United States Patent 6,900,016 (POLYMORPHISMS IN KNOWN GENES ASSOCIATED WITH INFLAMMATORY AUTOIMMUNE DISEASE, METHODS OF DETECTION AND USES THEREOF) - sequence listing, part 2

SEQ ID NO: 613 - DNA, 33821 bp, Human
taagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggtaagttctttttcctttctctcttttgcaaggtttcaaataaaattgcctttctagagcacttccccaatccatattcagtttataatctaaaatgtattttacaaagaagtaaatggattgttcgggctccagagatgtcttttttcatgcacaggattttttacttttaacaggatacaatgagtgatcaagcactcgaggctctgtcggcttcactgggcacccggcaagcagaacctgagctcgacctccgctcaattaaggaagtcgatgaggtactgaccttagagttgatttacaaagcttgttagtctgcacattacaaaaccgaatgcactctgcatgtttagaattctcgcacaacttttattggagagtaaaagtgagcattcttcattgtgccttatttattgctgagtggttagcaactaagggggatagttacatgactgacttgtgaaacagctagaattttaacatttgaaatgaacacgaatctcccttgctagagcttaaatgacccttgactaaacaaggtaacaaggaggcaatgcctggtgggaaatagtgaagtttggcaattggaaatttgtattttcagaagggttctgggtgcttctgtttataagagaaggagatgtctatacacggagtgggaagatccttcatttatcactatggggaaagatgttgaaaattttgtctcaaattaaaatcaagcaacaattaccctaactagagctcctgcatatttatagaataatgctgatgagtgtttatcccgccacactccaagatcttaacaagccttctgaaccaaaacaagcttacatctggtgtaggaaagttttaatattaaattataatttttgtggaatttttcaactcagtcctctggggtgaaagaggaaggaaaggagagagttgccggttcctgacaaggcagtgttgtggggagatggaaaggtagcctgggatccccaggagcccgccccacctccatcagctcaggctgggggtgctggcaggcattgctgtcacaatgccccatctctgctgtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagtaatgtattgggaagaagggaaacttgattacaacacaatgtgagatatacattacttagagtagccgacagaagcagtgtcatcttgaggaaagcggggtgttggcagaatcctggggggagtcaggaggccaagctgagttgtggctttaccacctgagggcgacagggccacaagtatattgcacttctgccccaagcttcttacagacacttaaggagagacaattaatgtgggaagggagggtataaacatgtcataaacctcaggatcaaaggagtcttaaaagtgactaaaagcagataagcagatgttaagaaaaaaagtgacataaaataagttatttaaacatgtgggtaactagtttgggaatgcatatgaatgtattaagttccctctagaaaacttcagagtcgcagcaaactaaaattccagcaaaaagaactcctcttttccactcttatgacataatagttgtattagtctgttctcatgctgctaataaagacataccagagactgggtaatgtataaaggaaagaagtttaattgactcacagttcctcatggctagggaggcctcataattacggtggaaagtgaatgaggagcaaagtcacgtcttacatggaggaaagtaaaagagcatgtgcaggggaactcccctttataaaaccatcagatctagtgagaattattcactatcatgagaacagtacaggagagctccgcccccatgattcaattacctcccactgggtccctcccacgacacgtgggaattatgggagctacaattcaagatgagatttgggtggggacacagccaaagcatatcactagttttcctttttaatcatatacaaagtatgaatgtttctaaagaggatctttcagtcctctagattattaacctgaattcttagtacccgacttagtgggtcctttacatcctagatagtctgatgtgatgagaaggctcaggaaggtcactgtcagcctgtaggagtgtccattgccaccccagcataccccagaatagagagctatctgtggaaaaccacacaatactccagagaggaaacccatgcctacttggtattcccatcatctaccataacataaaataaaagttttttattctctaatgatagcccattataagtctcccacatttttaggtgtggctgcctagtctagtgccatttcaattcagtaggctcttttttttcgatgcctactgtatacaaaccagagcaggcatttcaagactataaagatcaaagaggaaaataaaagctctggccgcatgtgtaactttcactgtccacagcctgagattagtggggaggaccgtcttaatacaggtgaccctggatgttcatgaaggccgctgtgccttgacctggggagtgctgctccatgacaggatttctccagatgccgaaatagagcgtgactggaaatgtttaaaagaaaaccatgacttcatcctttaatgagagcttctctataaaacagtgaaactaatcccaaagcatagaacagtgcctggtccattaaaagtgctcaataagtagtaattaatcaactaaccaatcagtgggtttagttacatttaatgtttaaatgttttcatttgttttgttttttatatttcctgtaaaacatgaccagctgactttctctattattgtgcgtatcctgtttaaatgttactaattacaattgtttaagaaccacactcttaggctaagatgcagatgggggccgtgggttgggttggaatatgccaagtgaacctcctaccttggttagtaaattaaatccacacctttatataggtacaaattcttacatattatggaacttcacactacccaccagcaggttaaattgcaagtgttgtgtcctagcagtcagtgatctactatagaactatgcttttatttgtaatgcagctagttgttcatggttcagtaagctagagaagtcctggcattattgaagagagtccttttaaaagaggtaaaacaagttatccatggatcagccaagatttgtgatgggccgcttctcccatatctgaactgggtttaatgtgaaaattagtcgtgtttcctctcccttccttagacagctgcctcgttgagtaagacagatgaaggccattaaaataattgcaactaactgctgcactgtgcttactgtcttcaaaggatcttttatttacttttctctggtgatcttcacaagtcagtgagctagataagggttattagtagccacattttacagctgaagaaactggaccaaataaaggctaagtggcttcccaaggtcacagcagctgggagcagaacagggcagttgcccaggatccctggctgggctacttttgctcagtcacccactgctccctttctcacagctgcccaccatcgtcttgtgctttgtagtttacaaggctcttccagatgcttttaccagatttggtcttctctataacactcgagaagtacacagaggaagtgatatcatctcattatgtgcattatccaactactttttttttcccctccattttcatcaggcaaaagctaaagaagaaaaactagagaagtgtggtgaggatgatgaaacaatcccatctgagtacagattaaaaccagccacggtaaatttttagccacagtgcatgacaacagcatcttgcctttgcatcttgttttgttgtatctgtacccttgacattgtcaaaggacatgtctgtcccccattcagatattaactctgaaaaccctgaacctttttttctctgctccctacagttagaccccttgagggatggtttgtccctgcctggcttcctaagtagtgaccatgtgttcatttaaattcccacagatttaaatgtttcgtttattaacagttcttacaatagatcctaaaactcagaaggaacaatttggggataatttcttttctaactgctatatggataaaagcaccataggtcttctgaggggtagatatgaatgtacgagggtttaccagtatcctaagtgaaggtggttttgttgctgttgtttttgattatggtgaggatggtagactaactcctgtcattacatttgtcatttacttttgaaatcatgcatataaacacatgttggaaaatagttacaattctaagttatgaaacctcatatccaaaaaaactaaaccgtgttataggaatgatatccacctcttcactctaggttggagaattggggttttttaaaagcttcgattaacatagctacatctttattgccaaagaacttttttttcctattactctacccaacagattaaaaacatttttaataacttaaagtaaatgtgcattctgcttggtaacatctcgatttttatagctcaactcctttttttatactttataaaaagtaaatctgaaacacaaactcatgtaaatctaagaaaaaaattagctgacatttcatatcctggaattcccagaaacaaacttgatgggacatgaaagcaaaattttctatttcatttccaatgaattttaatttcatttacaggataaagatggaaaaccactattgccagagcctgaagaaaaacccaaggttaggaaatacatttttttctgatacttaaagaacaatagacatgtaaagtatgaattaagataattttgacagtctggaattcactgtgcagacttgcatgctaacctagtacagaggaaaggggaacttctgatggtaacacttggctgatacctgtagctcctttccatatattttaaagatgatcttcctcataaatcattactagactataaatttctaggtaaaatttattgcacactagaaactgatgtcaagagggcccttaagtcagattaagctagcacttagagttccatcctgatcaaattctctaatgattctattttgccttaagttggtagtaacctgtcacatacaatcagcaacatttattaatcgcttgctatgcacctggcactgcaccaaatgctttttggatattatctttgtgagtcctcaatgaatgaggacggtactgttattattcccattttacagtgaggaaattgagacacagagggcctatgtaaatagcccaaggtcaaggggctataaaatagcaagccaagcccaggacttagaactcaggctgtctggtctgagtcccagcgtctgaatcacatgcccttctatcatgttactgttgttagtgacaatctccacatgccctaaactaataccactctcctgaaagaacaaggggtagcagaactttgctgccaaaatcctgcataatcatagaaacggagtatatcatccgtgttttgacttattcagaagagaagtcatgaggaaataggaaaataataatcacatttaaaaaaattatacagatcttcattgtagagaacaggcaattttatttgaacaaaattcttctgaaactgaaacatcaagggaatgtttgaccaaataaaccattaatactttggtcctgaggtgtttagtatttcttaattgtttcatgaaaattttatcttaacgttgataaatgaaaaaatatgccctttataaattagctttgggtgttaagtatggcctcatatgtgttaatcaggaaaaaaattgctccatgaaaactttttttttacaaaataaaaaagagtccccttgtaatatacagcacttcttatattacagcctcggagtgaatcagaactcattgatgaactttcagaagattttgaccggtctgaatgtaaagagaaaccatctaagccaactgaaaagacagaagtatgtttctaaacatataaatctctagttttgaggtttgtgatcttaaaaaaaaattgtgagacagactgttttagcatcaagcagtctgttagaaagcccaatatgccatcgttttttccatgtcatttttgtcttcctttttggatgtgctttctgccccaacctaaccctgatattcttgcaattgaagtcctgcaatgactccttcggaaagctctggaacccatgccttccttcttatcccagcttctgtaactgacctgattggaactgtcaccacccctcccctctgggttgcagtggcctttctgcagtctccttcatgtccgccggactcattctttctcaagcatgtctgtagttatgtcattcctctgcttctatccccaggagtttcccatccctacaaaaaaaagttcctattaccatattcttgacccagttttctttcctaccaaactgtgtccctgtgtcagtaaacagaacaataagtatgtgtgcatccctggcttttctcacttggttcctctgtcttgattgacctttctttctaatgctagatcaactaaagtcttactcatcttttcaaggctctgctgaaatatggctttatctgctgcttttccctccctaagctatatccatccaacctttattaagcagaacacaacatggcagaggatctgtagttctttttttatatatcactattaaagcctttgttacaaagaagagtttagctgttttagtccctctttaactctaacatttatgccaagtttaaatgggtagtaagttccttgaacgaagagatcatatcctattaatgaccatctgctgagcaccttgcatataggataggcttccataaaagtctagatttaaaacaatttgtttaaaggtttgcttctgttttttttgtttgtttgttttgttttgttttttcttgagatagggtctcactctctctcccagctgggagtgtagtggcacagtcttggctcactccagcctcaatcttccaggcccaagcaattctctcgcctcagcctcctgagtagctgagactacaggtgcatgccaccatgcctggctaatttttgtattttctgcagagctggggtttggccatgttgcccaggctgattcaaactcctggactccagtgatccaccctccttggcctcccaaagtgctgggatcacaggcatgagccaccacacccagccttgaaactttattcttgtgataaaataagatgggacagtggttctcaaactttagcatgcatcaggatcatctggagagtttttttttaaacacaggctgctagactctacccccaaagtttcttagtacatggggcaggggtctaagaatccgcatttctaggttcccttatggtgctgaggctgttagttcagggattacacttccaaaacttgtggcttattactactaccttccattcctacatagctgtatataaagtgctcttaggtttatataaatacaatattttacataatgctatattacataataggcatatttgttatacataatgacaaataaataatagaaataatagcaataattgctcaaatgtattgagctaactgtgttcccaggtactatgcatagcactttgcctgcattgtcttatataggcctcttaccaacccttcagatgtggatactgtcattgttctcattttacacatgtggaaactcagtttcacgagtttcagtaacctgcctaaggtgagaagtaaaaccaagttgaaaaaaatggcagctgaagagttttagcatgctttgacttatttactatttagcaatccttaggtattcaagagaatcatgttcacaccatataatgtagcggagtgtcttgttggtctaccattactcagtcttattaaccaaatatttctaaacttattgagagtacttgtgtctttcctcaggaatctaaggccgctgctccagctcctgtgtcggaggctgtgtgtcggacctccatgtgtagtatacagtcagcaccccctgagccggctaccttggtgagtgactccctgggcatttgagcagtggcttgagaaagttttctgcctcctcctgtcactctctgctgtgtattaccatcattttatcttatcctgacaaattaaaaataaaatctgatatcattatagtatctgttgtttctttgggcttcaggggtgtcgtagaaattcagactaagatttaaatttttaattaaattactcccaactgtatttttctctactcttctgaaattctagttcctcagctattgtggataatcctgccttttcacttctctgcatcttttaagcctatatagatttccaccgaaagcccaaagttacttttttactgactttcctggtagaataacatgcagtaaaatcattatgattcctccccactcttcccactgcaggaggtgaaactgactcaatttctttctctttccttcttcttttcgtgcttctctctcactttctaattttcacatgaagtatgatatttaagaaggtgaatctttgtttccttttgattttagtgttttttttccattagttaatgattgaatttgactcagggaataacatctgatggaattatatttcaattgtatttcattactacagaattagcacatcttccctctgaacacctacctttcatcatctgctgtgccattgctctagatgttttgcaatgtcttctcattaaattttcacaaggacactatgaagtctgtcctgatcatcttcctgtaatagataagggaaatgaggctttgagttgaccttgatccacttgatatttcagagcctcagttgagatgaaagatatggcccctgctctcagctgtcttcaagactagtgtggatatgagccctccccagttttttggggtttcagggtactcttcaggtactttttacagcatgtgtgctaggccacagtggtaaagaaccggagaggaggagggactctaggaggactctggtgaagaaagcaggcaaagaggctgtgattggagtcaaaacaacaatagccagcattccccagtagaactcttgtaaccaaaacctgcacctgcaccacctgcctcatctgccaagtgtgactgcccgggctttagagggctcaattccttttcaactttaccctgactgtagagctgagcattggattgttagaaagcagacaaaccagaacaaaacaaaaagctcttgttttccctttccccgtcctcctttccagggccttaaccccaccaactctggccatggttgcccaggttactgtcactgaggcagttggcatttctgggattgtgacaccctcgaacgccagaaagaatagctgtagagtgtaataaaggtcagaggactcaagaaaggcatgaagattagagagtaaaggaagacagaccagaggaaggagatgaatgcgttccctaggtggttcttgtgtgtataaaagaaaatttattaaggaaacccagagacctgagttgtagttgtgaatttgataatatcaaatactacagaaatagaagttttagtccttactcctgtttccagattcctttgttcttaagtctgcttcttctcctaggttttctttaactgtttcagtaatttcttaagcaagaggttggcaaagggcacaggtttggggaagcagtggtttccaaagattctgtagcatagagtatgagaaaacagaattgtagtgtgagcaggtgtcttaaatcatgtagcaactcacattgcttgcataagacttgggtaccagtgcaactcttgatatccttgattagagtgttgcaactcttaatacttaatacttaatttaggtataatcccaaacaggttagaaacctcagggattttttttttttttttttttttttggtagctcttgggaataaaacccatgcagtattcagccactaggtggtgctaaatcacttttctttggtgatctttccttttgcagtgcagtttatcagaaaaacagcttttcttacttgaaatcatggctaaaatataaaacagaaatacagttttactctaaaattttaataggtgctcattgtgaggtcagagattttaataataagattaaactctgagattgtttgacccaaggccttttacatttttgtttgaccaagaccaacagtgggaaattcattgatattgcaaccccatccccatacactggaagcaacagtttaaagaatagtatttatcccttctatgtatgatgcattttatacacacacacacacacacacacacacacactcttacatttttttttttttgaggcagagtctcgttctgtcatccaggttggactgcaatggcatgatctcggctcactgcaacctcaacctcctgaggtcaagcaatcctcccacctcagcctcttgaggagatgggactacaggcatgcaccatcatgcctggctaatttttaaaaactttttgtaaagatgggatctcactgtgttgccccggctggtctcaaactcctgagctcaaacaatcttcctgccttggcctcccaaaatgctgtgatggattacaggtgtgagccactgtgcctggtcctgttctcttcattaaaaaagaaaagtcctggccatgaaccattaagttgattcttatgacctactaatgtacagacgattccctttattttcccttgacaccattcatcctctgtgttcaccagtgtgattttaaataccagcatggccagagttcattacatttgggggagtacatttcattttgaacaatcggaccacaggtagacagttctcactgtgccattcaggttagttggtcacaggcagagtcatcagaaccagccctgaaactcctttggtcagtagaagccctgtggagaaaacaggcttccgagcctcctcttctgagacaagccaggctgtcccacaggaaatggagaggaatggcctcttgtgggctctctgaaaatctttcctgtgccgtctatggaatgatctccataaagaccacgtctttcttttttcctggtatgcaacttatctgtgatacacctcagtccattgtctttcttatttctaaaccaactctgggtcaggtctcgtaagtttcacattatcaacatataatttgcacacaatgtttaatataagaaatttgctcgaatgttaaacgttttgttttttaaacatagattctaattcagttgataactcgagttattaaaagatagcatgtgccttttatctgaaataatgatatgcctttctgaattgatagcatatgttttaaagggagtgattaaccacctacttaatatatccactaatgcactttcagaagggcacagtgccagatgatgctgtagaagccttggctgatagcctggggaaaaaggaagcagatccagaagatggaaaacctgtgatggataaagtcaaggtaatggcaactgagatgcttctggaaaataaatatcattgatcaccttctccccctgcaaataagttagtcatttgttttgttttttatatttcctgtaaaacatgaccggctggctttttctattattgtgcatatcctgtttaataagctaaacctgaataagctgcagtgttgaacccccacagtggatggtcgacatgcacagaccggaggcctctgagtctcatctttgcccacctgcattgacattgctgggacttgggaaggaaggggcagctgcctgctgctcctcacagctgtcttgcatcccagcaggctttctgctggtgcctgagtctgccagatgaagttgctgtaggagcactaagcatacggtcatatgtacttcctaacctaatgatagatttgtttacctcaaatctagtcactcaggcatgaattttatggagagaaaaaaacatgctaacaatgaaaatggtataatttttctcaggagaaggccaaagaagaagaccgtgaaaagcttggtgaaaaagaagaaacaattcctcctgattatagattagaagaggtcaaggtaaacaggctggagtctttttctattttattttaattcatactgaattcatacacagaacaaaggtacttgggaacagaactggaatataaagatcttgtttcttcatatttcaaacaccaaatagtattagtctactactaatagtgttagaacaccagatacaaagctaaaatattcctaagtagacttgatcctcaagtgaaagaaatctaatgtctaagctacctaatgttttcctttctaacccacagcttgttacaataccagaaatattaaaaaaccttgtgtagataggagaactaaaatgaggaataggccgggcatggtggctcatgcctataatcccagaagtttagaaggccaaggcaggagcatctcttgagcccaggagttcaagactagcctgggcaacataatgagaccctgtctctacaaaaaaatcaaaaaaattaggcatggtggcatgtgcctgtagtcccaggtacttgcgaggctgaagtgggaggatcacttgagcccaggaggtagaggctgcagtgagccatgatcgtaccactgcactccagccagggtgacagagcgagaccctaactcaaaaagaagtaaaaaatgaaaaaaaataaaataaggaacaattactttatataagaaaaatttgcaactttcagatataagttggaaaaataagagaacctatttaacattgagtatagtgttaagttgccccatttcttctattttgaaagtacagattgtacacaacaagggggaagaccccattatgagtcctgtggtttaagtgcagtcacttaaatgaggcggattcgtggacagttgaacaatgtcagtcatctttgtagcaggccaggatttgaaagagtattcaactaaacttcattaacaattctagaaaatcaaattcatgcttctcactcatccatgtgcactagcccatttatttagcagacacgggaactagactgaactatccgtgattgaaagtttattattctggaaacctttatatttgcttcctgagttttacaattcagttgcagccatagcgtttctattaatttgggctcatttgtacattgctttgcaaagttcctagagagcatgctaagggccacatgttctgtctccactgagtgcccattcagtagaggctggtcaagtgcaggtaaactctcttcatgataggtgattggttggtgatttgctctctccctttactgaatttagtagtagtgtttaaggaagcagttgattcacagtccctgatcactttattctgtagtcatttcatcctcctctgacttacctcacacgttattagttacctattaataacattttcaggcactagcttcatctcatttaaatcctatgttggtattcaccagctatgttcccatcaggtctcctcagtgagatttggctccccgagggcaggccacaacctccccttccagacgcagaatgacgcagtgatggaaaatcgatttcagtttgagtagggagcaaaagtgctcccagagtcccaggcatcacttaggaaattttctgcctttacagctaagagatggtggagaacaagcccaggttcagctttcccctgtacctgaagaatggtcagaaggcaaaagtcagtcatgagggaaacaggtgatccaagttgaatatccctcatctgacatgcctggggaccagaactgtttcagatttcagacttttctggattttggaatatttgcctcgtatctgttgagcagccctagtctgaaaatccaaaatgcccccgtgagcatttcctttgagttgtcaggtcagcactcaaaaagtttcaaattttggagcatttaaattgttttcagattttcagattagggatactcaacttgtacctctaaaccattgcacttcacattttcaatgaaacaaaaaccaaccttaaccagtttctcaggtgaaatattcatatatatgtatatctttgtatttacttatttttgtgtaggtggataaatgggatttactattagtatatagatctccttttactaaagagccccgcatgctttcttcattttgtcgtgttactcaaatgtggcacttggagtcataaacagcttgacctaatctgaaccataagttgcagagcgtttcactgacaggttaaactccctgagggcaaggcctttgtgcgattttctgttgtattgccaatgcttacttaggtcagggcttggcatgtagtccttgcatatgagttagatgtgtggcttacaaggttaaccagcattttccagacaacctctacaaagcccacccccatgtaggtaaagggcttatcccacactgtcctgcaaaccccagtcacagcaccacataccacactatgctgactttcacgttttcctgctgtgatagtctctaggcttctgaggtcacaagccatacctcatccagtgtgcagcccccgtgactcaggaatgcctggtgcttgtgagctgtttgttgccatgaactaattagagcgtattctctggtgagagaatccttcgtgacatgatggatctaatttaaaatgtacaacagcaagtataacctgtagaccctttgtaatgtttacaaggtttcatactttggataaaatgtaaaatgatttcatgccatgtgttttcccccccggataggataaagatggaaagccactcctgccaaaagagtctaaggaacagcttccagtaagcaaaccagttttctctgaagatatcttttccttttggccctgattgcaatggtgtttgttgatacatttcctggttcttgcagcccatgagtgaagacttccttctggatgctttgtctgaggacttctctggtccacaaaatgcttcatctcttgtaagtccaaaactcttggttttatttctttagttttttttttttttttcctttgagatggagtcttgctctgtcatccaggcgggagtacagtggtgccatcttcagtcaccgcaacctccaccttccagattcaagcgattctcctgccccagcctcctgagtagctgggactacaggggtgcaccaccacacccagctaatttttgtatttttagtagagacgggctttcaccatgctggccaggctggtgtcagtctcctaacctcatgatccgcccacctcggcctctgaaagtgcttggattacaggcatgagccaccgcgcctggcctatttctttagttttagagtggcagaaataaatggaaactggtgacttagaatctgacttgggaactcaggaacaatcataaaattaatggccctcaacccactgtagccattaaaaatgtgttgcaccatgaaatactgtcccaacatagtggatgcttttattagtgtaactaatatcaagtaccagtacccctatgaaaagagaatttaaatgtaagcttatccaaaattactcctcagacaactttacctattgatatttctacaatttatcatttcccaaattgcctcctaagggaacttagctccatgtggaatatagagtccctcaaagggaactctgttactcgaaaagtttggacaatattgggtaatgttaagcaggtttctctactgtaggattttcatggctttttatatgcaaatatatagtgagtctgttagagttcccaaacttaataactgcagaaccttttcttgtggggtctggtttatctgtttactgggaactcagtttttaaaccactgaatgtattattagcagtcagttggaaagggattaacagtttctatgacagtggcatggaaaatatatttatatcagttggagaatagacagaatgacaactagaagaaataatgattctttggaattgcctgaagttgttacttttgctgaatgaagcaataaagcccctcaaagaagagcttactaaccagagcatgttattctctgtacccctgtaaaagcaccgtgctgctcagtcacctcatcccgtgaccttcctctcatcgtcttccatacagaccacatcacagcaaagcactccagccttgatttagaaaccataagacatggggaagaatacaatgtgaggagtacgccaggaatgtggagtcatagcattacactgaggcagaacagatgaacaaatagtggggaacaagatctcaattcccttcctcctcctatcattattattattacaattgttaggggtgttttttcttttagaaattcaaagatttggaaaaagtaacaatggatttatatgcccccttcaaagatatgtagcagtgaaatggtgagatgaaacaacctttaaaaaaaatcttactcttagaaaattagcaaaggaaacattagtgccaacaatatagttaataaagtagaaataactaatcatcatgagaaccaaataatcaaaatagttatttagtggaaagtttcaagaaatttgggggagaagtatcacatatggctcataattagtgttcatctgtaaaagagtagctcctgtacgtaccatgctctttgatataatagaacagaaatgctatataaaaagaaacacttaaaactattcccctaataatactgagatcacattgataatagactattttaaaacatcaaagatattacaagaaaaagtctttgagaagcagtcaaagcagtattcctgtgatacattgtcataaacacctttatcaatagtagagaaagagaaaaagagaaacctgataaactaaatgcttattgaattttaaactgaaatttctaaaagttttaataaggtagccaccaaaaacaaagtagcaataagcataccaggaaatgaaaatagcggcatgaaagttaactggccaatagttgtttcttttgaaataacaaatactttataaaatactagcaaatataaaagaggaaaaaaaaccttacaaaaaatacaattaaattttaacagagtaatataataatatagagatcaactaaattattggtagtttaaagccaatagtcagttggcttttatgaatttttaacattttacaaaactgataaatagagaaaataatcttactaataaaatttaacataaatgtgagaaaatacaataatcagtacagagcacaaataaattattaggaaacactatgtacaacaattttctaagattaaacaaaaatattaaactgcgtaattcacaaaacctaaaaaaagactgaagaaaatattgcaatgattttcaaactgtccttctactgaaggtttaaagatgactctaactgttgaacactcagttcttatgtggcataaatatgtcatgaaaaagatggggtcacatagttgcttctatgagtaattatggtgctaatcttaaaatctgacaaatataacggtatcagctaaagttacttaaatgtgtagatgtaaaaattacatacagcatacatagaatataacaaacagttaaattatttgccattataagtattgattcagtagcaggaaaactgtcaatatattgtagtggtatatcaaatagaaacaaataatcatgtccatgtaaaagatctatttaaaattttacatatactcatattataaataaaaactttttaaaaagtaggcaatcccctaatctgttaaagagtctttagttttcagaatcaaatattcaatatcatgctggaggcattttccttaaaagcagaaactatgaaaagtttattgtcatttctgcttattatcacatggaagaatcattaacaacacatgaaaaaaatgacaaacattaaaagggaacatttgaatatatttgtggatagcactacttgtagataatacatttgtaagtaacattatgccatgtttattagtaacaacagatgagaaaatgtaattaatatgagatcagacttaatgtaaactataaaaggagaaatgatcagaaaaataaggacacaaaaaaattgaaggccatacattaagtcagtttaactaaatatcttaaaaagaatgatgacaattcaagtcattttatgtgttaattttttattaaatagcaataagatacttttataactcaataaaattattcaatgatacattcggaaaataaatgtataaaatatgaaaaagtactaaaaagcatttttcagtacttttaggtaagattaatccaactaaacactagcatatgttatacagtaataataagtggaaaatacaataatgttgagaaagcaaactcaaagcatagatcaatgaaaaaattgagaaatggacataaatgatttagtatttttaaagagagtgaaaaatcattattttatgcttttgtgtagcattagatgaattaaataacatatgcacatatagctttgcgatacaaatttccagaccataggttgtttcatacttagtattaaaaggcttaaataataagtcaataagatagtttaagaagagacaatacaaatgtttcaatgtcattcttttcatttgacaacttgttattcttttcatttgtcatataagcaaagatttctcataactaaaaatgaatttaatttagtacattttggattacctaaaatattacattctaaaacggctttacagggtataaatggacaataagtatcttatagttatctaaattagtttaaataatttccaataataacatgctgaaatgaatttctgaatgttggtatctttttaatgtgcttttctccatcttttggtaaaatttgcaattctcctttttcaaaataagctatccatagttggagtcaccaaagagttctggacttttttctggtttttcatcaacagttatacctaagtttttttgtcaaaagggagtatttgaaatgaagcaaatattcaatatttttaaacagaaattatttcagaaagtttctagaatatttaacgttgaaaaaaaaccctgaaacctgacaccgtataccacaatatacaagcaatagtagtatatcattttacactgattatcataataaaagtcaaattctggcaagcaaggccatgggaaaacaggcatgcttattcattgcttttcgcagtatgaattcctagcaacatttgagagggcagtttagcaaaatatagccagcaccataactcactcactagaacttattcagagcaattttaaaagagctgaaaactttgaataacctaaatgtacaacaggaaatgtgtaaacaaaccgtggaactctaagttatattattgcatagtatttagaataatcaatatgagaaggaaatagaaatagcaaattgtataaaataatacaatagagaagaaagaatttaaatttcttttaaaattatatgttattatgagtctatttggtcaagagaataaacagtcattaagctatcgttaagagttatagttaagtgatggcattgtgctcataattttatatacaacatgttactaataaaatttttttcaataaaagaaatttgaagatgctaaacttgctgctgccatctctgaagtggtttcccaaaccccagcttcaacgacccaagctggagccccaccccgtgatacctcggtaagcagcacatcttatttgggagataaatgtttttgcgcagccacaactagaaagaaaatagggcgcctgtttaaagcaaatgaaaataggcagaattattaggaagatcaggcaccttctatttcagaagagccaagactgatgatttagcgagatggcagagattaactttgaaatgattaaatgaaactatatatgtgaaaacattgtacacatagtcaaggaccttaatattattgttgctttataagaattgaaagtgcaataaagtgcattgtgtctatattcaaattactagatttgaaaagttctttagctttcctgataattgattttctcctttatattttttcttatacattctataatttactacccattatttaacctcaagtttattttatggaatcgtcatgtttgagcttttacaaacattttacaaacgtcatggaatagcattgttttcttcccaattcacaccagtaaaaatttgtcactttcatactagcagtagaagaacctcagcatcaatattgttttaattatttacatgctgtgaggcaaggctgtgggaccaaagcttttccagacttccttgactaatcacctgtgcaataccaaattatacattaccaaggagaccacagcacatcaaattataaagggattgccctaaaccagatccccatctcctttggttgagaacagtgcctcatttgctagatggagatgaagtaactttagcgaagtcagctatgcttccattccgtttgatgtagcatcaaagcatatttagtgctgtagtctgagattctgatggattttcatcctgttgcgtcagcttcaggatcatctgaaaatatccagaggcacaaatgacaaagcccagacctggccccgggcagctctaccattagcagctataatcctggattataataaagcacttaaaaccagtaaaatgccccgtgtgtgtgtatgtgcatgtgcatgtgcatgtgtgtatgtaaacacacccacaatgaagaaagtccccatgcaacagaaaggaagaatcattaatagcctaggctgccgtttacacttcagttcttaatattcaggccagagattctgccctgatgaaggctatcagtaaacatttgcaatcaaaaacttttttgcctttaagaagtaggttttacaatgacacttctctgatcacatttcccatcagagaggcttgtttttagttaacattttatttgaagatgtcactaaaacaaggtataaagctttatttagataaaaatattaggaaatcgaagagtcaaataaaccatgataattcacgggagctttctttgctgtgattattagattgttactaacagtgttacatacactgaaagcatttgaagacatgatttcaaagatctgtgtaataaaatcactccaacaggaaaactgcttcaaagaaaatagaagatcatggatgtgactaagcatgacagggaaaagctttatcagtcccaagacctgggttctattcactttttaacaatttgttttcaagcaactgacttagcttccctgagctttttacctcaaaaaaaaaaaagcctgcttagttcactgagaaccattgtgggcatcaaataaaactggatagtgtatgtgaaaacattttgaaaatcaactggaaagttctatacagtattggacagagttcagcatggtgtcttatacaatgtagatattaaacacattttaattgaattcatttagaggtggaattttgaatgcaatgtgttgaaaaatatggattttgctataataatactaataataatttaccatttgttgggtcctaacatacaactagtattgttttaaatgccttttcaatcatttacttttctcagcaacttaggagtataagtactactattattcacatttcacggccaaggaaactgaagctgaaaggggttaaataagctgcctgaatcatacagtaaataaatgttagaggaaataagctatcttagttacagtgatattgttgtccataatttttttcctctagaataccagctcccatttctgcaatttcacttccatgagcttcctgaagatgaaaagagaggtttccccaccagttcagaaattctctgaagtctttcagggcactcatcaccagtgtggcagacaagccccttccactctcctgaccccagattgtctctggggttttgtgctttaggaagtattaggatggcagtgccgagctccatggcttcccacaaactgcgggtcacgctgcactttctgaaatgcacccctcaagatcttagagttttagagaggacccacagaaccaaagaaacacttaccctctatagttgcagaatcttgcttcctaaccatctgacaacattagtagatgtttgttttcatatccagttttctaatggtgtttaatttctaaatgaaaggcacacatgattggttcatttgcttttggaccctttatgtgacctccaggtcacccactggatatggctcctgaggctgccactaagacctccttaacctggtgggatcttcaccaagagatgggcagggttgggtggaaggtgctggccctccaaccccagtagggtgacagatactgccgctcttctcctgatcttccattcctagccttctcttctctgaccctgtctactcccctgccccagccccagatgtctttttcttccaaggaaacaggttccctcctgaaaagatggagttcctgggctaatttgcctctgatacagtttggctaatgagtgactaattcagcattatttacttttcagcagagtgacaaagacctcgatgatgccttggataaactctctgacagtctaggacaaaggcagcctgacccagatgagaacaaaccaatggaagataaagtaaaggtaaaaaaaaaaaaaaaaaaaaaaattcactaataagtgaaattttaatccttgggtcttgactctgtcattgtcataggaatattgatgtgaacttaacctatattttaaacatgaaattataatgaaatagaaaaatcaatctgtactccactggaggggaaggtcactgaatctgtgacagagataccagcggagcctccctgaggggattctgggaggtaggtgtggggtatgcatggcttcctcccatgcaacacaagcagtcagcacatccattcaaattagctgttgtccttcagggttgcttataaataggcaaagttgtaaatgtgacctctctaaatggcaaggtacagtggcctgattttgtattagaaaagtgaaaccatacagaaaaaaagaaaaagatattttatacctttgggttctaatctcctaacatggtttctgaagataattatttaatcatttatttccatttaaaatatagctagaaaattcacagatatgaattgacatacagaagcatacgggattttatattttagccaactagcagtctgttgaagtcatctgtgttgttctgttgcttaaaaaataaaaacagaccatatgttttgcctcatgaaagtacaacaaatgctgaatgctgcatttgacaatgtattttctaagtgaaagaggaaatgaatattaattctatctgctcactgttgatataggaaaaagctaaagctgaacatagagacaagcttggagaaagagatgacactatcccacctgaatacagacatctcctggatgataatggacaggtaaactgaggcaaattgctagatcggatttatgctaccaagatctttaaattcaaacctcccttgaaataaatagtagctatactcctttacagtagcataaaacatatcatgactgactgcttctaatgtgtcaccaaagccgaccagcaggtaaatatttatttgagccaatatcattatatatgcatatgctaggctctgtggtataaacagggttgaatactgttcagtcactcacagatgcttaagagtgatccaagaaatgtgattctctctttcaagaaaaggctataaaaatgactaaggtgataggatttcaaaggaagcaatctctgtttaaggagagcagaaaaggagctggtgttgggataattaatagggaaaattaataaggcagctccaagacctggggtctccctatcttctcctgcatcatcatcagcactattgcaagtgaagacaggcaaagcaatattcccaatcacaaatcctgtttctctgccaaaaagtccctggccttttgtctcccacatgatagaggccagtctttcgtaggtcaaccaggcctgtcccccacctctttcctatttagtttctaatttttgagtcaattagatgataaataaccctttccatgcctgttcatcaaataagaaacaaggaagaccaaattacacccttctctttctgtactgattcattttggtgagtaagatgattcctggtttaaatagcagtgtcagcttcagggtctcctattacaggaaccaattctccttgcttgcattcagtattcctcaagatagcaattccacatcctgctagagcccttcccactttgatagtaccaactcaccctgcttgcgttctttgggaaatttattatttaaggcccttgcctttgaagctgggaaaaatccctgatgactttctaagtgtaataagctatagtaaataagatgtaaaaacacaagtaactttttataacactttaagtagaattataagtgataatacatgatggcagaaggttcacaaatagtgtttctttcacttccaggaccagaccctttcatatgtttcccccaagtctacacaaatgattataaagaatagtaattaagcaaagctggtaaagaaatagtggggactcaggtttattagttattgcaagtctacactccattttatccaagtcaagtcatgggacaatagattctctactgcctaaacctaagtaaacctttacagatatctatgcttaaccaatagtctgccttctttttaaggacaaaccagtgaagccacctacaaagaaatcagaggattcaaaggtaaagaccataggaacatatttccattaaattttgttttattctagccataggggtatttggcattttagaaaactaaaacatattgaatgcctactctgtgcctggtactttgtcaaagcatgcatataaatgtgtgtgactattgtttacctctcttttagtcttcacaaaagccctttagggtggaaaactgaggctcagagaatgctaagcaacgtgtattaaagagtagatggaaaaaaagccatcaagattttcttgtttttctatctcctttacaatacattattattaataaagaatgtcagtcagtttttttcttatagaaacatcttttatttgtaagtgatgtgggaaaagaccccatattgcattttgccttctgcttcttcactgatggttatttctactcatatctcagaaacctgcagatgaccaagaccccattgatgctctctcaggagatctggacagctgtccctccactacagaaacctcacagaacacagcaaaggtactgtgctttttcacatttcactctttgaaatgtgtgtgtgtgtatgtgtacatacatataagttttatttattgattgatctatctatcggtctgtcttgtaacagggtcttactctatagcccaggctggagtgcagtggtgtgatctcagcttactgcgatctctgcttcctgggctcaagcaatcctcctaccttagcttcctgagtagctgggactacaggcgtgcaccaccacacccagctaatttttgtatttttttgtagagagggggtttcgccatgttgccaggctggtctcgagctcttgggctcaagtgatctgccaacctctacctcccaaagtactgggattacaggcttgagccactgcgcctggcccttacaatttttaaactgtagaatgaatcaaacgatgatatagagaacctgaaaatgaagaaaagaaaaaatgcctataattccactgcccccaaaacagtattattttgtggatttccttttttttctatatgtatattttacataattatacttacagtccacttataaaacactgcttaacgttatttcttaactgctactttgtaatttccatagccaccattttttatctccacactatatggttgtgccacaataatgctatgtctgtgttcatttaaagtgagagcaggccctaactacatcaggcactctcatgctcatttgctctctggagcttcctccccttttctgtctgcttagcccaactggtctactcttcattcctcagggcacagctcaagcatcagctccttagggaagactttcttgtcttacatcttctcccttcccagtccaaagttagaggcctctcttccatgccctccttgctctctgttacctctctgtgcttgtgtatcacaccactgagctacgcatttcatacagtagtgatgtgtcttttacctctgtgctcctcattagcaaaatgcctggtacttagcaggtgctcaaaacgtgattaaaagtgaatgagaaacaactgtgtaattcaacaagtgtgaggcattttccctcaagctacaccctcttgtaaatcaaatagaaggaaacgtgaaatgagtacctccttgttattttcagaagagttaattctgcagatctcagtttgctattgttttggctgttctaaggcactgctctcgatcactgaattgtcagcccttccatactgggtagcttaatttctagaccacttcagcatcctatctctcacccctggtaactcgtaagtaatgccttttttggtgaatggactttatttttatacgtaacctgctccagctttccttggttgtttcccattgttcatttctctcccataacactgaaaacagggtttttttttgtttttttttttttgccttttggtacacaaaagccagtcctgatcgagacaagctctattttgttttttaaatacattttattgtgtatatttgaggtttacaacatggtagtttgggatgcatagaaataataaaatggttactgtagggaagcagatttacatatctatcattctcacacaactactttttgtgacaaaagcagctaaaatctacttagttaacaaaatccctaatacaattttattaaccttagtcctcatgttatacattaactctctacacttgttcattctgcatatctgctattttgtatcctttgacctatatctctgtttcctcctcctgttccctaccatggtcgccatgttttattctctgtgtttttgagctttttcttttatatatattctacatataagtgaaatcacttttctttctgtgtctggcttatatcatctagtataaggtcttccaggtccatccatgttgtgacaaatagtaggatatcgttttttaaggctgaataatattccattatgtatatatacatgacattttctttatccattcatcaacaactaggttgttccatatcttggctattgtgagtaatgttgcagtgaatatgggagtgcagatatctttataaggtgataatttcatctcctttgggtatatacccagaagagggattactgggtcatacagtagttctacttttaatttctttaggaacctatatactgttttccatcatagcccataccaatctacatccccactgacagtgtactagggttcccttttctccacacccttgccaacatttattatctattgacaagctctgttttgattagcaaaataaggtctgggtgagtcaggcaccacgggaattagagcatcaatgtcacccacatttccctccttatttctatcctttttccctcctgctttaaacaattctctgacaccgttgttcaaaaaaaatcatgaaaaaacacccaaagtcttccattatttaattaaattggagatctcagaatggtctggattaatttaactgcagcctagttaattgctagatggattggtgatagccatagcctcattacatttcctttgctttaggataagtgcaagaaggctgcttccagctccaaagcacctaagaatggaggtaaagcgaaggattcagcaaaggtaaatggagcagtaaatatactacaaattagtttagcagttacacagagtagggtttatcatttcagtcatttagtttcctactggaatctatttagaataaaatttcttaaagtactatctatcccatagcatcgcttggtaaagtaattgaatttgtataaatacatatatttttaagtaactggtgctttaaaatcctaaatgaatgttcttgacacaacccaatttgcctgtgttttgcctgtctttcttgccctaattaaaataccaccatagtatgtggtttatatagattttagaacatggaagttggaaacttcctattattaaaattactcaagctgtgatgagaaatgaaaattggattagacaacttctaggtcccttccaattccaagaacatatgatttaaatgattattactatgatcccctggctataaggaggagttaaaggtgtagctttaaagacaatagtccagttacaccaaagcttttaaaacaatatattaaaatcttcctgtagtagattcccttaagggatataggaaacagcattgataattggcagttatgccattatatctcagattaaatacttatttgcctattatttaatttcagttatacgaagtacttaatcagccctttaacaaataatagaaagcataataaccctttatgatgagtggatttactggacagccatgaccctatgtacaggaaaggaaggatcaccacagaatgaaacattgccatttaagaacacctatgcatattttataacctaccctagccttaaaaaaataaagctgagagtgatacatttaggatcaggatcacttaaggttatttttagcttataagcttgaggaggaagaactcacaatattttggccagatgaagaagagaaactgaaaggaccatcttatttttccccactgactgccatcttttgtcccctaattctgagaaggccatctcctcatacttaatacagaaaagaaagctcacggatggttttgctttcccttttagacaacagaggaaacttccaagccaaaagatgactaaagaaatacaagttaaggtatctggtaagttgggtgtttatttgtaaatgaagacaactgtatcttctgccaatttatgtgttatagatgagagaagtgaagtccacctcttgagtaattcatgctcactttacagtattggcatgaaatgcatactgcaagatctacagagtaattggtcattctctgaaagcactaaatgggatgagtttgctattgaaatgtttaaaaaccttaatcttataattaaaagcttttaaaaatattaggccaggcacttagaatgaccatctgaggctagttgaatctttgaaatccaaatgctcattactgcaggttattgtggcaaagcaaaattagcatgttacaacttagcgaaatgtcctgaagatattggcattccccagaataccaatacatggtggggtggggagaagtaccctttagagtctggtggaaattacagggttttgggaacaagggcaaaggaaaagattggccatttttatttgtcattattttggaaagtaaagtactgtgtttgattctaatttataattgctgaagaaactggacagattgaagggatttctgagatcttcagaactgggcccttatcttaatcttcagaaaggagagggcttaatgtaagccttaaaagcatacaagcacttactgaccaaagcctaaaagaaatcaaagtataggttaaatcgggttcagctctctcaccatgatccatgtttatttcctaggaaaaaggagctatattaggtagaactgctctaacatttttcccaaaattaaaaaaaattctattaatccactttcatgtttacttataggaaattccttctgtctgttatacaatgcttttgctaagtggtatatttactatgtctgtaacaagaaaattacatattaaatgattcactgcattttttatttgaaatttttaaggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcatctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggctgcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaatcttggttgtgtatttttttaaaagaagggaaatagtttagtttggggtggaaattaccagtgatttctatttttattaaaccattcactacaacaaataagtataaaaattccaattccacttttatacctatttatttgttgtagtgaatggtttaataaatggcagatttatgtccagaagtcactctattttgtcgtgtattaggggaacacattttgacatttttcgtaccaatcatcaatcatattcccttatcttgaagtttttgccttatattcaaaaagttcagtttgaattctcctttgccaggtgtgaggatttccgcaccttagagtcagcgcaaaacacgctgcaacttgaatcaagtcagcaacagagcacactatgggttagataagtccctgtgtagcaagttttcagaataagaaataaaatctaattcttagggtattaactgacttgacttgaactccgttggtttaccatgttagtaaactgtgctttctattattatcatctatacataaaacctgagcagcaactgtgtgctgaagcaaccgtgtgtgaagtcttcacaaaagaaagacttcaaagccaaagaatgtcctatttgctaatatgagcaaatattttgtttcacaatgtactatcatttattggtgactgcaataatttactgtcagtaaatgccaataactagttagttagaaattgtaaagtaggccaaataagaagcagagagagaaaaaaaatcacctccctaagaaaagggttttcctacagacttgaatgcactctgctttttcagaagagatactgtaccagtcagggaaatagatgacactcagaattatctgaggagggttctataaaaagattttttgcaaaagtgcgagcacattatgtagaaaccacaagtccgccaggactagtaaaagccagactcccactgaggccactaatcctgaagggatgaggagggagcagttaccaaaatccagaggtggagaaggctgtgtggaaaagagggtcccctctcggagctaagaccctcaggggaggccagcccgaggcatcccgcaagggaatcagggaagaacacctccacctactacctcctccgaccccagctccagctctccggctccccactgaccaacatccaaagggcaagaaagcttgatgacttggcctttacaagtcagcccctgggcatggagcaaggaagagggatgggcagcgggtctggaggggtgagccgggagagctttaacccagtcatcgtccggcttagtctcagatccaggtgttcattgttcagtagtcgactattcagagtctttcgaggagactgatgaaacagtttatgaatgataaacatggggtacagggttttggacacgggtgcttaa

SEQ ID NO: 614 - DNA, 22155 bp, Human
ttttgctagaacttgttctgttgggactttttcttgtttgtgccccttggcattttcagttgttggcttctccagtattcagcctgagatatatgaggcaaagagaaatcccagggaattcaccaccattccttaagtcccgaggttcctaaccagtctgcttctctccatctttcagtcttcttatgcttgtcttgtcacgttcaaggttttcagttatacttggcagaataaataaatacatctactccatctttccagaacatcactgctttttgttcattttatttatttattatttactgagacaaggtcttactttgttgcctgggctggagtgcagtggtgctatcatggctgactgaagccttgaactcccaggctcaagcgatcctcctgcctcagcctcccaagtagtttggaccacaggcatgggccaccatgcccagctacttttcattttttgcttttgttgactagccccacagagttttgctgtgttgttcaggttggtctcaaacttctggccttaagcaatcctcttgccttgctctcccaaagcgtattacaggcgtaagtcaccacacccagccctatcggtgcttttggaagaaggtgttcttccctctctctgtttccctccctatggccagctgcccatagagggcagtggtgctggagtgaagacctctcagcgcatccctcttcatctgtaggatgtgcatggcttccaatgctgtctgttctgctcctgagacactcgctggctacaggattataaaggtgatgaggtttcagcctaaagactctccattcaataacacttcctacaagatatcttttttgtttttttgtttttttgagacaggatctggctctgtcacccaggctggagtgccacagcgcgatctgctcactgcaacctcagcctctcgggcttaagtgattctcctgccttagcctcctgagtagctgggaccacaggcgcccgccaccacacccagctaatttttggattttttttttttttttttttagtagagatggggttttaccatgttgcccaagctggtcttgaactcctgagctcaggcaatccacccgccttggccacccaaagcgctaggattacaggcatgagccaccatgcccagtcctacaagatatcttttctttttcttcctttctttctttctttctttttttttttttgagacagagtctcactctgtcacccaggctggactgcagtggtgtgatctcttctcactgcagcctccgcctcctgggctcaagtgattctcctgcctcagccccctgagtagctgggactacaggcgcctgccaaaacacttagctaattttttgtatttttagtagagacggaatttcaccatgttcgccaggctggtctcgaattcctgacctcaagtgatccacccgcctcagcctcccaaagtgttgggattccaggcatgagccaccgcacccggccgagatatctttttcctcctcaatatctatgtgctcctccctcaacccttgggggcttcagtgtaggtggtcagattccccaccatttatgcctatgatgaaaagagtggaaatggtaataactggatggtgtcactaaactacaaatactttcaggtaggcctgtgcctttttcagcgggctgcagttctcctgcttggcttgagtcattcgcatttcctgagagctgggtagagggggagttgtggaggagcccattctgaaactgatctgatattgcaaacccatacacggaaaggaagaactgcccatacgtattcgagtcttccaatctgactccgagcccgcatccccctcaatcgtctcttttccccactccccagatcacggtgctgcttggtccccctcagagccatagagaagcagggggtgtggccatggaggggaaacctctgtcaccagagactttactgtacttctccttttgctctcagatgctgccagggtccctgaagagggaagacacgcggaaacaggtaaaaatcattttgcttttattttgcattcaacaagcaagttattacggaacagcagttatgggccaggcatacctcccagagctgggaacacagtggggacctccctggctctctcttaccggtgttacaacaggttgtagacagacccctgtcttgagcatcctccttgccaggcctgctgagtcttctgagagtagggtaggttattggatgcccaggagggaagaaggagccagggaggtcagccccaaggttctgcaaggccctcaacaggcctggactgaggaggtctggacagcatggccctgtcctgagcctctgtgcataataactgctgtccctaacctccaccccaccctcagccttccaattcccgggcctggggccctactcctgtgctccagagactcctggagctccttgaggcagcacacagtcctgctctggaggcgcccatctcccactcatgctgggatgctccagcccgtcccagagcaggttgtggctggagggtgctggcagaggagggacaatggcccggctcctggaggcaagtgttggctgcagggaacggagtctagtccttgccacagcccttgttaccccttaggtaaccttaaggggatttcaaagaactctggctctgcaaccctgctaagttttttatggaacatgtaaaatagatcccatggccaaagaagtatggacaatgtattatactatactctaatccccatgtctagagattaatggtgtagatagagtttactgaaaggtttttaaagtcctgcagtaaagaatcttacttaagccaggtgcggtggctcacgcctgtcatctcagcactttgggaggccaagttggggggatcacctgaggtcaggagtttgaaaccagcctggccaacatggtgaaaccccatctctactaaaacaaacaaacaaacaaacaaatcagacgggtgtggtggcacatgcctatagtcccagctactcaggaggctgaggcaggagaatcacttgaaccctggaggcagaggatgcagtgaactgagatcacaccactgcacttcagcctgggcgacagaagaatgagactctgtctcaaaagaaaaaaaaagaatcttacttaactcttttaccctgcctttctcaagtgtatgtgaccttgaagatgttttttgcatgtgacatgatgagtacctgcggggctgatgtcagctctgcctggggaatctgcctcagcttcagaccctgcaccccaaattcatgcttagcccaggccagacccccttcctgctgtcggcaagcagcttagctttccgcacacccatgaacagatacccagcagcctttggcatgagccatgtggcccgaggagataaacagacagagagaggaacattgatgcgtgtgaaatgttggcaggtgagtgggaggggcttgggttggtgctgagaccggagacacactctgctgtcacatccttcagggtccccgggggccagcacggagggccatgatcatgtaaattgggacttaaatttaactctatgtaaatataactctatgcagaggtcagggatggtagaggacaagctcactgcagagaaagaaagaaagatgggcaacagttgcagaacctaacccacagataggttttgtttgaccagctctgtacatttttagtttattttttatctttttgagacagggtcttgccctgtcgcccaggctggagtgcagttgcatgatctcggctcattccaacttctacttcccgggttcaagcaattctcctgcctcagcctcatgagtatctgggattacaggtgtacgccaccacgcctggctaattttttgcattttgagtaaagatggggttttgccatgttggccaggctggtcttgaactcctgacctcaagtgatctgcctgccttggcatcccaaagtattgggattacaggtgtgagccactgcgcctggctcacccatactttgttactggttttagaattcctttttacctggtctttcaaaccaagttttgaccatgtctgtccctgagtataatccttgatgagtagcaccagagagagctccacgttacccggggcctggcattcaaagcactcagtggtctggtgccactcaaagcctgtgagccaggcaggaagtttataaaattagagatggatgaatggatggatgggaaaaagcaagcaagggaggaaggaaggaagaaaggaaggagttctgggaagagagagaggctgcccccgcagggctctcagtttgaaggagaggtgcagcacactcagaaaaaactcccggccaggagtggtggctcacacctgtagtaccagcactttgggaggccaaggctggcagatcacctgagatcaggagttcaagaccagccaggccaacatggtgaaaccccatctctactgaaaatacaaaaatcagccaggcgtggtggcacctgcctttacccagctacttggggggctgaggccagagaaacgcttgagcctgggaagcagaggttgcagtgagcggagatcacaccactgcactctagcctgggagacagagcaagactctgtctcaaaaaaaaagaaagaactccgtgagcatcccaaatgccacatccccataatgcaaccagacccggtcctcccggatccaggggaagggtcggagctcagtgggtgagcaagaaaagccacgtggaagaagtaagcggccagatggctcaaagacaaactctcccctgctcaggcttgcacccagacacgacaccatgcatctcctcggcccctggctcctgctcctgggtaaggactgtggcctgggctagtactggggttctgggatgtcagtgggcactggaggaggaggaaagacccaggcagagaggcgtcaacatagggtagggtgggggcagcggtgtgtatagataaatgtacatacaaatatatatgtttcccatatatacatacacttctctcattgcatcctgctgtctttgtgtatctctgtatttctcccactatcttcagagggaattctttagtctttagaaagctctctgctgggtgcagtggctcatgcctgaaatctcagcactttgtgaggctgaggtgggaggatcacttgaggtcaggagttcaaggccagcttggacaacatagcaagacccctatctctaaaaagaataaaaaattaaacaaattttaaaataaaaaataacttttaaaagaaggctctcatgcccccttagtaatgctttctgatcactgtggtgagttctagaatacttggctttctctgactcaagtaaatgggtttttgagcaccctgaaaccctctacgcctgggagggggcctgcgtctggatcccctgcacctacagagccctagatggtgacctggaaagcttcatcctgttccacaatcctgagtataacaagaacacctcgaagtttgatgggacaagactctatgaaagcacaaaggatgggaaggttccttctgagcagaaaagggtgcaattcctgggagacaagaataagaactgcacactgagtatccacccggtgcacctcaatgacagtggtcagctggggctgaggatggagtccaagactgagaaatggatggaacgaatacacctcaatgtctctggtaaggccttcggggagcgggtcctctgctctgggcaggggtgagtgggaggcaggaaatacctgactcctggcacagagctcacaaaccgagcttcctgcagagctcaggcaggggacgccagcggatgacgatggcgatgcagcagcactagacagagctgcgggacctcggatgtcccatctgaccctcagttcctgcccctctgggacctggattccaaagttatcggatctcctgatctttccctctttctttctcaccatgtatttttcagcttttgtgacaaactcgtgtttggccttagtactggaaccatccaagcaccgcattcctttagtggggtgggtctgcatgtaaccagcctcagctctcccccaggctggaccgcccccttcagacattggggtctgaagctgcatcgctcaccccaaacttagggctgctcagagctccctatagaggaaactgggtgtggaacggagtaaccacactccctagggcagaggccccagacctgtgtttgatgggtcaaatccacccctacatgtgcagtgccataactgagcctgtgttataaaaatcataaaatgtttgttttactttttttcctcttcttttccccttccccttcctttccctttttatgagacagggtctcgcactgtcatcacccaggctggagtgcagtggcgcgatctcagctcactgcagccttgatctcccgggttcaagcaatcctcccacctccaaagtagctaggatcacaggtgcatgccaccatgcccagctaactttttaatttgttgtagaaatgggtcttgctatgttgccaggctggtcttgaactcctggcctcaagcaatcctcctgcttcaacctctcaaagcattgggattacaggcatgagtcaccgcacccggcctgatcttctgatttttcaagagacgatggaaatctagattttccagtgaaatctcccagcatgttaatgttcatggcaagttctcatgagctcttcaaggtcagatgacactgttgttgaaccccaaaggccaggtttgagctcccgatgcgtagtcagccaaacactgacatctcagtgcttagaagctgagataggattatttaatttagccaaagcaaggggacagaagagagaaactctcaaatctgacctgactttgagcgttagtgggggcttttatgagtaaagtaggtgtgcaggaggtgacctcccgatcgtcaaagctgttgtgcccctcggctcatcaaatttctggatgtcatcaaggaggtctgtgtgacctaaggatcattgttctttgaaagagagacaagttcatttatcttgcaggcagctgccagggagtcaggatgtaagttaaacaattatgagtgaattaatggttacctgctactgaaatgaccaaatgtaactaatcatgcatggaggaaggaaaggacaaagagaaaagaaaagaagtaaaacgaacatcttataatttttataacataggttcagttatagcactgcacatgtaggggtggctttgacccatcaaacacaggtgtggggggcccctgccacagggagtgtggtcactccgttccacaccgtttcccggatgggcagttctgagcagccttaaatttggggtgagcaatgcaacttcagaccccgctgtctgaaggaggtggtccagccttggggagagctgaggctgggtgcacacagacccactccactaaaggaatgcggtgcgtggatggctgcaatactgaaggaagccatgaaagtaacacaagtttgtcaaagctgaaaagtccgtgaactaaactgataaaattcacttagaggtggtgggaataggccgggcacggtggctcacgcctgtaatcccagaactttgggaggccgaggcaggcggatcacaaggtcaggagatcgagaccatcctgactaacacagtgaaaccctgtctctactaaaaatgcaaaaagttagccaggcgtggtggcaggcgcctgtagtcccagctactcaggaggctgaggcaggagaatggcgtgaacccggaaggtggagcttgcagtgagctgagatcacgccactacactccagtccgggcgacagagcgagactctgtctcaaaaaaaaaaaaaaaaaaaaaagaggtggtgaggtggtgggaatagaactttgcaatcattcagaaagcagacatccggcaatgagcatgaaagaaaagtagatcacagttcccaaggaggcttagtgtggtcaaggcctttcagaggggatttcgggtgagcaaaagtgattcaaagtggagaaaagcaggactgcgttgggtgcagtggttcccgcctgtaaccccagcactttgggaggctgagatcggaggatcgtttgagcccaggagtttgagaccagcctgggtaacatggcaagaccctgtctctacaaaatgtttaaaaaactagctaggtgtggtggcacatgcctgtagtcccagttactcagggggctgaggtgagaggattgcttgagcctaggaggttgaggctacagtgagctaggattgcgccactgcactccagcctgggtgacaaagcaagaccctgtctctaaagaaaaaaagaggccgggtgtggtggcttacacctgtaatcccagcactttgggaggccaaggcgggaggatcacttgaggtcaggagttcaagaccagcctggccaacatggcgaaaccctgtctctactagaaatacagaaaaattagctgggtgtggtggtgggcacctgtaatcccagctactcgggaggctgaggcaggaggatcacttgaactggggaggtagaggttacagcgagccaagatcgcgccactgcactccagcctgggtgacagagggaaactccatctcaaaaaaacaacaacacaacaacaacaacaataacaacaaaaaaacaaagcaggactggagagaggtggaatgaagtggcaaggggttcctgaggggtgatttgggacaggacatctaaagccaggtgtacgctcacgtcctcagtcccccaggctcctgcacgggctctgttcttttgcagaaaggccttttccacctcatatccagctccctccagaaattcaagagtcccaggaagtcactctgacctgcttgctgaatttctcctgctatgggtatccgatccaattgcagtggctcctagagggggttccaatgaggcaggctgctgtcacctcgacctccttgaccatcaagtctgtcttcacccggagcgagctcaagttctccccacagtggagtcaccatgggaagattgtgacctgccagcttcaggatgcagatgggaagttcctctccaatgacacggtgcagctgaacgtgaagcgtgagtctccccggcatgcctgtgggaagggcaaggtctgtgtcaccttctccccagccccgcagggggcatgcacccagggcagggggaagcctgcacagacggcggcatcctccagccctggtcacgccgccttgtcagccctggtgtttcgggaaaaagatttgctctagcctaacagaataaaatggtccatcctcaagccatgacatgaattggggattatctggttaggtctttttgttcccctcttggtggggatttttttcgcatcattatcttgtgcctcattcattcaataaatacgtatcatgaacctactaggtaccaggccttattacggctgccaatggggggcatggggcggtgggcagggtgcagcagtgagcaaaactcttgccccacgcggagccagcgctgcagtgaaagagacagacaacaaatggattaccaaagaaatacagagcatgagccaagacattagaatctggaacaaagcaatgttaacaaagaaatatacaacactattgtaggtagtgatatgtgtgttaggaaaaaaataaggccgagagaggggagtgatggagagagacctctctaagaaggtgagcacttaggccgggtgcggtggctcacgcctgtaatcctagcactttggaaggccgaggcggggggatcacaaggtcaggagatcgagaccatcctggctaacatggtgaaaccccatctctagtaaaaatacaaaaaattagccaggcatgatggcaggcgcctgtagtcccagctacttgggaggccaaggcaggagaatgacatgaacccaggaggcggagcttgcagtgagctgagatcgcaccactgcactccaacctgggtgacgagtgagactccatctcaaaaaaagaaaaaaaaagaaggtgagcacttaagctgactggaacggagggagtggctgaggccggcacatatttgggagaggaggatttcagggaaagagaagggcaggttcaaagctttgaggcagcagctgggtgggaggacctcagaggctgaagttcaccgcctctgagggccacatggtaggacaggaggcaggagatggagcaggactctggatcccgagggctgaggtgagggtttgggattctatgcaaagcacagaacccgctcgtggtttccagcaggattggcgaggtctggtagatggtgttaggaaccctgcgtgctgctggtggagaccaagaagtagaggaagtgggagggggaagctgagagccgagttaggaggctgtgaccatcacctgggtgaagggactggcaggccatggctttgtcagaataaaagcactttccacaccctccaccctctgaggattccccgccccctccccgactgcccctctgctcctccagacaccccgaagttggagatcaaggtcactcccagtgatgccatagtgagggagggggactctgtgaccatgacctgcgaggtcagcagcagcaacccggagtacacgacggtatcctggctcaaggatgggacctcgctgaagaagcagaatacattcacgctaaacctgcgcgaagtgaccaaggaccagagtgggaagtactgctgtcaggtctccaatgacgtgggcccgggaaggtcggaagaagtgttcctgcaagtgcagtgtgagcccctcggagctggggacaggccaggcagggaggtagcaggggtggacccggagaggggagccacgggggctctcggggccgtgtgcacaggttgggggtgctctcctcacccctccactcgcctctgccccctcttccagatgccccggaaccttccacggttcagatcctccactcaccggctgtggagggaagtcaagtcgagtttctttgcatgtcactggccaatcctcttccaacaaattacacgtggtaccacaatgggaaagaaatgcagggaaggacagaggagaaagtccacatcccaaagatcctcccctggcacgctgggacttattcctgtgtggcagaaaacattcttggtactggacagaggggcccgggagctgagctggatgtccagtgtgagtagccacggagcctctggttctagggagagaagatggacacagggaacggggaaggcagatggggtgcagggcattccggggtcctggagtcaagagcaaggagcagccagggtctcctgttcacaactgctgtctcagctcctagcatagggcctggctcatggagggtgcttggtagatgcttgtttttttgtgttttagttttttttgagatggagtctccctctgtctcccaggctggagtgcagtggcacaatctcggctcactgcaagctccaccttcccgggttcatgccattctcctgtctcagcctcctgagtagctgggatgacaggcgcccgccaccacgcccggctaattatttgtacttttagtagagacggggtttcaccgtgttagccaggatggtctcgatctcctgacctcgtgatccacccgcctcggcctcccaaagtgctgggattagaggcgtgagccaccgcacccggcctgtagatgcttgttgaatgaatgaggccaggtgcggtggctcccgcctgcaatcccagctctttaggaggctgaggcaggagggtctcttgaacccaggagtttgaaaccagcctgggccacacagcgagataccatctctacaaaaaaatacaaaaattagctgagcatggtggtgcgtgcctgtggtcccagctactggggaggctgaggagggagaatcacttgagcccaggaagtgaaggctgcagactgaactatgttcctgctactgcactccagcctgggtgacagagcaagacctgggtctcaaaaagaaaaagaaaatgctgggactgggattataggtgtgagctgggcacagtggctcacacttgtaatcccagcactttgggaggccaaggtaggcagctcacttgaggccacgagttcaagcccagcctgggcaacatggtaaaaccccatctctacaaaaaaaaattagcctggcatggtcatgcatgcctgtagtctcagctacccaggaggctgaggtgggaggatcacctgagcctggaagtagaggctgcagtgagcctgtgatcatgccgctgcactccagcctgggtgactgagtgagaccttgtctcaaaaaaaagaatggattggccaggcatggtggcttacgcctgtaatcccagcactttgggaggccaaggtgggcagatcacctgaggtcaggagttcgagaccagcctggccaacatggcgaaaccctgtctctactaaaaatacaaaaaattagccgggcatggtggcaggcacctgaaatccacctacctgggaggctgaggcaggagaatcgcttgaacccaggaggcagaggttgcaatgagctgagatcatgtcactgcactctagcctgggtagagtgagattctgtctccaaaaaaaaagaataattaactgcaagataccaggactccatgagggacacagagacttagcgtccctaggcagtggctgagtcttgagagatcttgaaatttttaatgagaactggggcaaactgtctcattacctctccattgtaagacccttttaacacagtgaatcttgttaccatgtagagcacaggacaaaaagaacacataagctcgatccttggaccctgagatgtcatatgtgctaacaggacaggggtgcccaaatcctgagcatctcagacagctggatgcgtgaccacagcagccacagtgatgtttgtggagtgtttgccacacgccacactctgctctaagggagtcatctcatttccttcttgaaacaattcccaggaggttaggaactctcaggactcaccccccacccaccccgcactgcctcttgtttttaagatggagtctccctctgttgcccaggctggagtgcagtggcttgatctcggctcactgcaacctccacctcccgggttcaagcgattctcttgcctcgaccacctgagtagctgggactacagacatgcaccagcatgcatagctaatttttaaaatttttagtagagacagggttttgctgtgttggccaggtctcgaactcctgacctcaggtgatctgcccacctcggcctcccaaagtgctgaaattacaagcgtgagccaccatgcccggcctcaggaccccatttgacagacgtgtaaactgagacctgcagcccatgcccgtgcgcctctcagcagccgtctggcttcagcgctgtgccctgaacccctgcaccaaaccacagccaggccagagagccagggcagggtttctgttctcacacagatgcaggaaggacgcacaagcccccctttgattaatttaggacctgtgcagatgcccgggacaggtagcgggagaagaggaagcaggagggaaggggtactgtggacagctggcttttctttactcacctctctggttttcttccagatcctcccaagaaggtgaccacagtgattcaaaaccccatgccgattcgagaaggagacacagtgaccctttcctgtaactacaattccagtaaccccagtgttacccggtatgaatggaaaccccatggcgcctgggaggagccatcgcttggggtgctgaagatccaaaacgttggctgggacaacacaaccatcgcctgcgcagcttgtaatagttggtgctcgtgggcctcccctgtcgccctgaatgtccagtgtgagtccctgggctaggcagggggatctgggaggtggcccggctgggatgaggggatgaaggcaacgaggccggagcctgggccagtgtcttcaacagaattgagggacaggagcctggcgtcagggccaaggggaggggaggcctggggacagcaaaagggacagggagcggagaggtcagcttgggacccttgccctccagatgccccccgagacgtgagggtccggaaaatcaagcccctttccgagattcactctggaaactcggtcagcctccaatgtgacttctcaagcagccaccccaaagaagtccagttcttctgggagaaaaatggcaggcttctggggaaagaaagccagctgaattttgactccatctccccagaagatgctgggagttacagctgctgggtgaacaactccataggacagacagcgtccaaggcctggacacttgaagtgctgtgtgagtgagggccggaggctgggagtggagcagagaagggaccagtggcctgcctggtagtgacttcgcaccccctccccctgcccgccatgcagatgcacccaggaggctgcgtgtgtccatgagcccgggggaccaagtgatggaggggaagagtgcaaccctgacctgtgagagcgacgccaaccctcccgtctcccactacacctggtttgactggaataaccaaagcctcccctaccacagccagaagctgagattggagccggtgaaggtccagcactcgggtgcctactggtgccaggggaccaacagtgtgggcaagggccgttcgcctctcagcaccctcaccgtctactgtaaggcctcttcctgctcttgttcttcttggtggtggtcagtccttccttccttccttccttccttccttccttccttccttccttccttccttcctttcttttcctcctcctcttcttcccctcctcctcctcttcctcctccttcttcttcttctgctttctccctctcctcctcctctttcttctccttctccttccttcttcttcttcttatagagacaaggtcttactctgtcacccaggctggagtgcagtcgcataatgacacctcactgcagcctccaattcctgggctcaagcaatcctttcgcctcagcctcctgagtagctgggactatagacatgcaccaccacatccggctaatttttacatttttgtagagatggggtcttactatgttgaccaggctggtttcaaactcctgacctcaagtgacccttctgcctcagcttcccaaagccctgggattagagccatgagccactgtgcctctccctgtttcctctcatgctcctctctggccctgtctgctccagtgacttcccgaaaagccttccagaccagctggccccttcttccccacctcactgtcccctttcccattcacaccccttgctccaggccatctgccgctgtgctggaggagtcgtcttgtcctgcgtcaccagtctctctttttctacctcccctgcagtctctcctgcctccctctagggtcccctctcaggctgctccaccttccagaagtcctgagctcctactgggtccctgtctctctctctctgactactctgtctctctcagccctgacaggctccttgtttttatcttttaaaacgtaaatgattttttttttaaacggagtctcgatctgtcacccaggctggagtgcagtggcgtgatcacggctcactgcaagctctgcctcccgggttcacgccattctcctgcctcagctccccgagtagctgggactacaggcgcctgccaccatgcccggctaattttttgtatttttagtagagatgtggtttcaccgtggtctcagtctcctgacctcgtgatccgctcgcctcggccttccaaagtgctgggattacaggcgtgagccaccgcacccggctgattttttttttttttttttgagacagggtctcaccctgttgcacaggttggagtgcagtggcacaatctcagctcctgcagcctcgaccccctaggctcaagtgatactcctgcctcggcctccacagtagtaaacttgagtggtttttaaacagatcatacaagcacctggtaaaaaaataaaatgtaagcatgaaagggtaaatagtggaaagacagacgcggctcactcttgatccctgagaactctcatccccaccaaaggtcctcactgcacacagtcttcccatctcactgcacacagtcttcccatctcctccaggggtatttttcacacgcacaattcacacacagaggtctgtgcctatatacccttcctcatgacacagacgaggcagagcccacactttgcctgggaattttctttgcttttttccatgtaataatactgtttggacattgttctgtatctatgcatacacagagtgtctaaagtctggaggctgggcatggtggttcatgcctgtaatcccaacactttgagaggccatggtgggaggatcacttgagcccaggagtttgagaccagcctgggcaacatagcccacacctcatagcaagatctcatctctacaaaaaataccaaaaaaaattttaaaaacgaacaaacaaaacaataacaacaacaaaaaagagtctgaaagcatatggaagatacctaattaatttattgtactttttcagattaataattggaaacatggccttaaattgagggaacctgaccaggcacagtggctcacgcctgtaatcccagcactttgggaggccaaagtgggtggccacaagcactttgggaggccacaaggtgggtggatcacttgaggccaggagttccagaccagcctggccaatggtgaaaccccatctctactaaaaatacaaaaattagctgggtgtggtggcgcgcacctgtagtcccaactactcgggaggctgaggcaggagaatcgcttgaacccgggaggcagaggttgcagtgagccaagatctcaccactgcactccagcctgggtgaaagagcgagactctgtctcaatcaatcaatcagtcaatctagggaaccatcaccagcacggccgaaggccaaaggaaaacatctgaaacatgttatctggaaatgtaacagacacatcccatcatataaaaccattgttccctgggtatcccctttgcagacagcctgagagcctcctctttttcctggggccatggagtcctcgcgtatgaaggttgcatacatcctcctcccagtgccctcttcagggcctaggtctgcagcctcttgttttgggcacgcctgcaaggacagttgcaagatgcattcccatgtggaattgctgggtggaagacaggtgcactttcagagctgatcacacagctatactgccgtgaagagctgcacccatttatgcgggtgcgggtcacaggctctgggcgtgccacgtctgtgggaaaagcagctcctcaggagaattagtgccttattcctaaagggaggcccagagcaagcaggggccattgtcaccctcttcctctgcacccctgcacgcatgcaggggagaaggacgagtctggctgcagagagaagtccaggatgccttccaggcaaaggctgccagggagagctggcccctcagttgattaaggtctctcctttctccacccagatagcccggagaccatcggcaggcgagtggctgtgggactcgggtcctgcctcgccatcctcatcctggcaatctgtgggctcaagctccagcgacggtgagctcctgccatcccccaccacctcctctatcccttggcagaggcccgtgtccagttgctccatctcgaagcctccagcctgtggagtccctgaccctcacacatgtgcctttatttctcagttggaagaggacacagagccagcaggggcttcaggagaattccagcggccagagcttctttgtgaggaataaaaaggtaggatggggctgggcacgatggctcatgcctgtaatcccagcactttgggaggctgaggcaggtggatcacctgaggtcaggagttcgagaccagcgtagccaacatggtgaaaccctgtctctacaaaaaatattttaaaaattagccgggcgtgatggtccatgcctgtaattccagctactcgggaggctgaggcaggagaatcgcttgaacctgggaggcagaggttgcagtgagccaagattgcgccattgcactccagcctgggtgacatactgagactctgcctcaaaaaaaaaaaaaaaaaaaaaaaaagggtaggcatgaggcagactgtgaagctgagtggggaaacaaggtgaaggaaggggataaaatgtcctctgaggagacctgggctgtcagaggccagggaaggggacgagggttggggaacaggtggttagcacttcatcctcgtctccctcccaggttagaagggcccccctctctgaagacccccactccctgggatgctacaatccaatgatggaagatggcattagctacaccaccctgcgctttcccgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccactcggcaacaagcctctgggtaagggccagtctccagaagtggacctgctccttcaagtcagcagcacacatgcccagtccgttcttatcacaaagatcaagagctcgtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggagggtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctggcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcacacacacacacacacgcacacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaacgaagtagaaaggggcccagtcctggcctggcttctcctttggaagtgaggcattgcacggggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccaattcttgcacaacccatagctgccagagaaagtcttgaagaccagccaccctgagaaacctcacagcttttctgtcattcgaggtcctctgcacccgttctctaattctgttcactgattcagactttccagttaggtgccccagctcccctctccgcttctcgggtttgatctttctccacccattcacctgcttctgcaaaggggctaaagcccattctccttagagggcaggggtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctcgtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgagcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcaagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacacctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcaga

SEQ ID NO: 615 - DNA, 38944 bp, Human
  misc_feature (1)...(38944): n = A,T,C or G
acaggcgggggtgagggggatgtggactggaacacaggggacagagcactgtcctggctcctctgcggccaaccccccctctgggcaggagaaagcagagttaatcccattggagaaggaagcgctgagctgttgtttgttcattccacaatcggctgttgaatgtgttggatcccactcagaattccgccccaaggactgttctccttccagcaggtcgctcctcagtctccagcatcatctgtcttcccgtctgctggatgctccctggggacatgagcgtgctgccatagttaaaaaaaaaaaaaaaaaaaaaaaaaaaaaaaaaccctcccacttctctgctcccattcactgtaagacttggggaagaagctacagtcacacgtgactccacatccccgtccccctttctcccctttctctagcccctccaatctgtcttgtctaccttttcctgtttaacctgttctggtcacagtcattgatgacctcatcttccaaatccaaagttaagtctcagccctcatgctccccaggctgacccactgactactcccctgccctcctcctctgccctctcctggcattcctccttcatcatgggaccctcttctaatggatccccaaatgtcagagggtccaagtcctccctccctccaagctcatccatgcccatggcctcagatgccagccataagctgttgggttccaaacctcgactccaggctggactcacccgtctcccccaccagcctgacacctccacctgggtatctaacgagcatctcaaactcaacctgcctgagacagaggaatcactatcccctcctcctccaaaaatatccttccatcacactccccatcttgtgctctgatttactaaacggccctgggccctctctttctcagggtctctgcttgcccagctatataataaaacaagtttgggacttcccaaccattcacccatggaaaaacagaagcaactcttcaaaggacagattcccaggatctgccctgggagattccaaatcagttgatctggggtgagcccagtcctctgtagtttttagaagctcctcctatgtctctcctggtcagcagaatcttggcccctcccttccccccagcctcttggttcttctgggctctgatccagcctcagcgtcactgtcttccacgcccctctttgattctcgtttatgtcaaaagccttgtgaggatgaggctgtgattatccccattttacagatgaggaaactgtggctccaggatgacacaactggccagaggtcacatcagaagcagagctgggtcacttgactccacccaatatccctaaatgcaaacatcccctacagaccgaggctggcaccttagagctggagtccatgcccgctctgaccaggagaagccaacctggtcctccagagccaagagcttctgtccctttcccatctcctgaagcctccctgtcacctttaaagtccattcccacaaagacatcatgggatcaccacagaaaatcaagctctggggctaggctgaccccagctagatttttggctcttttataccccagctgggtggacaagcaccttaaacccgctgagcctcagcttcccgggctataaaatgggggtgatgacacctgcctgtagcattccaaggagggttaaatgtgatgctgcagccaagggtccccacagccaggctctttgcaggtgctgggttcagagtcccagagctgaggccgggagtaggggttcaagtggggtgccccaggcagggtccagtgccagccctctgtggagacagccatccggggccgaggcagccgcccaccgcagggcctgcctatctgcagccagcccagccctcacaaaggaacaataacaggaaaccatcccagggggaagtgggccagggccagctggaaaacctgaaggggaggcagccaggcctccctcgccagcggggtgtggctcccctccaaagacggtcggctgacaggctccacagagctccactcacgctcagccctggacggacaggcagtccaacggaacagaaacatccctcagcccacaggcacggtgagtgggggctcccacactcccctccaccccaaacccgccaccctgcgcccaagatgggagggtcctcagcttccccatctgtagaatgggcatcgtcccactcccatgacagagaggctcctcgagggcacgctgggcctcctcgtggctcagagcagggtcggggaaggtgcacccagaggtagtgccaagggcacaaatgggcatctcggggctgaggggggcagggcaagggcttggctctcccagaagtgtattctccaactcaaaaaggcccactggccttcatcagtgccaggctcagagagggcaggattctgccccagttgcccagcatgccggggcagaggactggcacccaggccttggcctcccctcggtgccttacccttactggagaggatttaccaaggcctgacaccagcctcctcagccccctacccatacgccactaaagctctatgctgggatctggggaggggccctgaaaaggaagctccgagccttggcccctctcggtcagccagtgcccccatttcaggataggcaagctgaggcttggctctgggcacttgaggtcttgcctttccctctgggcctttccctgcccaaacaccatcggggcccactatgtgtcaagggagctgtagtctggacagcggtccaccattcctcccaccagcaccctttcaaaggctagagcataagagccccaaggcccccacagcccaggaagtcccccagaagcaggaggtctgggccaagagcctggcctggagacagctgccctgggtacagatcccagctctcccatttgctctggggtgaccttgggaaagttacccagagtttccaaaccacagtggggaacaagggatggtgtggggctcattattttaccattaacaactccacaaggtagatacattctttctttatatctcagtgaaagcaactgagctttggaaacatatgagctggtgtggggatttgaaccaggatctcgtactccaaagccccagctctccccaggtctcaagtgtctcatctgtgaaatggggaaacagtgtttcctcagtcaattgagtgaagtgagctacatccctggtgctgggaatggcacataacatgagatctttaaggaatagtggctggatttaccagctagcacagagccgatcctggttgtgaatgtgataaagattttggcccttgaggtatggtcaaaccccatcacggaggggtcctcaggtgcccagcaggtacgaggaagggggtgcaagtgagaggacatcgcgagcacctctgggcctctgctccatgtcaggctccctccccagcgtggacgtttctcatgtgtgatgggcagataggattctgacaagagaggaagggcattcccagggaggcagctttgaggagtcgagggtgtacctggaaggctcttttgccacaggccactggagccagggccagaagccctggtccatcctcaggtggtgggaagcctgggactctcctctgcctgccctagagagcagcaggtatccaccaaggggcccaagagctgctgagcccctgagcagccctaccaatttcagcttatggtggtgaggggtaggggaggtgtatactggcctggaaggggttaagctgcccgcctgcagcctcagcctgagctattgtgttgccaaacaagggccggacatgagggcaggaagccagcaggggccacacattttctgcaaagttggatgattcactgctgacttggggacacccaggggacagaggggacaccatcccaggaagaatcttaggctcattttgcccacatggacccatgactgctccctgtatcctctctctgcaccccctcagtcacactgaagcaactatgagaattcccatttgacagatgggaccatcgaggctgagggaagctgtgcagccagtccaaggtcacacaaccaacacaaggtagaagcagggtgagtgcggttccttctgacccacagtccatgccacactccacagtgaagctcagagagggggaaagcagagcagtccaggccacagaggcaggcacagggacaagccaggagcccagtgataccaggggaaggaatgttctaggaggcagggcctcaggagcttcacctctggctgaggagatactaaaaagtctgtcctgatccaggttcaagctggtgttaagtgggtaaatcatggagggcttgctggaggaagagtgggaatcccagatgctaggaggccttgggcagcccctctgcagcctgcacctcagtcttcccatctcttgagagtaggggatggtccctaaactaattcagggatttccaggttgtctgccttggaccatagcaaaacagtcagatcctggcaggtccagatactagaaggaggaggaagtgggacccaggggcaggccgggctggtggtgaatgagatttccttctgcagaggaacagaaagagtaggaggtgggcccagagtagagccaggaaatgaggttaagcgtaagttggccagtcaaagccacacccaccaggctggagagggcgggtagataggagtcaagacacctgcacccttactgagcacctactgtgtgccaggctttgcacccatgatctcatttaatcctcctgcccagggaggcagctattgttgcctccattacagataaggaagctgaggctcagcaagcaagagatgaacccaaggtcacacagctcccgagcagctgggcaggttcaaataggcaggtgcaagggcctcattctgttccccgcactgccctgacagtcccagacaaagtcaggaagcccagaggagtctggaagcctccttagcatgggtgttctctccttgaagtttggagctgtccctttagaaggcaaggggatagactagatgacccggagcccagagattccagcacaaatttgtttcacatcacaaaataggtctggccagttggtaccctctaccttcattcagtgggaatgaacttgaactcagcccctgaatcctcaatacagtctatgaggatcctcaatacagtctttgagtgattgattcgtgatgtctgccataggtgtggaaaggggcatgtggcaagctgagttctgttttgccagccctgtcttaagaggtgccctgctcaggggtgtttgcatattcactggagacttttttgtttgtttgtttgtttgtttgtttgtttttgagacagagttttgctcttgttgtccaggctggagtgcaatggcgcaatcttggctcactgcaacctccacctcccagattcaagcgattctcctgcctcaatctcccaagtagctaggattacaggcatatgctaccatgcctagctaattttgtatttttagtagagacggggtttcaccatgttggccaggctggttgcgaactcctgacctcaggtgatccactggtctcggcctcccaaagtgctgggatttacaggtgtgagccaccacgcctggccagggactcttaagaaggataattttgttgtcagtaaaggatcaaaatcctatcggtggtcttttgggcagtcccatggcagcctatcccatgagccatcagaggacctatttgggaacaaggaggagcttctttaagttataccaacaattgtacctactctgaccaccctacgtgttgtctgaaaatatacagatttgtttctaaatcctgtgagtggggaaggagtgggtgacaagaccagaactggagctggcaccaggctgacaggcagcacgtccaggtctagggccttgagttcatgcacccaggtatggcatgaagtgaactcttaggcccagaacctgcctgggcagataggccaggaggcagaggctgtgctggtggcaggtggcaatcagaagacctcatggagtaggcagtgtgggccttgagaagaagtaaagcgttaacccaggaaacacagcaaagaagagcattccagtcagaaggaacagcctgggcaaaaagcctgctgctgagaggaagggcattgtgcatttcaggaactcctagctctcctcgaggctggaaggggcagggaagtggaggagaggagagctggcagggtgggcaggggacaaccatgctaggccttaagggctggctgaggagctagacttcctccagcagggagtggggaggctgttggcagaacctgcagggagaggaacaggtctggaacccacagaagcctatcccagggccaaactgagccacaaaccaggaggaagcagaaggggccaggtcatagctgcctggccaaaccccattcccgagctcccagggcctcacccttcatcctcccaaagtctgtggccgccaatacgcaactttaaatgcctgagctcaagtagaccatttgagagtccccacagagtttgggggtcactgggtcccagccccaacctggactgagatttgagctgtggaatgggaaagcggtggggagagctgcccagggccacacacggagctgggtcttcagtgcccccactccagcaggcacacctcctgcatgttctaggccggctcctcccagcgccctgcccctcatccctgaccccaggcctctgggctggagtccagaggctgcaggaggctgggctgggatcctagctgaaagcgggtgtgctgggggtcagggaggagagcagccaggcctgcaaagaggagccctgcaggagttggcctgggcaggtgcctgtggtcaggggtgtgcacttgtgaaggcatgtttgagggtgtcacaggtccatgaggcctgcagatgtcatgtgtgtgtcctggacctggagccttcctctgccccacccctgaggccctccagcctattgaaaaccccctatactgcaaagcccagacttggcccctggaatctaaggcttgagtggggctctggtcaggtcgaggggcagggggtcctcctggtgctcaggggcaggaccagcccaggggctgaggggctggaccagcccattgaggggcccccagctgggtccagacttcctatgtcttatttagctacaaagccaggggtcccaggcagtcccaagaaaagcagctctagcccttcccctccccgcccttcccttcccttcctcttctcttgtatccctagcctctctttttgacactgtaactcagcacagagctgagccgatctcacagccccttggaggcagaaccccagagagatggacgcccacaaagggaaagggaccaaagggagctttgtgtgatgtcccacagtggctcagtgagaggcaggactcactcctgggactgtggtcctcagacccatcagggccctcccagtctgtatgctcccacagcctcctcgatttgtccatcaaagcacatgtcacaatttcaaactgcatttttcaccacatgaccggcatccctctctcccacggaagtggagcctgtgtttattcctgcatggaattaagtgcctggcacatagtagatgctcaataaatgtttgctgcatgactgtataaccccaggactctagagagagcttcagagaagtggtgacatgtgtcctaaatccaggcagaggagagaggacagcaagtgcacgggcagggaggatgcaaccaaacctggtggggtggggagcttcccagagagttaacgtcctgtgggccggagctatgcctggaggctcaccaggcacctgcagacccagacaggcagctggagaggagcagaaagagccgcaggagccccaaccttttctcaggctgcccaggtgactcagccttcggaggacccctcggtcaccaggcttggcctaggtgtctaggttctgatcccagtggccccacccacggtagatacagacctggaccccagaggcctctgcggtcccaacctcccatgggagcatggtggagcccagtcgtcccccttattttccaaggctcccctgctgtttaatcctgggctccacgcccactcaccaggggattcgggccactcactccgtcctctcattttgggtcctccagacctccccagactgagggagggtacagagggcccatcctcctccatttggaactgcccccaaaccctctcacatggctctggggacagcagcatcgataagcatcctggatgcctgggacactgcaggtacctggcctcggcgtgctcagaacctacatctgagttgccaagcgtggcccctccctgctcaccactgtgatcaggcagttgctgggctgctcagctgggaatttctgaacatggaaatcacttccaaaatcctcagaccctctgaatgtctggggtgccccaaatctacctggcaacagcttgagtctctctggaaactgctgagaacgaccgagagatgtgactcttacctgccgaaaggaaacaggctaaaatgaaaaaagggctatgaccacatctccagaggctgcagccaagagaaattcagttttcagctgtggctgcagtagatctgactggcccggtttcctctgcatcatgatgggaaggaacatctgtccaacaagacccttccctgcagcccccattttggttagccaatttttttttttttttttttgagacgaagtcttgctctgtcacctgttgcccaggctggagtgcagtggcaggatctcaactcactgcaacccccgcctcccaggttcaagcgattctcgtgcctcagcctcccgagtagctgggactataggcatgcgccaccatgccaggctaatttttgtattttttagtagagacaggatttcaccatgtttcccaggctggtctcgaactcctgacctcaagtgatccacccgccacagtttcccaaagttagtggccaaatttctaacctaaagggcaaaagacacaaataaatgtggcttttcagatgggaaggtcccacaggtgtctctgagattgagtatagaaggagcctaggatttagaaaaagatcgatctgatgacaaccattcatgagttgtttgtctctgagcctcagtttcctaatctgtgaaatgggaatgataagtcttacatcctggggatagtgtgaaaattaaatgcgctggcatggatgaagaccaagcaccgagaatagttcattattattacatgtgaatgtcaccacagagatagagagagtggcatgacgcaaaaagcactaatttgggggaaagacagcctaagttcaaatcctggctccactgcctccggctatgtgaactgagatgacttacgctacctctctgagcccccatttctttacctgcaaaatgggaacgcagacaactacctagaagggttgttgcaaggtttaaataaaataacgtgtgcctcgggggagtgctcagggatgtcagccctcctccaccgtcccaggcgagaaagagctgtctcgggagggtgctcaaggctctggcatgggggtgcaaatgggattatgtgatcccaagctcccaaatgcccccaacccaaggtcctgcccctcaccaacagctgactgatgagagctgagcacccagacctccctctgccctggcaaatgacacacagctgctgtgaggtgactctgcgagagccagtctcagccctgtcagagggaaggagcttgagggtggcccatgtgctccaagggacttctctccagagctagcagcagggcccctgctggacacagaacagaatccaaggggcttttctgcaccttcagagaacgctttgttatgtggggccagacaaagcccactgaggagttaatgtccccccaggagccacgtggtccgagcctgtgactggtggactctgctttgctgaagtctggtgtaggtacagccgtgcatctttttttttttttttttcaaatcaaggaaggaacctcattttattctgaatgtgttagttttgaccgtcttcaccctgaaattttctctttgtttaattttatttatttattttttattagtatactttaagttctagggtacatgtgcacaacgtgcaggtttgttacatatgtacacatgtgccatgttggtgtgctgcacccattaactcgtcatttacattaggtgtatctcctaatgctatccctcccctctccccccaccccacgacaggccccggtgtgtgatgtgcatcttaatgactgggacacattctgaaaaacgagttcaggtgatttcgctgttgtgcaaacatcagagagtgtgcttacacaaagaaatctggatcgtatagcctgccgcacacctaggctgtacggtacagtctattgctcttaggctccatacctgtgcagcatggtactgtactgaatgctgtagccaattttaacacgacagcaagtattgatgtatctaaacatatctaaatacagacaagatacaataaaattcccatgtaaaagataaaaaaggagcctgtaatcccagcactttgggaggccaatgcaggaggatcacttgaggcaggagttcaagaccagcttgggcgatatagtcaaacccctccaccccaactatctcttcaaaaaaatttaaaaattagccagatgtgctggcacatacctccttgtggggctgaggtgggaggattgcttgagcccaggagtttgaggctgcagtgagccgcattcacaccacactccagcctgggcgacagagggagactcaatctcaaaaaaataaaaaagtaaaaaataaaaataaaaataaaaaaataaaaaatggtacacctctctatggtacataccatgagtggagcttccaggactagtaattggtctgggtgagtcagggagtgagtggtgagtggcctaggacgtcactgtatcctactgtagacttaataaacaccgtacacttagcttcactaaatttacttaaaaatatttttctttcgtcaataagaaattagtttactattagggtagtgcaaaagtaattgctgttgttgccgtctaaaaaaaaaaaaagccaccggctacggtggctcatgcctgcaatcccagcactttgggaggctgacgcggcggatcgcctgaggtcaggagtttgagaccaacctggccaacaaggtgaaaccccatctctactaaaaatacaaaaaaaaattggccgggcgtggtgtcacgcgcctgtaatcccagctacttgggaggctgagccaggagaatgacttgaacctgggaggcggaggttgcagtgagctgagatcacaccgctgcactccagaacaaaactctgtctcaaaggaaaaaataataaataaataaataaataaaacacaattacttttgcaccaacctaatataacattttttataaagttggtctacactaccatcaccccaaacacacgagtaatggcttgtgctgtgacgtcacaatggctgcaatgttactagggcagaggaatttttagctccattaaaaccttaggggaccacattcatatgtgcagtccattgttgaccaaacagtcattttgcagcacatgactctatttatccatctgaccgctggctgcggtcagccctagggatcactaacccatcccaataggccccaggaaagagaaaaccacattcccgctcactgtattagagatggggttcccagcaggaaacagagcgaaccctgggaggccaattgaagagattttatgaagggactgcttcagagaggtgggctcctttaaggaaaccaaccactgcctgcacagaggtgggctcggatgttgaggtacccagagaccagcaacggcacttctgcctggaattcccttccctctcctgtcagtcctgtggctggcactcagatgtgggctgaaacgtccgctctcccagaggccttcctggcctcacaggctcagccagctgccccctcactctctgcagcacctcccattgtaattccctgaacatctctgatcgccagctgatacgtttcctcattgacttatttattttcctgttgttcccattactgcagactccccaagggagtgtgtcttacttactgcggcacccccattgcctagcatggagcccatcatgcagtaggcacccagcacctatctatcagctcagagcctgggcgctcaccctgttctgcccagagccctgagaactctccctctccctgtttctcgttttcacttctgtccattttactttgtcatctttgagtcacttctcacttgaggcaggaagaaagaatcaagacttgcactttctttctggacaaagaaggaaatgagccacagggtctgggtccagtgaggctggggcaggggtcatgcctgccgcctcccctgagtcagggaccagcttcctggccaggactcccaacctgcctcctttcttctccaagcctttcctcaccgccttcctcctgcctagagcatcccttcaagggcctcaagtctcttccaggttgaccccctcatttatggctgaggaaactgaggcccagaggggtcagggcctctcccaggcatatggcacttgcattctggggcctatccccaccctgggagtccacttcctccagggccagaggcaggaaccagaaggcaggggccgtcgatactaaaatcagtgggcccagaggtcagctggcccagcacagacaccctcagccctccctgaggtcagcctggcgccagcaaatcaggggaaatgttactagagtttacaaacctcttgtgatgtacagagtccagcctctccctctggccagacaggggacagtcaagggaggaggccatcccatccagcaccttgtagatccttgtctgtctccatatgtgagtcctggttccctctcccacccacctgttcttcctctacatcatcccaggagttgcaggtcagtaacacagggaccccagagggtggagagatagagtcagggctgagagaacatgctaatggccaaggtcacagcctgcactcctcgtggggctgtagagaaaacccctgttcctggaattcagaatgaagccaggccttgatctctgggtgatccacatccctaccccacagacctgccttcaagagtgtgcaacctgtgcaactgtacagggcttgcacttcaaagggcatcatccttggtttaatgttctgtcgccttcttaaaattcttttgcactgggccacacaaattatgaagccattcctatgaacccagaccctcaactcaccaccccacccacccctgctcttctgacagcaaagctgaccactcactgtaagatctggagtgaagggctggccctcagggttaagacagttggattttcctaagagccttctgaagacagaatcaaggcaaaattgtcaaaggggctttcaggcaggaggatgtttgccgagagaaggctttaaatcttaccccatagcagctgctgggacaagggaagtcaggaggaaaggatttgaacttccgggccagacaaccttggttcaaatcctggctgtgctccttacagtttgggtgatttcaggaatgttctgaaacctctctgttcctcttctgcaaaatgagggttataattacaccaacctggaagatgatggggaagattaaatagataagatatataaagtgcttgaaacagtgccaggcaaaaaataaatgcttgataaagattagctatcagacacttgggttcctgtctgagtcccaccacttactccaatgtgaacttaacatctgtgtgcctcagtttcctcatttgaacaatgaggataacctgagcacccaatgcctggggacttaggagctgccattggcatcagcctcacaccctcttcctggagaccttccccacaggccctcctctgggctcccatatcccctgcacttgcttccgtcctagcacatgtgactcgcaagtagaaatggtttccacgtctattttcaccctccccagttcggagttcatcaaggcatgaagggggtctggttctgctggtgtcagcagacagtgaaggatgaaggagtgaacagataaagggagttaggttccctatggaagctgctcacacccttaggcagtggccaccatatatgggcgatcggtcagagtggtggaagaaattttagggaaaggacgcaaaccttcttgaaaggtcagaaggttttgcatagcttcggggaagaataagcagaaggcagctgttctaccctgaggcagagggtgaggagtaggtacaaggaagtgtagggaaatttatcttaaatgcgcttgtttactcatgttgtcctaaaaccgacctttcatccagtgcatgactgctccctgaaagggggaacaataatgttaattacccgcagattgtgtttgccccaggcttttggcattatatctagctgctcttatgtgaaatacctgtgtctaagtactcctttcatcgtcactggccagaatctgaatgtgtctcctctttccccagatctgttcctcctgggaagatgcagaggctcatgatgctcctcgccacatcgggcgcctgcctgggcctgctggcagtggcagcagtggcagcagcaggtgctaaccctgcccaacgggacacccacagcctgctgcccacccaccggcgccaaaagagagattggatttggaaccagatgcacattgatgaagagaaaaacacctcacttccccatcatgtaggcaaggtaaggctcaagccccaggacaggagaagccatcagcagctggcccatagtgacaagtggtggtggtgatggcgatggtggcaaaggtggtaatagatattgtggtggttgtaggagtggagatgataagggtgaaggtggtagcaatagtggtagaggtcgtggtggtagaagtagtggtggtaatggtagcaatggtggtggtagtgatagtgatggtggtgaggatgggaaaggccaaggtggtggtgggagtggtgagaatggtggtggtggtagtgatgataaaggggtaggtggtggttgtgatggtggtgatggtggtggtggctgtgatggtggtgatcacggtgatggtggtgatgataaaggggtaggtgttggtggtgatcacggtgatggtggtgatgataaaggggtaggtggtggtggtgatcatggtgatggtggtgatgataaaggggtaggtggtggtggtgatcatggtgatggtggtgatgataaaggggtaggtggtggtggtgatcacggtgatgcgtggtgatgataaaggggtaggtggtggttgtgataatggtgatgacagtgatgataaaggggtaggtggtgattgtgatggtgggtgatggtggtgatgataaaggggtaggcggtggtactgacgatggtgatgatggtggtgctgataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccaggagtttgacaacagcctggacaacatagtgagacctcatctctacaaaaaaatacaaaaattagccgagcttggtggtgcacacttgtagtcccagctactccggagtacctgtctcaaaaaaaaaaaaaaaaaaaaaagaggctgggcgtggtggctcacacctgtaatcacagcactttgggaggccaaggcaggcagatcacttgaggtcaggagtttgagaccagcctggccaacatggtgaaaccctgtctctactaaaaatagaaaaattagccaggcacggtggcacatgcctataatcccagctactcaggaggctgaggcagaataatcgcttgaacccaggaggcggaagttgcagtgagccaagatcgtgccactgcactccagcctgggcaacagagctaaactcaaaaaacaaacaaacaaacaaaaaagcaatgttgcacttcctcagcatgccagcctctgaggctgcaaacctagatcctgagagccacaatgggatctgtaccctctgtactcctagtgggggcctggcacctcccaggcaccaagttatattttttaattgaatagaattctattttggggacatactaaccttctatgagagtatcattgtatatgcatagaatactattctataggaactataccgttcctaatattttctgtttctatgattctttaaatggagatcctctaacctgtggctctattattgataattattagctagcatttatagaaccctgtttggtgtaagatgctttacatatattattttccaaatcttactccttgggacatgaacagtacatgttacacagaaaaatggttctgtggtctaagaagtatggaaaatcctgagttacacaaagctcactggagttcttttctgcagagctgtacattgtaaatctccaagaagagaatattttatgcaccattttctgtactgggcccaggggtgtgctgatatatgtttgacaactggctgtccaggggaaaagttctgatgcgtagcacttgccaatttccatggtgtaaatattctcaccatgtctcatttcaagctatcaatgtgatgtcatcgaaggccaagacaagacaggagaagatcctcatgagcacatcattatgtagcatttccatcatacagataccataaacacagataacctcaaaacacagtcaaaggtagcaaaacaattcggaagcgatgaattctgagaattcgttgtttttcatgatttatttaattgtaagttcatataatttaatttgtaatagtggctgtatttaacaatcagctcacaaatattcctgaaaatttaagctggttcttgaaagccaagctgatacaatccagcgccagcacaccactggctaggaccccatctttgcgtggaacagcagaagagttcagtgtttcccagaactcatcttcaaaagtgctgttctactcctcagagcaaagcaacatcagaagcaatatttccattttacaaatgaggcaactaaaacttagagaggttaagtgacttctacggggcaaaaatatcctttgccttccaatggcaccaggtatattttttccactcaaaaaatgttttctaagcacctactctgttcaggcaccattctaggcatgctggggctctgccaggcaactcacaccatgagaacaactcattggtgactagtcagaggttcttttttttttttggctttttaaaaattttattttcaggggtacatgtccatgtttgttacatgtatattgcatattcgtggggattgggcttctagcatacccattacccaaatagtgaacattatggccaataggttatttgtctaccctcgccctcatcccaacctcccctcttttggagtctccagtgtctattatttccatttttatggccatatgtaccaattgtttagctcctacttataagtgagaatatgtggtattggatttgttgcttctgggttagttcacttaggttcatttaggattatggcctgcagctctatccatgttgctgcaaaggacatgattttattcttttttatggctgccagaggttcttgataaaaaatctcagtatcatatttagggaccctggccagcaccacacacaccacatacacacatgcacaggcacacctgtgtacacacactctcactcacacactcacacacagccactgccgcccattcccagctcacgtcacctcttcttttctagatcaagtcaagcgtgagtcgcaagaatgccaagtacctgctcaaaggagaatatgtgggcaaggtcttccgggtcgatgcagagacaggagacgtgttcgccattgagaggctggaccgggagaatatctcagagtaccacctcactgctgtcattgtggacaaggacactggcgaaaacctggagactccttccagcttcaccatcaaagttcatgacgtgaacgacaactggcctgtgttcacgcatcggttgttcaatgcgtccgtgcctgagtcgtcggctgtgggtacgttgcatgcccactctgtcctcctccctccctcatccccagcctgggggcacctctcacatcagccacttcactgcctggggtaggaatccagtgagttcagggtagtgattgtaatgcctgtgttgccactttacatgatttgaaagaaactctagttcctaacaagctctgatctggccacaggctgagctctgaccctagtcatagaccaagccctgatcctaatcatggactgagccctgactacagtcataaacttggccctgatcctgatcctggactgagccctgatcctgatcatgggttgaaccctgacactggtcacagaccaagccctgatcctgatcgtggactgagccctgaccctagtcataaacttagccctgatcctgatcatggactgagccctgcccctagtcatagactgagccctgattctgatcatggactgagtcctgaccctagtcatagactgtgccctgattttgatcatgaactcacccctggccatcagaggcatatctcactactctttggaacaaacttcactcacttcctctgactgtcaggactagcacaccaagagtgtagcctttacatgtgacgactgtcatggcctgccactaaggcaaaaggattcatctctaggggccatgcaggagtggtgtgggggacagagcactagccccaaggtatgtcaccagcctgggctctgggctcaggaggttactactccacctcttcagtacacctcagactccagagggtgccagaaaagagcttccctcttcagtccagagtctccagccagggccctgggaccagaccttcgggttgagtgtgagatcctggagttcaaggggatgcaagaaatgacaccactcctttgggggcacctttccaggagagggagaagcagctcattgctgtcctccatttctctccctgaccccaaccctccgccccctccctcatttccccaggaagcacacaaaccacctgatctctttgaccccttcaaggttgacctggctgggcccccactgccaccagcactttgcccccatgcaggctcctcagaaaacaaaacagccttttattcccaggacctgggggaggtggggacagagcacagcctgagccccatctgctctgttccaggaatggggtaaggggcctagcagtcacaagtcagcaaccccaggattctctctctgcagggacctcagtcatctctgtgacagcagtggatgcagacgaccccactgtgggagaccacgcctctgtcatgtaccaaatcctgaaggggaaagagtattttgccatcgataattctggtctgtgtgactaacactcctggacagtcactgatttggagggacaaggggaggtggatactccaggtgcatgtgctaagggaagtccagtctgacaggtgtcactagctactgaaccacactgtaccatggaagtagtcagtatcatatgtaaagacaaggcggctggtcaagggagaaggaagcaggcaggtgcccaagaggtggactcaagtccagggaacaaaatcaggatcttgttacccaagaagtggccaaggggcagcagaggatggtggctagccgctctgggtgcaggttcagacagatctggtttccaaagccagctctgccactcaccccctctagagaccttggacaaatcaactaacttctgcaagccttagttccctcatctaggaggtaggaatgcttatatttatatcgtatggtagctgtaaagtttgagttagatcatgtataaaggcagcaaggcccatagtaattgcttatgtgatgacttaacaaaaaatataaggactgactcttgggagcaagaaagaagtccagtggaactgtctttcagagagatggcaaatacatagcacagatgccactactatgctacagtgcaccaaggcagacatcactaatctatcacagcactctttccatctgagcctagatatggcctcatggtctttgtcaacacaatatttcaggtggcgaggaccaataccgaacccaactattgggccagctttggcctcacagtataggctatggaggtagtgggttgtagactcacagttctcagccccatttgcacagtggaatcaccagggaagctcttaagtcaggttctctctgggcaggccctaggcatcggtattttctagaagctggtaacatggttcctgctgggaatctttttgcaggacgtattatcacaataacgaaaagcttggaccgagagaagcaggccaggtatgagatcgtggtggaagcgcgagatgcccagggcctccggggggactcgggcacggccaccgtgctggtcactctgcaagacatcaatgacaacttccccttcttcacccagagtgagcccctcctctagggccctgggaaggggggctgggataccccagactcagtgacttggggctctgggaaaagagttacaaatcactttacctctccctctatcccagggtaggcctgatgcccaaaggagtcctttgggtgaagggaggggccctgcttccatcccaataccacattcccaaggccatcctgccgccccctgccacaatcccctcataggccagagggaaatcccactccctgctgggtgccaccactgtactgtgtcccaccatgagacacaagcagtttcacccagatcccatgggcttgggaaaatcaaagccctgagactcaggtcccagctagaaattcccacaagccagtgaacatggggacagcaaagttctatatccagagccagggctgggccctgaccccacctacacactgatccaccccacagagaatgtctaatgagagcttttcccatgcctggggcagatggctctccacttgcaactcccagtgctgatactgtcattcagttgttcagccaccctagagacaggccaattgtcctgaagtggcttcctcgtacatggcataagctccctgaaggcaggacttgtctctcttgtccattgataggtcccctagcaaagtgcctggcatacaataggtgctcaatagctatttattggatggagggatggatggatggacatacagatagggaagaccctctttaccttgagaatcccaggggtattattatttatgattattttattatgcccatttcttttatcaaaatatgttagaatagctgaaagaggcaatcgccttgtctatctcattaacccaaagccctttggggtgctctgtttgcatcagccaagtacacatttgtcgtgcctgaagacacccgtgtgggcacctctgtgggctctctgtttgttgaggacccagatgagccccagaaccggatgaccaagtacagcatcttgcggggcgactaccaggacgctttcaccattgagacaaaccccgcccacaacgagggcatcatcaagcccatgaaggtttgtaggccaatggcaacaatgtcaaacgtgaggcttggggctcttggcacccacaggtcctgcttggggattgctcctgggccagagaccatcaaaggaccatcaaagctccaaggtggtcatgtgttcatggagactgtgatccagtgtcttaggccgagttacttgggaagcaaatcttaaggccatgactgggtgtaaattgtttatctgggaggtgatcccaggaagccccaggagcaatgacccactgcggggtaagtgtggaacacatcccagagttggagaagctgagggtgaaggagctggggtatttatacacccgctgtctgtggtgttgactgggggctgcccctggagttattacctctctggcactttctggcctgccatgtgtcctggccagtagaaatccatcagcatgaagaaaacagtgagtaattgtggtgacatggatggccactgacactggatgctgctgacagccagagaagccagattaactgaatctggaagaggagggagaggtcctgtgaggggcataaaaaatgcctctggaatggccatgcagaggattgcaagtcctgggcctgagtccttctctgaaccagccccatgctggggcttggaaacaccaaggagaggcagacacagcctccagtgtcagcaaaggtctcagtgaatggggaagacatatgcatgaacaaaaaaagtacagccaggtgtaagtgatacacagcagctctgaacagggagcaattacctctgctaggaggggtttctgagagagcatctgattaccttctgcttggcttcctgagggatgagtaggagttttctaggcaggcaagggcaggagaaggatcttgagcaaaggcataaagaaaaagcatgtccggccgggcccggtggttcacgcctctaatcccagcactttgtgaggccgaggcaggtggatcacctgaggtcaggagtttgagaccagcctggccaatatggtgaaaccccgtctctactaaaaataccaaaattagctgggcgtggtggcaggtgcctgtaatcccagctacttggaaggctgaggcaggagaatcgcttgaacctgggaggtggaagttgtagtgagcggaggtcgtgccattgcactccaatctgggtaccaagagcaatattctgtctcaagaacaaagaaaaagcctgtccttaaggacctgtgggtagaaccactagtgacgctcttaagagcaggaccatagttgatccattctatgtcccaaacgctggaaatagggccaggcacacagccagggttgtgggtgtggccatgaggctgctgagatgaaatggggagcagctgaagacagacaccaggcccagccgctgtcttgatgacctcagaaatatcacttgtcgaggccatgggcccctcatctataaaatgggtgtcatcctggtactaccttgcatagttgctgtgcagatcatgtgccacacacatgcttggcccagagcaggcactcaccatcctttttccttacgcagcctctggattatgaatacatccagcaatacagcttcatcgtcgaggccacagaccccaccatcgacctccgatacatgagccctcccgcgggaaacagagcccaggtcattatcaacatcacagatgtggacgagccccccattttccagcagcctttctaccacttccagctgaaggaaaaccagaagaagcctctgattggcacagtgctggccatggaccctgatgcggctaggcatagcattgggtaagggggcgtgtgtcgatgagaatgataaggacaatccggcctggatgttcctatgcctgctggtctgaggccaggactcagagaggggaactggcttctcctagcacttacagggaaagtgacagaggcaagaccagaagcccaagctcttgcacttggcagcctggcatcttgacctgcctggactcccccacctagcatggtcctgggcatccagagctacttgtcctctgtccggccttgaaggcttattctctgcaccacagctctcaccagtcctatgtggtaagatctgacagtcaagaaagcaaccaatcagacgacacaccagaggccccttcactaaaactgtattcttgaatctatcttccccaaaccacaaaagtaagaagtgttcattttatacagtgaaacaacacagagatctaccaagaaaacactgataacccccactctcagataactcatgttcgtggcctaacctggtcctattgctcctttcttttcgtgaccacacaaacatgtggatgcatttatggtgggtttgttgttgtctgtttgcttttgatgtttgattgttttaaaatttttttggatcatgccatgctggtttcatcgatatttgctcttctatcttaactaaatttctcttttacaatctttagaaaaaaatgatatagttccaacagatactttttagagccatataatatgcaatagtaagtataaattcaattcaatcttattttattgtagatgcatagctgattttgccagcaccatttactaaatattataataataagtcatcgttttcccaccttcattatatactaagttttctgtatatacctgtatctacttctaattctctgtcctatccatcattctatagcaaagctattctgttttattctactagcttgtataagtccattctcctataaagaaatagttaagactgggtaatttataaagaaaagaggtttaacaggaagtatagtggcttctccttctggggaggcctcagaaaacttacagtcctggggaagcaggcacgtcttacacggccagaacaggagtgggaagggagttgttacacacttttcaacaacctggtctcatgataactcactagcttgagaacagaacctaggggatggagctaacccattcatgagaactctgtcccatggtctatccacctcccaccagggcccacctccaacactggggattacatttcaacatgagattcggtggggacacagatccaaaccatatagctttacactagatcttagatatacataaaagtccttcccatgttgcttttttatttgatataattttttgtcaactctcattttttcttttgtgaaatttaaaattttgtatccaggttttttaaacattagaattctagtgtttatatattaattttggtatagctaatgtttcaagggtattaagtcttcttattaaggacaaaatatgttcttccattttggcctcatatcctaagttttgggactactcttcattgccattcttttctaaatagcctgtaattataatttttgtttctcctttgatccaagggtttatttaagagattgacttgatttctttattttcatttataagtcatagggtgttttttttgttttgctttagcttgttctgtgatgtgatacaattgtatttgtgtccacttcttcctagaatatctaagttttgactttatgtatttaaatttttctattcagttaacaaaggtttgcaactattttaccttcattatggtttgtaactttcatccaaatgtaattagccaatttgttctgcttaaatattttgcctttaattctgtttcctgatgttacatttgttagtcctgttttcatgttattcatatacgcctaatgcaaattttccaacctttacttttaatttttccaggtcatttggcattaagttgtctcttgaaaacaagaatgcatttggctttgctttttaatctaaactgaaatgctttgtgtttaacctatttacatttttcatcataattgatatgtttgatgttccttcttttatcttgttttacatttctcatttatcaaatttaatggcttttttctttttcctcatctttgctatacagtctatgtttctttatttttttttctcctagatatttggatgaggtgcatccatttttatttctaccagtgagatttacttctatctgcaaaatttaaaatgttttcttggacctatattttctagttaaaactattatagacatacacacacccattgcttttctatgtatgataaaaaaaatcaatagttttgttttaattcttcccatgccaggtttttactttatattgagatgtttagttagatacagtaagttttcaaaaaaaaattcaggacacaaatatcttagttctttgccttttttggggggtgggggggacaggttcttcctctgtcacccaggctagagtgcagtggcacaaccatagctcactacagccttgaacatctaggctgaagcaaccctcccacctcagcctctgagtatctgggactacaggcacacaccaccacaccaggctaatctttttttttttttttttttttttttttttggtgagacagggtctcactctgtcacctgggctgggctggtcttgaactcctggcctcaagcaaacctccagcttcagcctctcccaaagcactcaaattacagatgtgagccaccatgcccaaccttgccttctaataacacctagatgtattcgtataatcctcagattataaacacttcccttcaaaaatactatcaatgtattctagtatttaattttgtgggggcatctgaggcaaatctgatttttctttcctcataaggaaattatttctttctgtctggactcttttcagtttcttcacacagccttgaaattcgtaagtgtcatcaggatttgcctaagtattggggtttttttcaatgatgcctgatgtcaatgacatcttataatgtgtagactcaagcctttcttcagatcaggaaacttttcttttctttttttttttttttttttttttgttatttcttctgttctgtttgttctgggattttcctcattaatagcaactattattcctatatacacaaaacatatatatttatctttccatagatttttcctgatttctgaaagaactttttaagttttttatttcacaaagttaatttctttgtaattacttcttatctcttccagctctttttgtattccttcctggctcttgcccaatgatcttttcattaatcactaaaacaagtcccagctatggtgtgatgtcacctgttcagctctgaaagtgcatctgatggtctcaggtaccacctccagtccagtgatggcaatgtaactaagatcaaagacattatcttgctatcctgaatccctctgtgtaggtccgctcttgtctgagtggcagagtgcaatgagcagtgagagaggggcatggagtgggatgcaggggacagatgcagaagggccttgtccatcatgctgaggagtgtagactcagcaaagaacaatggaaagccatgaaactctctcccctgggcagatactccatccgcaggaccagtgacaagggccagttcttccgagtcacaaaaaagggggacatttacaatgagaaagaactggacagagaagtctacccctggtataacctgactgtggaggccaaagaactggattccactggtgagtggccacatctgccagggcacctggattcttttccttttccctcattcttccaaaactggcataatcaataatttggggtctctagacgtattagaagtgcctgctgaagcacccgctggttgggatgctatagagctcccatgcccaagtgtggtccttgaacccagcagtatcaacatcccctgagaccttgttgcatctcgggcctcacccccacactgaatcggaatctcatgcatgtcacagtttgaaaaccactgtcatgaaacaggctgtgcagatgtctctgtgacgagaatcacccaagtcacctattaagcataaagctctactccaccctgcaggttctggtccagtgagccagagatgtgcatttaacaagggtcccatgattcttagttatcatggctgtttgggaaatgttccttcagagggtgtttatgcaccagttaataggtagaattcaaaatgtgaagcagcttccaattttgagattgtgagtttctctagaaattgtgtaatttttgccagagggaggggcaagagttggagttttgcatcctctatctatattagaaaatcacaatcaccctccaggagaactattaatactcccactttacccaggagcccgctaggccaaggatccctggcgcctgccgggcccacccagactcacttctgccaacacagctgctgccccaaactgtaatggactcctgcatgtttggccagatcagtctttgcttctttctcctccacataatcccattcatagactctttacatttaaatggtttaaaatacggaaaatacagaaaatgagaagaaaatactcctcccaccaatgccaccatgcagagacagttactattagcacattcatgtatttttatttttatacatatttttatacttacatgagattgtaatgtttgtgtaagatattatattccacatttttacttaacctttacttaaccttattccagaaccactttctcatggtactaattttttttttaagagagaaacagggtctcactctgttgtccaggatgaagtgcagtggcacgatcacagctcactgcagcctctaattcctgagttcaaatgatcctcccacctcagcctcctgagcagctgggactacaggcgtgcaccacattgcccagcaaatgtcttaattttttttgtagagatggggtctcaccatgtttcccaggcttgtctccaactctgggccccaagcaatcctcccttctaggcctttcaaagtatgaaattacaggggtgagccacagcacccggccttaaaattttttttaattatatgtttaagatgtaagtgacataggcattgtcagtggccatccatttcagtcttttccggtagcctagtttactgacccaatctcacttaggttgtttaccttttcaattcttttatgattaatttattatgttttatgtatttaatcaaataattaaatttttaattttaggaatttaattacaatttttttaatgcacttaggtggtttacctttttgattctcataatcaaagtaatacctcagtaaaccttatggatgagatttaacacctccccccaccaaactccttttatccagaacaccatcctgggcctctgttccacagcctcctcctgcaaaaagtggcctccatagggcagccctccttccacacatcttccaccgcccaaggccagcatcagctgagcccataatggtgacagtcttctcccctgcaggaacccccacaggaaaagaatccattgtgcaagtccacattgaagttttggatgagaatgacaatgccccggagtttgccaagccctaccagcccaaagtgtgtgagaacgctgtccatggccaggtgagtctggttcaggtgggaggggaaggcagcaccaccctggggcaggctggggggcagaactgctcaacagagtcagcaggagttcccctgtacaatagccttgaggaaaataacattatgcccattttacagatggagaaactgaggctcagagggaatatatggggagtagattggcggggcagggaagtagaaagaatggctttatgaagaactaaataggtgagtgttgcaggtgggaaacagccatggtcaggacttaaacccaaaggctccatcgctaaacctcagaccaccccaccaccccaccaccatcactgaccatctcctgtcttccacactccagctggtcctgcagatctccgcaatagacaaggacataacaccacgaaacgtgaagttcaaattcaccttgaatactgagaacaactttaccctcacggataatcacggtaggcatcaaagtaatcagttcagctgggcgtgatgacccacacctgtagtctcagctactcaggaggctgaggcaggaagatcgcttgagcccaggagtttgaggctgcagtgagctatgatcacatcactgcactccagcccgggcgacagagcgagaccccgtctccaaaaaaagaacaaatgcagtcagttggctctaacagggtcggggtgaggttatttgagtcttgaggcaccaaggtcaaagaccaggccaacaaattgagggcaggctcccactgggattttcaaatcattagatattttgtacaatttctgccacatacattgtacaattggtctatgcaatggtcagagacactccatccaaactcccaagtccacgtcgcctgcaaggagccagcgaggagtacagaacagatgtgaggatgcaggcagtcagctcagttcaagaactagccaaggagtcccctcccatactggaggctctatgggtcagcaaaactgcacattaaacatggaactttgaggtcattcccaaagagtcaaaactggaaatgtgaaatcctaaatcccaaggatccagtgagctttgttttaattcagctacaacgattactcacgattagcagggtggcccgtgtgatggcattagcagccaatcagagcttctgaggagtaggtgctgacttaagtgatgatgctgagttgacttcattccagccacaagtaggcaagcttccatggcctctgaaatttcctcaaaaaaatagagaaaattccccttgggtttaaatagagtgatccttcacctagcatgggatggaattcctgcctgtccctaatgggcaaaactatggtggatgaggatggctgtattgcagcagcccattactacatttaaggaagactggggagtggggtccctgaaagttggaggcagacttgagggatcaaccacagaccagtccttaaggagactcctgtgggatggagaaggtggccctgatgtgttgacagtcaatgacagaccattcaacacccagttgtcattagaagtaaataatgtggcaaaaatgtcaccccctccccaatgtccacctcagtcccatctcagagtggggatctgcaatacagtagaaagattcagtgccaccccaaagacacccatatacaataggaggcaagtctgttggtgtcaaattcacttatatcatgaacatcctgcatgtcaaaatctctagtttctcccataagtgtcaatgacatatagtttattttgaaatataatagacttaatgctgaaatgtaattatgaataatgaaatataattggctttcattcaaaatcgaaaagatggattcctgggtttttcaatccagtgtgtggagcctgtgtagctaagtaaatcctggagtagggagttcctggatccttctctgatcgttgacattacaacctcctgggaccctgcaaaaggcagattatctggcctctgcccagaatcactgaataagaagtgtgtgtgagcataggggtctgaaaatcagcatgttttaaaagctccctgggggattcttgggtacaggaaaccactgattggatctgggaaggtgggcggggccaatatttggacaaaagcatttcccagttccaaactgcctgggaaacccgcaattctatatgtaatcattttctctgtgccccaagggacatgcccattgtttttactgttttcaacaatgtaacaatggattttcagagagagcagaagctgccttagaaattagcctaatgctaaaagactttttaaaactttatttttccccgctgcttgtcaaagcttgaaacggagcattaattaattgagctgaaagagaaaacctcctgttactggagtggggttagggaagaggaaggggagaggcatcagttgcccacaaatacagaaagcaaaggatttgaccttctttcaccaaggcatccttggagattgggtcaaagcagctgccccaaaatatcccctctgtggcggaacagacctgcactcagatggctgaaacaagaggcgctgggtgcaaagggcagaaaagcagcccagcgagcacgcaggctggtgcagtcagggagggcttcctggaggagccaggtttccccatctgtgcagatggcaaagcctgactccgaggccttggtgtttccagataacacggccaacatcacagtcaagtatgggcagtttgaccgggagcataccaaggtccacttcctacccgtggtcatctcagacaatgggatgccaagtcgcacgggcaccagcacgctgaccgtggccgtgtgcaagtgcaacgagcagggcgagttcaccttctgcgaggatatggccgcccaggtgggcgtgagcatccaggcagtggtagccatcttactctgcatcctcaccatcacaggtcagtgctgggcagggtggggagaagacacagtgggtggaaggggatggaaggtgttgggaggcggggaggcttcacaggaaaagtagaggccagaggttcaggcccaaccctgcctccaatctgcaatgcagcccttagccagttcatgtgcaggatgcaggatgtgagctccaaccacctgggtgctcacggtgggggatgagccagggaggaggagggggtgggactcaggactcctcccccacgcatcaggccagtatcactttaaaataacttatacataacagtcactccttccacttagatattttcagcatttactgagtgccaggcattgttctgggcatgtatttacataaaacctatttttgaaaaaggaaaaaggatccagttctaaaatggaaagtttaaaaacttctagtttagattgtctccacgtgctttctttctttttatagaattcctccggccttgatacatattttttttcttgtttgggcctcagaaattttaggagcattgtaggccttagtttggatttcccagggagcagccctgggatgaggattggggtggaagtggtttatttgggaggtggtttatttccctggatacctcctaaggcagagggggagtgaagctgggaagggaggaggccagcgaaggtggaatgttcccatcgtgaggaactggagcctcctcccatagggttgccgggaggcagcgtggggccaccccccagcatcatcccaccgggggagcacagtgatgtactgtatcctgcatttcactcgccatgagacgcagcaggggctgatcctccagaggaagccctcaggtgattagagatcaccctggcactcacggcaaggcctggatacagccacggggcacctgcaatacagattccaggcctctcctgcctgtagccctcctgagagtggcctcggtatgccccacttctgggacttctccagcagagatttctcctttattaataattaatgatgatgatggcatccccaccacaaatagaattgcatttgacctcacaaccatcctcccaaatataaacagagcagggaggtcatcatttccattttacagacaaggaaactgaggctggggggcagggctgccttccagggcatcccagctttacttatgtatatagtagtttgttcagtaactcaaagctagaaggcctgagcctaattttagaagctctctgcacttcaaggtctacccctccttagggatccaagaccctcacatagccacacccctcagagattcccacaggctgagcatccgcacctgcccctgggtgtgggggaacggcagcggtgggagtgtcgggcgaggtggggatgagtatgcgggggagcggcagggacggggtgtggggtgtagggggatggcggggatgggggtatgggggaacggcggggatggggttgcaggggaaggggggccaaaaggatggggttgcaggggaagggggggccaaagggatgggcatgctgggagggcgtgggggtggggttgcagggggcagtggggatgggggcatggggggccgcccaggcccccagccttgtctgactctgctgctcggctccctggctgcagtgatcaccctgctcatcttcctgcggcggcggctccggaagcaggcccgcgcgcacggcaagagcgtgccggagatccacgagcagctggtcacctacgacgaggagggcggcggcgagatggacaccaccagctacgatgtgtcggtgctcaactcggtgcgccgcggcggggccaagcccccgcggcccgcgctggacgcccggccttccctctatgcgcaggtgcagaagccaccgaggcacgcgcctggggcacacggagggcccggggagatggcagccatgatcgaggtgaagaaggacgaggcggaccacgacggcgacggccccccctacgacacgctgcacatctacggctacgagggctccgagtccatagccgagtccctcagctccctgggcaccgactcatccgactctgacgtggattacgacttccttaacgactggggacccaggtttaagatgctggctgagctgtacggctcggacccccgggaggagctgctgtattaggcggccgaggtcactctgggcctggggacccaaaccccctgcagcccaggccagtcagacgccaggcaccacagcctccaaaaatggcagtgactccccagcccagcaccccttcctcgtgggtcccagagacctcatcagccttgggatagcaaactccaggttcctgaaatatccaggaatatatgtcagtgatgactattctcaaatgctggcaaatccaggctggtgttctgtctgggctcagacatccacataaccctgtcacccacagaccgccgtctaactcaaagacttcctctggctccccaaggctgcaaagcaaaacagactgtgtttaactgctgcagggtctttttctagggtccctgaacgccctggtaaggctggtgaggtcctggtgcctatctgcctggaggcaaaggcctggacagcttgacttgtggggcaggattctctgcagcccattcccaagggagactgaccatcatgccctctctcgggagccctagccctgctccaactccatactccactccaagtgccccaccactccccaacccctctccaggcctgtcaagagggaggaaggggccccatggcagctcctgaccttgggtcctgaagtgacctcactggcctgccatgccagtaactgtgctgtactgagcactgaaccacattcagggaaatggcttattaaactttgaagcaactgtgaattcattctggaggggcagtggagatcaggagtgacagatcacagggtgagggccacctccacacccaccccctctggagaaggcctggaagagctgagaccttgctttgagactcctcagcacccctccagttttgcctgagaaggggcagatgttcccggagcagaagacgtctccccttctctgcctcacctggtcgccaatccatgctctctttcttttctctgtctactccttatcccttggtttagaggaacccaagatgtggcctttagcaaaactggacaatgtccaaacccactcatgactgcatgacggagccgagccatgtgtctttacacctcgctgttgtcacatctcagggaactgaccctcaggcacaccttgcagaaggcaaggccctgccctgcccaacctctgtggtcacccatgcatcttccactggaacgtttcactgcaaacacaccttggagaagtggcatcagtcaacagagaggggcagggaaggagacaccaagctcacccttcgtcatggaccgaggttcccactctgggcaaagcccctcacactgcaagggattgtagataacactgacttgtttgttttaaccaataactagcttcttataatgatttttttactaatgatacttacaagtttctagctctcacagacatatagaataagggtttttgcataataagcaggttgttatttaggttaacaatattaattcaggttttttagttggaaaaacaattcctgtaaccttctattttctataattgtagtaattgctctacagataatgtctatatattggccaaactggtgcatgacaagtactgtatttttttatacctaaataaagaaaaatctttagcctgggcaacatagggagaccctatctctaccaaaaaaaaattaattagccaggcatggtggcaggcacctgtggtcccagctacttgggaggctgagataggagaatcacttcagcctgggagatcaaggctgcagtgagctctgaacgcaccactacactccagcctgggtgacagagtgagatcctgtctcaaaaaaagagaaagaaaacctttgagattcttccatttttagagctgagagagcacttgtgaaacacacacacatgcacaaacatataaacatgcatacaggcatgcacatgcacacacaaatacacatacacacacacaagcacacacacaccaccaccaccatcatcagaggaacttacagaaaaggggacatttatagattcctaggaatatgccaaagcttttcaaagcctctatggacagctcattccttaacttttccttttaaaatcttttttagcttcttatttgccccagccactatcactgcctcaggcagctgcaacgttaaacaattgccactgattactttcaacaaataacctcagagaaaaggctgtgtgtattgaatgggtatcaagtcaggtcaaaagaacacagccttgcaagtggagtttcttccagggaactaccagacaagttgaataatgacagttatctgggaattggactttgcagaagctccaaccctgttctgatctgtttgtctctagactgctggttttcaccatgattatgaatccactgggtttcaaggctaccacaggtctcgggagaaggggatgggactagggcaagttaaaatgccatcaagctctgccaggtgtggtggctcatgcctgtaatcccaacactttaggaggctgaggagggaggattgcttgaatataggagtttgagaccagcctgggcaacatagtgagacccagtctctattaaaaaaaaaaaaaaggacaatgccatcaagctcactgttcttaccaatatttagctgttttaaaaaaaaataggtacaccctggattattgcaagtttttaattagttttcagagttctgaaaaagttggttttgacaattttggccagtattctcattgcttttctcggggagaagtgctccttactcagccattcctgccaatgccaccccttccagctggtttttaagctgttttcccacctgtctgaagtacctgctccctgaactcacggttgttcaatccctggagcccatgagatctgttcactacttccttctccaagaagcctccccatccccaagacacctccagatgagacaatctctgtcgctccaaccttcaagagggcctggctctgagctcttggccaccctggtcacctcctctgcttggaacctgtttaccctaaggtaggaagagtgatcttcatagtggaggagggcctgcctctgaatttgtacattttatggtaccccaaacccagtggcctggaatcttctgaccacactgcacatgcctgctccagccaaccctgggtcccaagcctaccgaaagtgggcaaggggagcagaggctcagagcccttcccctcccccaggccaaacctgtgaagccagcatgaccttcctcatttcacagatgtccaaggtgggacccagatggggatgagatgtggccagagccacacaggcaagttagggacagagttgggcctagacactctcccattcccctagaccaccctcaaccgttgcctcctgggtcccaggacaatgcgaatctacagacttcccagacctggggggctagaggctgaaccaaggagcatcgtccgcggctgttgggttggtaatgggaaatgaccactagggggcgcgctgtgtcaataaatgctcagccagggccggtgtctgcgagctccgcggccgggcatcctggcaatcaatggaccgcaggttctgggggttctggaccttgacagagaacctggtctggccctacaacctgcctggg

SEQ ID NO: 616 - DNA, 42410 bp, Human
actgtccaatatggtagccactagccacatgtggttatttaaatttaaattaagcaaagttaaatattctcttccttagtcataataaccatattttaaatcctcaatagtcacatattataaatggctaccatatctgacagcatagatagagaacatgttcgtattgcagaaagttctactggatagcactgttctgaggacgttaaaatgagtaagaaagagaaaaaggcagggaaggaggcaagggagagaaagtgattaacaaattccctctcccgctgtgtttaacatcgtattggctctcatgtaactgccaagacagacgctgctctgcagtattggagttctatcacacctcctctccagaaagatgtttgagagattgctgccttatgaatcccctagtcatataggattgttggagcaaggcattgagttaggggtggagccagggttaggtttaaggaaaggtaatttaatggatgaaggaggcccccatgcatgccctagcatcatgcccagaatccgagatgcataaaacattgactcgccactggaaagctgcaagagtaggtgcagttgtctctggtgcccagtgagtcttctgctattcatggtcagacaacatgatactaatatattgctcagactaagtcataggttaatacagtctattttatttgacatttctcattagagaaaatcggccagctcatctttctaaattttatttatttacatctgctatttacaatcataaacattcttattcactgcaaataaacatgggcagcctatctcctcccctccacactgtatgatggataatatggaaattcaaaccacacatcttctttgccacaaatctgtagtgaaatgacagccttctatagaccctctgaccctcagagattttcttccttttggagacattttgagtatctttttgaccataatcaacatcttatcaggtaggtctcttgttctaagtagccgtttcaaactctgagggtgtccagtgtctatgagcttcctgccactcacaatatttatactagacgttgccaggggaagagaagagagtccaaaaatatgtccaaatgctgccctgtgaaggttgctatttattttcacaaacctcagggctgcattcagtttcccgtctacctgtgtaggcagccatttcttcagtgtattccctatgttctaattggctcgctgtacagattcttggctctgtgcttaggaattgtcattgacttttaacccacctcacctgctgagcagctttctgtgttttcattagtatttcaggcaccgaatctcatttttaaagttattatcaggattttaattggtggttctcactattcacccttaagtttagtaatatttaaatttttattttgttgcatttaataaaagaatcataaagaaagaaaaataattagggagagaaaataatttctttagagggaaaatggaggattccttagactgaaggctggtcagttaatgggaattgtgacttatgcagaggatctaataattgtaagtatcatggttttacttgtttgaattaataactttaaaaaatctcagtcttgcattagcatattttctgtctcttaacaaccgaaaataactgaaactttcccaacatctactaaaatggaaagtttgtcattttctactatgacctgagggtttggctacaaacagataatggaatgaataagatgagcattcaagttatacctgcctgtttaatatggggagaaactaaaccacctgtaaagaaagcatggggtgagaagcccccatcacctgtataaccctcggtatttctgttcactttaagagcctgccactgaaaacattcagtaaaggagtgaatcttccttgccccatcaagagtcgcttttcagctggaggaagggtgtgtccccaagtttttacctgggagcaatgatgatcttgtcaagcatttcagtgagaccagcccaagtttttagggtggggatccagactggttatacgtaccttcagtccttctcccagaggaaggcagaaacacctcaaagcctgcatgtaagaacatctactgagaaattattttaatcagacaccagctgagtgggagaaagaaaaagaacagagaagaacaaacaaaactcccttggtcttggatgtaagagaatccagcagagatggactggagtttcttcagagtagttgcaatgctgttcatttttctggtgagtggattctggtaaaagtccttcataatcgtgcccattgtaaacaagtgaaaactttttagaaaatgttagtgggcattatttctaacctaaacccattgaaaatgtatattaatgacaagatgattttatgaactagatttttcaatagcatttctctctttaattgaagactcaagatcatgttaatgcctcagtgtcaactcattgtattacatctctgacactgaagtcattgctaagtcatgctgggaaaagactgaatttaggaaattcctatcgctagttagtagcactttgtcgttcaaaatctcttctgcaagagggcttttaaactaaatatcacaagtgtgtctggatttttaacctgtttttttttttattttttttgtgtgtttggtggtggaattactctaatttttaaaacataaaaatagcaccacataatttaaaatcgtagcagtttgtggctggtctcgctatccaaataaagtcatcagttgcatatttggttagaatctgtatcactactataaaaagccccgcactatttaactatgattttatttaaaacatttttaatttcaaaaaacggcagtacaggaggtttataaatgacatattaagtgaagaagtggctataattaaagagtaagtataattattattacactcgatcttactactggaatgtcagtgatgactgcgatataaaagttgtgcacttgatcgtctgacgaatgtaatgaaatactttatcattgcccccttacatgtaattagttttcttgctgtagagataatactaagtgcaccactaatgtattatgtcaatttcactttcagtgaaaatttgaaaattgtaatctctctcatagtaaggttaatgtaattcaaaaaggcaggtgccaagtaaattgccctccagcttggcaggatgtatagtgctgtggttcacatttgtttctacttgcttaatttttgaactggaatgttgggttggttggtataataagttagatctttgattcaaagtatgctggttagtttgaattcagttttattaactaaggcgggacataatcagtggatttagttataaatgagcatcagtaagctggtggctttggttccaagctttccttcaaacattagtcctatcccatgctcttttcagtggatatttaggatcagttgatttcattacttaggatttggtagggatcactgatcattatacagtatgtcatttgaaatatgagagtttcatattgtcagtaatcaagcacttttacttaaaatttcaaataaatttgatccattaagagctattatagttttagttgatcagcttgttcagataggtgtacactaactttcatagaatctctaagatgtgccttatttgttgatttatttatttcaaattaattatagcatatcaaatttctttaaacagccacttcctatttagtcattcttcaataaaatgtatcatcatcaaaatcatatatctttattgaactttctctagctgtgcctagatttttttttgttggcttatgggggtttttttgggaatgggggaagaggaggttaccttattttatattgaaattaatcacaagtctcccacatgccttatgaaaattttttctcaaagaacttacactatcatgaattacaatgtttcattttcacgttgacatcataggtttttttggaaaacatttcactttctaaggtttggaagatcaaaatttattttaagtacagattttaccacatgggataattttggtaattgtgctttggagtttcctaatctgtatttttctttaaaatactttttttcttcataaaacaaccaccactatagcaaattctttcagttatctttctcctagtctcattataaatgcatgcttttaccaaaaaatgaaaaaaaatttatgtaaagtctttatattcgtctctactcaaagtcaataagcgggaacctgcattaggaagcgtatttgtacaattgttaaggcctttaagatatttaaattggtagtgtcttttaagcaaatctacctgagaactgggtaactatttgtttgcaagcatactgtgtattcatctcaatgcatctgaaggttgtgaaccttgttcaaatgagtgggttgaatcagggagaacaaagctggaggagctgctcttacagcaatcaagatcgctctatggctattccattgttctgacaagtctcctggacaggcaagagattacacctgctataacactgcaagtcaaacacattttgttaattctgcatctatttttcattcttctttttgtttccatataatcagtgtatggagtagagaaaggagttagaatgtattttctctaggcctgagaacaatgcttcttatgcaccaaataaaagaaatctatgtgcatgtatatgacaatggtaaaaagtacagcatggtcactgtgggaaagcaaaacagagccagagggatctctatggttttaatgatttctgaaaattacttgcaactttgccaggtccaattagtccatttaagtcaatacaaatctgaagatgtctttttctaaaaaggtaaatttctgcagctcaagctcaaagaacagagaaaatgacttttatctatgaccatgaatgatctgattattttggttcattatagtaaccattttccccctctttctatgggttaatatttcatttcgaaacaaacaaacaaaaaaaaacccaaccctctgaccacctgataaactaactccacagtttgaaccgaactgaaattctgtaaaatatgagcaggagtttttaagagtactttcatcactcaggctaaaatacacagaaaataatacacatttcattacatagttcctaaacttacttgaagacatcttaagtccccaaaattgtgttcacagatgcctaaagcaagagaagaactaacaaattagtacagaccaaacagaagacaagcaaaagagagagctctttgtgctttcttgagcgtgtattatagtgatatgtagtatagagatcagtgtttcagtaaaatattttgtagaaaatggaaggaatatttctgttcacgtattcagtgaaacttacaaattgcattcaagtgtcatcattaacagttatatggtgttcataaaagctttattatttcgctgtagatttaggattagcatcttctatcacctttacagaaacaaggagtacaaatttatcatcgctcaattggtttgagttgccacaaagtaaaaacattttgtcatccctgttttaggaaaagagtagaaactaaagcactgaagaatgctgtcttaaatctgaaaggctgaccctagaataagattcacttatttaacaaatctcatcaatctagaaaattatcttatctatacccagagcacttaatttctggtaactctttctccacaacacattcatcaaagacctggttgctgagtatccctgtgtcctaatagacattgcctaacatatcagcaggaagcctgctgtgccaggcaccgcaattagatttataatgctccctcatctcagggaacacccttgcccagtgctgggtcatgccacccttgctgattatgcttgatatgcaaattccttcaatagacttagacagatcaaatttttttaaatgccattggctgctgatccatgctcttaattggtctatgagaataggccacagtttttcatactcgtctaatgagaaatcatatctctacaaattaatggttgcctgttgctctcaaaactgcaagactgtaagttatttgaaggcaggttctgtgtctgatttgcctttgtatcccttatggtgccttgcaccagtgcaagattgctcaaaagatgtctaatcacacacagcagaggtaccacaaggaagtttctggatagtttatacagctcttcccccacacactccaaaaaattatcacgctattaaacatagaaataataatactggatttccccaacattttaatggtgtagtattaaattcattttacatttcacctgagacttactataatattttcaggcctttaaaagtcttaatctagtgttggatccacataatacacattcagtatgtacttgtaaaatacacaaacgaaaagaataaattagagaattcaacccattaaggtgctgtcaacctcagactgataccctttgtcagagcagtacaaaggaaagataagaggaggtttttaaataaagcaaattgtgatattttagctttgtttcaagtgcatccttgcgatgtatataaaagttaacaattacattagaattgaatgcttaacaaaaacgtaacaattatgttagaattcaacgcttagcaaaaagtgacttggaagaccatctcacaattattaaatgcaagagattttttaaataaaaatagcttgttactctcaaacccatttttattatgtgcaaggaagcatgaacttcaatattaaaaaggaaaacattaaaaattactgtaattggggatttattaaaattagcctgtgattttgtctcctgtagcttttaaaaagtacataaatggattggttcctaaaacagaaatgaaggggaaactcattgaggatgtatttcaggtgaattatttactgttttcatagaattttaggactagaggggacttttagtctcatatacagctgaggaaactgagcacagattgatttaatgacttaccccaaagtccctatccactgggcaaaacagctgagatatactcagtcagcctgataacctctgtgttcatctctaggtaaatctccatcacagcctccatagcacagactccaaactcatttgggaatccaaacttctcccctaattgtcagaaaataacctcacccttactccagggacaaggtctaggtcatttaggagagtgtcctccaatttcccttccccagtttattgattttaatctccatccacctcacccttactccagggacaaagtctaggtcatttagtacaatgtcttccaatttccctttcctaattgatcgattttaatctctatctttccttgcctttgtctttgaggtcctttctttttctgcccattctctcctgctctccctatcacaacacttctatgagaatcttcctgcagaacatctcttcttttaaatcaaaatctcctcctagcttctatcttaactttcaaaaatccttaggttaccctctctcaaaaaaaaatgctactgtcttgtccctctgttcccttttatcaccaatgtcttgaaaaagtgaccatctttatgtcctcctctcctcctctcatttcctaatcccttgctgtcaagcaagtgcatgttccatccagctaaaaatattctcttgaaggtccctcagaacctcaggatttcctcagaattcactctgctcaacttttttacctcatctctttcaaccccatctgtctttccgttttccttttcctctgacctccattataatgcattatattttcctattgtttctttcgccattccttctctctttcgccactccttctctccttccttttttttttttttttttttttctttttttgagacaaagtcttgctctgtccccaggagtgcagtggtgcaatctcggctcactgcaacctccgcctcctgggttccattgattctcctgcctcagcctcccaagtagctgggactacaggcacgcaccacgacgcccagctaatttttgtatttttagtggagacggggtttcaccatgttggccaggatgttctcagtctcctgacctcgtgatccacccgcctcggcctcccaaagtgctgggattacaggcgtgagccacagcgcccggccctctccttccttttttttttttttgtttgtttgttgtcgttgttcctagttctataaatgtaggaactcttctagttttatcctcaattgcaggctgattcttgactgtatcctctactttggaaatttcaaattctcacgatttcaactatcctgcctgagcagatctacctcaaatctacatatccagcttgaacttttgctcaagttttgatccatgtttccaattgctgatcatcttcacccaggcattatctggcatctcaaactcaatgtgttctaatctgctaaattctattactgtcttgttcccaatcccacagtttaaaactgccatcccctgagcttcctccctctctcgaacacccccatcccatttgttctcaagccctgccaatgctatgctgcagtatcccttgatctttccccatccattccctctgtctctgctccagcgtacctccttctcacctccagtctgctttgatacagagaccctcaactgctcaccgtctgtaatcactgcctcttcccactagtcctaccaactgttgtcagagttagctttaaaaccacaattttatcatgctcttctcacatctaaatacttcaatattttcctactgcacacaggcatttaatattacagctggaaagttacctgtataaaatttagtctactcttgtcattttacaagtgagaaaactaaagttcagagaattggggaaatacgttgaagattttccaactctatcaagagtcagatttcactattttgcctttgaaagtccaagagtgactttgtatcagagtttattctagactctgagcaacagaaaataagcttacaccaacccaccacatttttaagcagacttggcggtttttagattacaaatccaattgagagtttgactgtatggtgaaagctacttggtcttctgcccaaattgtctctcatgggaaaaagaatgacccagcttcataaagctggaaagatttcttagtcatctgcatagctttccaaaacaaacagcaagcactggcgctccaatgcagtaagggaagcgcaataacagataacagatccatgcacaattctgtagctatgaagaaatggctttcaaacacacaaataaggtatgcccatctcccatcccacactcacaaacaagagagagggaaaagtgttcataaattcacaggcagcaaggagcatgcatttacatgaacaccatttcatcatttcagttctgcacccaagatgggctctacagataacatttcagttacatgttttaaaatttgggccatttacttttcttttttttttcttcatgctgtattcctattgtcgtatgtaaatatcaccaatcacaaggataataggttagtttaaaatcagaattttttgagttcttgaagttgcaatataaattctttgtagcatgcttttcttagtagtaatttacttgagggaataggctatctcatattttattgtaaaacccacagctcaagtgaaaatttatgctaaattgtattgaattatatttagccataggttaatatccaagactcaatttcctcatctgtaaaatggagatagtattagtggtgaccacatgtatttgttgtaaagattaagtgcatagatttacataaatacataacctaatacctagctattatttaacaaattataagagtaataacaatcataattattaatattagatacacaatggatatgtaattctcataataaaaacattatctttttatacttctcatattgatcataaatacttattttctgaattatctattgtggcaatttttttaaagtagatacttagagacattaagttcatattttctttaatgctacaattaaaattaactataaaaagaacttttttatatttttaaattactactgttagtatttttaaatgtaaactataattttcttatatcagttatacaaataaagttttcatactttgcaattctgaataaattcaattaaaagttaaaaatttcttatttagggagaaatacaagtacaaaataatagtaataaaaagaagagtaaattgaaaggtaaaaacaaaaattcttagcatcatcatcagacccaagacataaaccaaatccacctgctatttggctgataaaataattttaatgactcacaagcctatggtttcatgttgtttttaaagtaactggataatataaattttaaagcatttaattaaaaaataactagtgtgattatcttattttttacaggtggtggtagaagttaacagtgaattccgaatccaggtaatatataacaaatccatttttccaaatttttaaacaagaaaataatttgagaataacaatatgttttctgaagaaaatgtattctcataagtcaagttcatataatgctaaaattaatagattaccaaaattaccaattttcccaattaaacatcctctatttctgagattataacctcttccaaaaatctcagtggaatttgaattacgaattcaaattaatatataccatttctttattgctgtcatttaaggtaagagattataacactaaaaatggcaccatcaaatggcattcaatccgaaggcagaaacgtgaatggatcaagttcgcagcagcctgtcgtgaaggtgaagacaactcaaagaggaacccaatcgccaaagtaggtatcaactccaaagcataacattgaaaatcagaatggataaagtttcaaaagaaactgtctgctaaatatttcatgaacatgtctcaccgagaagctacgatacagaacagaactatagtcacctagatgatgaaaactgaaactcataaggagaaattaagaaatgcaggtgctcagagaaacaggcaaacgttgactcacctcattggtgaaatgcatacacatgatcatgtgttatcccaaactccagatgaaaaaagatcattattttaataaagaatttggctttcagcacattcaaaggaattacttcaatgtgtgctctttttgcctcacaatgtattagaattgaattcctacttttttgtttgtttattaacattcacaaggtgccctctctcataccccttttctattcatttttccatatcttcctttctacatacacacacactcagaaacaccccccacaaattcatgaacatacagatgtacacgtccacagatacacacacgaatatacacattcatccacacagacactcacaaatactccccactaggatttgtttacagccaaacaatattttatttcaaagaaagagttctggtttctataaccatttattcgcgtggtctccttccttttctgctaatacacccttcccattttcagaattcagagcttccactcaaacccagataactcttgtcacctaaataaatctactttcttcgaaaactttacatttaaaacaaattgaagattaaagttgcatgatgacaacattgataaactccttaagagggcaaagagtttccttctgtagctccagtgcaagcacagaccctgcaaataatacaagatcaaattttaactgttgaatgaatgaagtcatgcatgatgattgcatagacttagatatagtagggtgatatttcgcattttttcatgtttcatagaagcagaaaccgaatttctttgattacattgtcagttaccattgaaaatattagagctgtaattgttactcttatctaggaaaataatctccattgacaacatttcctaaataacaaggtcatcacatgcaacaactctcaagaaagctgtcgtatatcaaatatagaactctatttgctccctctaatatttttacttgtgttccttctgcagattcactcagattgtgctgcaaaccagcaagttacataccgcatctctggagtaggaattgatcagccaccatatgggatctttgtcattaatcagaaaactggtgaaattaatataacatccatagttgatcgagaggtcactcctttcttcattgtaagtggacttcatgtcaatatatatgttcatgcttaaattcttctcagaagttcttaatctcagatcatacttaatttgatttcaagagtctcaatatttggcatttttggttgtttcttaattcacgagcatcccacgactgaaaagaaatgcaaagattaagagagaaggaaatgtttcacttaagtgtcagcaaaaatgctaacctctatactgtcctcattggcaaactagagtatttgtttggaaggacaattacctaactttttaatttttccttttttaaaaaattcagtaaagaatgttaccttattttaagtctaatgtcaagtaatgattctagagctactgcaggactgttttctgagcaaatatactttattataaattcagtaaagaatgttaccttattttaggtctaatgacaagtaaatgattctagagctactgcaggactgttttctgagcaaatatactttactataaattcatattcctcaagctcacctgagctccaaatgcaccttgaaaatgcatccattcttaagtgaatctcactccattctttacaggagctgtcacatagcttaagtatcctatctcttcaaaccctcaacctcatttccactttaagcagttgaccttgtgaccaactttatgaaaaaggctgaggccatccatcacaaactcccataattatttctcactcgcccagctcagaaatgttcttcattaaatcaaaagcaggatcaattgtttgctttttctcacagcatattccaagacatttccatggtcctataattgccacttacttggagaatcattccatcacctctgttttctgtctcccttctgctggctccttggctactcccatttctctctatcgtcatggccaacacttcttaatattaaaaatagaaataaagaaaccctattttgctcctgttacctcttctattaaaaccccaccagtccgtatcccaaaataccttcaaataataatcgatatttgcagttttcactcacaccgcctgcctgtattcctcacacaactttaattctttagccttcaattccaaatctctatttctcccttctgtcccacaatgatcccccacaaactttaaaaaggcatgctaccctgttagcttttcttggggcataatgcatttttttacgtctttatttttttttagagacagggtctcattatattgcccaggctagtatcataatgcctttatatatgaaatatgccattttgtaaaatagtacacattacacttagggacgcttcaaatacaaataataatagtaataataataatcataataataatataaacccccatgtagctactacctagcttaagaatgccacatttgctttcccttagtgactgtaagtagggcttgtgcctatgttctaagtagacataataattcttttaattcgccacagtgctagcataatgctcaaagtaagaacttaataaatctgtgtttcactgtataattatttatcttttctctcccagatctactgccgagctctgaactcaatgggccaagatttagagaggcctctagagctcagagtcagggttttggatataaatgacaaccctccagtgttttcaatggctacatttgcaggacaaatagaagaaaattctaatgcaagtaagtaatgtagtggcttccaaatcactcctaacagccaggcacctaactggagactaaactatgtcaaagtacacatcatgaatgtaagagataaactatagaaaagatgcagaatagcaagtctttcctttcaactacggaagcagctccaaactgagggacacaaggcgtgattccaaagcaatgaggaggatttttctcacataactcgcaggccagccctgtagaagagtcctaacaagaaattttaaaggcattttgcacaatggtggcagaggcatcgggatgtgaatttagcctcccagtctaactgtgtagaaggacaatcccacccttttctgctcttactgcgttttttccccttttttaaagttagctactttaaaatcacttatagaaatcacttccacacaaaacttctttttgtgatttaacctttaagtgataaaatttcttgtgaattccaaaaatccctacactttacttttattcattaaaatactgtacctatactttcaacttttaaaagtgttattataaaatgctcattaaatttatgtaatatggaaagtaaaagggaacaaaaatctgctgtctgcatttcctagtaccattcttcagaggtatgcactgtgtacatgcgctccataattatgtaaacataaatcacatgttttttaacataaatggtatcatctgttacatgctaatccacaacatgaatttttatataaatatattttgaacatatttccatatcaggacacataattgtttcactgctttcaatagttgcatggaatttaattatataaattacataagtgtatataaatgttaattatctagtgaaaacattttaaaggttatgctacaataaatacaggtgggggatgacagatgccatgaagcatttgtaggaaaattgtatttaaaatggagttggagagtagagaacaattccaaagttatgaatgagcactggcagttttccacattctccaataatctaataatcttcatcaaaactacttataaaattaatgaaaagataagagacaggacaatatgtgtagttaagcaagcatttctttagatctactaattaccttgcacttgacgaaggatcacccaaaacaaaacagtagtaatgtatatttatcaaacgtgcattattcattaggaactttatatagttttctcttattaatgatttaattctcacatgaattcagtaaggatggcagtaatatcatccccatttatagatataaaaattgaggccaagatcatatagctagaaagtgttgagaaagttgggaaaatgttggtctggccttattatcattttgtttcgccacagcatcctttaaaaaagaagaaaatatgctagaagaagaaatagaaagccagaataacacatttcctttgtttcccagttatcaacaatgtctagattcctagtaaaatgtgatcttcttgttaggcaaagatatagaaaagagctaagatatccatatgttgaaggagtagaaagggaagacagtgaagtccacatcataaggatcaactaactctaacacttttttggaaaggtgatatactctactgtaacaaaaatgtaaatcacccatttgcaatcaattttccttaatttctagatacactggtgatgatactcaatgctactgacgcagatgaaccgaacaatttgaactcaaaaatagccttcaagattataagacaagaaccttcagattcaccaatgtttattatcaacagaaatactggagaaattcgaacgatgaataattttctagacagagaggtaattctttttctttaagtgggtttttggtctcaaaggaactgattctaaaagcaaggatactgaagagacaaagagatgaagaaaatgatggtttaaatttttacttgtataactttttcacataattctttcatgtaagaaatattttttaaatgaaaaagggaggatttttcaattacgttttgtactatttttcatataattaattgattaaaatttacttcaatttaagaaaactatattgtgaaagtacatgaaaatatgcctaaggtagaatctaaggtagaatcaaaagctccatttctctaaaaagtgtgttctataataaaatgaatttaggaatgacttgctatatgtccacgttttggtgagttacagtgcatgcgagtatgctggaggctccaggaatattgatacactaagttctctttctttaacctagcatatctaagctccattgacaacagaattcttgtttttcctatgtaacatctattgatagctcacccattcatttactttgggaaatgaaccacaggataagaatgatggataggaattaaatgacagactgaccaatctttttatttacaaataagaaaataactagtgatgttaacagagtaaaatcagcattatgaggtttctagcatgccttgtgattttatgatttagttttaaaataagtgctttttcattatttaaaaaaaattgtcttttaatagaatgttgcaacctaaatgtacattaggagcataagtgaggaagctttattttctgatggtattcaattaattttgttttaattattaaaaatgacaatcttcttgctgatgacttttaggtttaggataattcatattattttaatactctttaattatctaaatgttacaagtttctatgttacctaagtctccttttatacatgtttgaaaatcaacattagaagaaattgaatgtttacacttttctctctcaaactgtcttaaacagcccaatgaggtttctttcatgtcaaaagagctttcgtggtaaagcactgtaagaaagggctgtcagaaggaaagggactctgcagccattgggaagccaccagggcagatattctcaacctggggtcaatggagagacctcaagatgtctctataaaaccccctaaattatatccaccattttgaatgagtgtgcatttttgcatgagtcaaggaaagcctccatagattttaccagcttctagaaatataagcaccattgaatagagtcaagaatagatacatcaccaataattccactgccataacccactacctctcaaaacacaaagctttgttatctgtttatatgcttcttgcacactcgggggctgattatttaggttatggaatattcatgccataaatttttggtaaacttaatctctctccttgagatcattctggtttgttttaccctttataaactttttcaacctctggacatattattattaataagaaatgaagccttttaaaacgtgttgcatcttttaaataatgcgtgataagtattattgggaataatcatgtgaaacttgtggatttcccatattctgtgttaaccctacctctatcatagatttatgtaaacgttgagccaacttttcaaagaactttacataagacaaagtaaaggctgtctacgtcaagtgtgatattgcctgtaatatgtatttttagcaatacggccagtatgctcttgctgtaagaggctctgaccgagatggcggggcagatggcatgtcagcggaatgtgagtgcaacattaaaatcctcgatgtcaatgataatatcccttacatggaacagtcttcagtaagtatttgttcttggaattaataaatctaaattcgctatattctaaaacatatacgaacaattctgcttacagaggcacatgttatgtttattgacatacaacccaaatgtagacacatacttttttcttgtgtttatgcaagaataaatggagttaagcaatgaaaaatgagatgaaaaccacagatatcttttctaaataatgaagttatcaacattccagtataagcctactgtagttctctctctttcacacagtttgtgctaagagttttcacttcttgtttcagtataccatagaaattcaagaaaatactctaaattcaaatttgctcgagattagagtaattgatttggatgaagagttctcagctaactggatggcagtaattttctttatctctggaaatgaaggaaattggtttgagatagaaatgaatgaaagaacaaatgtgggaattttaaaggttgttaaggtatggtataattatcctaaatattttgttttcttaatcttttttcaaaatgttaaacttaaaataaaatgatgctaacatttcacaaacttggcttagtgaaagaataaaaattactgtgttttaaatatatatataacatagagctttttaatatagtctttctgcttataatcattttagaaaaacaggtattgaattttaactggagacagtttgtcaatacagtactcccaaatagatcatataaattgaaaacacttaaaaatatattttatgcttacaacaaagtataattaatccttaaggttaatgtcttaagaactttttaaagcatatttaatagaggctttaaaactgtgtccatgtcaacattgtaagtcaattattacacatgtagaatattcatcatgtaaataaaaatgtatttattcctcccgcgtgttttcataaaatttaagttaaattactataaatgtagaattatcacactcccatctcactgtggctgctgatcaaggcttattaggaacacagatatactggaaatttggtccaagtcaaccggtccagaacaactggatgccgttctcttatgtcctccccatattaatggtccacatttacctgcagtaaaatttcatctgagatgtgagaaaaaaaatttgcctcctagggagctgatagtcaaagtttcgccctgtgctacacaacttacacagtcgatttttaaaatctacaacagctgtttatggattgtatatgttgcatgcaatatatagtttcatggtaaaatataatccctatttaactatttcttttttcagactaggtctggaaaacagactctcaaacgactctgtccccatacgaatgtgtggctttttgcctcctgtgtcttcttaaagtgtcaccatgcctacagcttgtatttaatttgagacagtacgcaggtgctttagtttatccctcacagcatccctgcaaattaggttatattatttccatattgcagataaagacattgaggctccaagagagcacagaacctgcataagttctcatagctagtaagtagtgcagccaacatttaaacctagttttctctagatatgaagttcacattctttccatgatactatttaggattcaatactggggaaattggagtctaatctattttgccccaaactattatattactttagaaaattattcaacctatctgtcctcaatatctctatctgtaaaatgggaatgataattgtttgcccagacatatcatatattaaatcctttgttatagctatatacatatatatatattatgtgtgtgtaatgtatatatacttttgattttacatccattctttgaattgcaaataaaaccaatattagaacaaagattcaaaattttagctaaataggggagttcaatgcgtgaaattctatttttatctaaattactcttgtgaaattttagaaaaatatatttggtgtgtatgggcctaatggcataattgtttgtggattttatgtgttgtggatattaatatcatttttcataaagaaaatcactactttattattttatgaaataaatatttcctagaacatgttgaagaaaatagatttatttatattatatatatattacattatattatctgatttattcaaagagtcacacttacagatgtgaaatttcttgtaaatagttcttatggataaaaccactcaaatgattgaaactctagtatatttgacccatactgtgtaataaatagctactttctgaaaaacataaaatgattgaaggtaggataaattgtctttgcactaaaaaatacatacatttgactatctgtattattctaagtttttaatttgtttggtgaacaatcagagctcacgtcatatgttttcaactttttaacaatgaatctaggggaattgaattgtttcttactttatttgcacaaatttacatcaattaaagattaaaaatttaagaatggattgtgtatttgtgtgcatttgtgtttcataaaagaaagataataagttttttttgctattatcaaaggattttctttcacctggaacgttttattttcttataatgaaactattttactctgtattttctagcccttagattatgaagctatgcagagtctgcaactcagtattggtgtcagaaataaagctgaatttcatcattcaattatgtctcaatataaactgaaagcatctgcaatttctgtgactgtgttaaatgtaattgaaggcccagtgtttcgtccaggttcaaagacatatgttgtaactggtaatatgggatcaaatgataaagtgggagactttgtagctactgacctggacacaggtagaccttcaacgactgttaggtaagaatgagattttcaactaattttccttacatattgaacttaagtacatatgttctttttatagattataagtatctgagttaaaatacttttcattatttttgaaactatcatttaattgtaaaaagtactataaactgtgcatttaaaatgtttaacttaagaaaacataaaaattcatgcaagatgtaagatgttaaactgtaaagatgtgatatgtgaaaataatatgtctcaaaagtatcgacactcctgtatttctatgtcttattgatcaattagctgattaccacaggccgtgattcgtctctcagaagagtttaaggaatgattttccgatggcaaatctgctcagcttgaaatcaattagattttattagctcatttcaattatattcttcactttattcagcatttaatattggtcaataacgctggtgtgaaaattcggttatattaaggaaaactacaccatgtaattttttaaaactctatatatgcagatatttctaccaagtcacaaaaaaatctgtgcgtgcacatgtacctgtatttgcacatgtgactgtgacaagaagaatgggagaagcactttacccatgcattttttgttgtttgggggttttttgtttgtttgtttgttgtttgtttgttttttgagacagagtttcactctgtcacccaggctggagtgcagtggcacgatcccggttcactgccacctctgcctcccgggttcacgcgattctcctccctcagcctcccaagtagctgggattacaggcacctgctaccacgcccagctatttttgttttagtagagaaggggtttcaccatgttggccaggtcagtctcgaactccagagctcaggtgatccaccctcctcagcctcccaaagtgctgggattacaggcttaagccaccgcactcagcccacccatgtgttttataagttctttcttggtgttctcctcacatagtgtgagtagttctgttagaagtcctgtcacactgtaccatgttgctgatgagcgctcttgtaccccacaggagtgagttcactgaaggtagacgcaacccagagcttagcagaatgccagagagagagagagagaattacctaaccagtgtttgtttcacaaataatagatgagaagaaaaacaccgaagtcaaagatgagaaaagaatagaatagaggctcaaggcaaggccttagtttggaattcaaaagaggtcttgtcaagttccagtgcatgtgagaaggaggagcagaaacaggggggaagttcaggccaagctgatgaagtaacttctttgtaaaagaatagtttagaattaggagcagcctgggaaatcctaggatctgggtcttctgtaatagttctgctgctacttaaatcaaatgaaaatgagactgcaagcatcaaaggattattctgacatccaagtgggcataaaaagacattccatcagaaatgggtgctcagtaatttttttttcttaaatgtaaatcttgatatatccctgagtggctccatattgctaagactgccctgaaaaaaaataaagtctctagtaattgaaaactgtatctagggattataattactcactgaaaaaaacaatacattttaaattaaaatttctttttttagatagctgacattaatttgtatcattttctttcaaatacaggtatgtaatgggaaataatccagctgacctgctagctgttgattcaagaacaggcaaactcactttgaaaaataaagttaccaaggaacagtacaatatgctcggaggaaaataccaaggaacgattctctctatagatggtaagaaattaatttacatttttatcttttctagagaaagctgtatataccttaagatattaacattttaactatcacattttgaagtaacccctttccaacaaaagttgtcacactgggcattatagactcatatctttaacaacttgaggcagtataatttagtagctaagaccatgagtcctgaaatgagactagatttgtgtcttccaccatcacttactagctatagaatcttagagaagttatttaatccatctatagctgttgtctcttttttaaaatggaacaataacaatatatgtttagaaggatgtgatgataatgataaaaatagcaacaaaaacaaaacaacaggattagcatagttgagctgaaaggacatgggctttgatatcatatagactagatttaaacatatttctgttatatacttccagaatgtttttattcatttatttagaaagtgtataattgagtcctaactaaatgtcagccattgtgccagattctagggttacatcgattaataaagtcagacaactgagctcacatctatgtaataaagattacaaaaataacctcaaacaaattattcccatatttttgctgaataattccactttcaataatattaggaaaagtttaaatataacaagatgaatgcacaagatgttaattacagcactaataattaaatattgaaaaccacatcaataataggcaacagggtaagtaaaccatggtccatttgatataaaattatataaccatcaggaactatgttaatacaaagtttattaaaatacaaaagaatacttatagtttaaagtaaaaaaaatggaatgaaccatatgatcacatcaatgtaacataaataataagcaaccattcggcattataattaaggacaaaagatcatttttaaaaatatcagcaggtgtcgtccttgggtgctgctaccatgaatttggtttctggttttgttttgcttctttctgtaattctatacttttcaaattatatataatatccaactattggtaatgtaaagaaataatccaataaatagtattactatgactaataatgttagttataaataataatataataatttaactgatttttaaaaccgagtcaaaaacaagggatgattttcaagttaggagaaattatgggaataaagacactgaaataaatgttaatgtaaaaaataattctgtgttgtccaaccattcctacactaaatgtctaaaatatttcttccattttgaacgttattacagataatcttcaaagaacttgcactggtacaattaatattaacattcaaagttttggtaatgacgacaggactaatacagagccgaacactaaaattactaccaatactggcagacaagaaagtacttcttccactaactatgataccagcacaacttctactgactctagccaagtatattcttctgaacccggaaacggagccaaagatttgttatcagacaatgtacattttggtcctgctggcattggactcctcatcatgggattcttggtcttaggatgtaagtactttagcaatcctatgtatatgtgtcccccaaaaaatgctgggggaggagttaagttttctgattctttgataaaacgtattttacaaattctcattttgtgcaattataaagaaacttctgtgtttggcactgggtttataagatgaaaaaattaaactttttgaccccttctaagactgtggaggataaaaatttatttgcagtaagtctcaatgtaatgggaaagtgccataacaagcaggctcaaattgctatttcagtgaagaagacaatcagaagaggctacagagggcggggtgtggtggctcatgcctgtaatcccagaactttgagaggccaaggctggcagatcacttgaggtcagaagttcaagaccagcctggccaatatggtgaagcccacgtctctactaaaaatacaaaaatgatccgggcatggtggtaggtgcctctaatcccagctactaaagaggccgaggcaggagaagtgcttgaacccaggaggcgggggttcagtctcaaaaaaaaaaaaaagaaaagaaaaggctacagagaaagagtaaactctgagttgcattttaaaagatgaataagaattagcctgatggacaagagaaagggaacacaatacaaggggaaaaaaatctatgtgcaaaaacctaaaagaatgagagtgcaaagtactgcgatgaagaactccagtgtgcaagaaataaaagatgcgcatgacagcatggtgaaagtttagactaaaagataggcaggggccaggtctcaaagagattttatttatactaacactgcatagtattaataaaaggatagtcaaatagaccgagggttaaactctggtttctaagcctaatcgtctgagtcttccgaaggtcacctaacctttctgagccttgcttttgccatgtatgaaataatacttaccttaaaacagtgctttgatgatgaaaaagaagtaccacacatgaagcatttagcatgttctatggccactagggtagcactagtcaagggtctagctataaaggtagaatccagtggactctccaggtggctgttaacattacctcgaatgatgatagaaattagagcaagataaaccacatggcacagtcttcgggaaatgagaacaggagctctaaagtaagtaggttgcagtctgcacattacaattaaattaatgcaaacattgtcattttcaaatgtggaatcataaaatcttaatgtcagaaggtacctcagatatttaaatcaaacgctcacacaaaatgtgaagtcagagcgcttatgtataaaatatcttttctactttcatttttcttggcacgtgaacagtggcagatatgttttgctacatttatttgtgaactgggttttctctgattttaaataactcatgtttttgaagttttcatcaacattgggctcatctaaacaacgagtctggccatggtgataacacagcttagagctggagttctttttccaaaatttaaaacgtatttccaaaaaatgaaatttttacattaacaaataagagtttattcttactggctcataattaattgaagtaataaccaggaaaagttctatgaaacagagaaaagggaaagagagaaagaaaaaagcattctcatcaaaatgaaccaagacaagataaaggcaaaaatgctagtgaagttgcagaatataacataaaatacatatgaaaagagttcattctctctgttatttattaccaactaacattgtaaaatgtttaaatttaatacttcataagagtaacgtaattacccaagtgctcattatcactactgtaaataatacctaactttcatgttgagttttgtttgtttgttttctgggttttttttgttcttttgtttttttgtttttttgtttttttttgagatggagtctcactctcacccaggctggagtacagtggtgcaatctcgtctcactgtaacctttgcctcccaggttcaagcgattctcctgcctcagcctcctgagtagctgggactacccatgtgcaccaccacacccggctaatttttgtatttttagtaaagatggggtttcaccatattggccaggatgatctcgatctcctgacctcgtgatccacccgctttggcctctcaaagtgctggaattacaggcgtgagccaccgcgcccgtcctgagttgtttttttacattgcggactacctctgggtactgtagtaaataaaagatttataaattatatatgggccttagtcatcactacctgtagacccaaagtttcctctagtagattttcagaaaaccaatacatgggcttcttttcctctttttttcttttttcttctctccctctctcccttatgtctatccttactaccttccttcttccctaatttacttccttcttttttcctttcctccttcttcacaattttaatttacacattctttctttcatccatttattcaaaaccatttaccaagattagattatataagaggctgataataaatagataaataagaaaactccacttaacagcaaaagacagtgctaagcagtgtgatgttttctatttgtataagagttattgaaagaaaagacacttgcatagggggaaatagcctcacagagaattgttggaagcatgaataagattttactgttgaaataaaggcaagcatatgttaaaggaagacaataaagacatggaggagagaacacaaaggatcaaatatattgcctgaccttttcatctttccttgttctctcctttaatattttcctaaataatgacatggaaagattaatcggttttaataatgtaatactatctgtgatttttttttttttttttttgagagagggtctcactctgtcactcaggctggagtgcagtggcacaaccaccgcccacctccctggttgagcagcctcaacctccctggctcaagccatcctcccacctcagcctccagagtagctaagactgcaggcaaaagcccccatacacgcctaatttttgtattttttggtagagatagggtttcaccatgttgctcaggcttgtctcaagctcctgggctctagtgatccacccacttccacctcccaaagtgctggaattacaggtgtgagccaccatgccaggcccactatttgtaatttttaatactataaaataaactaaaattgactgcagtctaatatacagaagctcccatttactttggggtctgaccatcattcagcttgtattctgaaactttcataattttagaaccaaccagaattatattacgaattcaaatttaaccataaaaaatcaggttgttttgttttttatttgcacccagtgctaactctagtattactatccctccaccaccagtggtcccatttttgatgatctgttgtgattgtggaggtgctcctcgtagtgcagctggctttgagcctgttcccgaatgttcagatggagcaattcattcatgggcagtagaaggaccacagcctgaacccagggtaagtgccacattctaagaaatagccgttggtagtcactgaaattcagtctttacacatgaaccaagatggccgccatcactcacagtctatgctgttttttgtgctgagaaagctaatggagaaaatgaagaggaatcagaaacacaacaaaattagatggaagtaaccagggaagattttctaagtgaagttcaaattttaaatggatttcagaatttcctaaatagtattttttttttaggaaatctgaggtaatttaagaataaaccaaatgtatgactgcagaaagattatagtcattggtcactacaaatggaaatgttgtttcctgtcttttaggatataaccactgtcataccacaaataccacctgataacgcaaatataattgaatgcattgacaactcaggtaagaaaaaagaatttgtttaacatctcaaatgcttaagtaggaagtctattttctctctttgattattgttttttaattatcttatttttcttcaaaagtgtttatatcattcttttttaaatgactaacttgtaaattaaatggcaaggaaaaacctatggtaattattattgttatatgcttcattttaaaaattttcctcaaccatcaaagagtacttagaagatgtccaaattaggatctctatatatgcagaagtactgaattgtaaccatgagtaagttttagtcaagatttttaatttaatagagcaaatttcattaacatacatacacacacatatttcatacacatatatacactaattaaaattaaagtacaacccaactaaaatagagccgtgctcatttattgaggctaaaatctttatacacaattaatttaaggattcaaaattgctttgactttagctgcttattataacaaagaaaaaaactgcatccattttcagtatcatcacaaatattacctaaaaaatatttgtccaatttctttaattgaaagcaagtagatgaaacactatcaaaatctttctaagctctcaactgagattgtgtgcacatggtggagttttttccagcacgtgggtaagactgtataaatacaacttgccttaaaacaggaatctagaccagttcacaggcagaacccagggaataattagaatttcacagtgagtggataactaccattataataaaagaacaattaaaataacatctcatatctgtgaaaatagttgtatcacattacttttctcaaggtaaataaatactattggttagcttatttttctcatagtctttttaaacagtaaccattgttttctactttaaactaacaggcatagaaatgtgtataacttgtagaactggaccttattcaaagaactcgacacagtagtctttaaatctatttctccacctgatttgtccattttcattaataaccccaatgtcttctcacctcaaaagcagaatctcattgttgactcgtcgtattcactgacaccaaatcagttctcaagacatttatcaaatcatcaaatccatcagtatttatttacacatttgttcccattaaatctacaaacttttgcacaaattttgaacaaagcaccataagaggcaccaaggaaaactgaagcatgaaaaacagactgttcccaaactcaagatccttcacatactaaagccagtggatacatatcccactgacaacattcttcattccacagcagttccacggtcccggccatcattttatctcacctacctcaaatatttcttttttttttaatttaaaaaagatgaaacacttgaccaatttgcgtatcatcctgtgcaggggcaatcctaatgttctctatatagttctaattttagtatacgtgctactgaagcgagtacctacctcaaatatagtaacaggcttccacttactcctcacatccaagtgcaaacccaagattcttcatgaaaacctttctcctcacatagccatggcctcctctctgaaagccagtggttctcatgtctttttctggatgtcctgtgcttctagttatacactggggcttctagttatacactgtttttttaactttcagaatttgagtattttttctccaatttcctacaggttgaaatcaaatgctttaggacatagattttttttaagtcctctgcagccttcacttccagcagagaatatagtaatctctcaacagataattatcaaattaacaaattaataatattattttgagttcaatattgtatttatatctcctttctttatgtattatctttttatttctttgttcacaaatgcatacctaaatgaaaaaatcacatattacaaggcaagttgttactttttagtttatgatagactaaagaaaataaatttaatttgatcaacacttttaggagtttatacaaatgagtatggtggcagagaaatgcaagatctgggaggaggagagagaatgacaggatttgaactaacagagggagttaaaacttcaggaatgcctgagatatgtcaagaatactctggaacattaagaagaaattctatgagggaatgtagagaaggaggtctgaatatgaatttcatggaaagctacttctgtcaggtaaggtccctagccacatgcctttctcgccatccatgtgcctgctgctcttcaccaagctttcactaattcctaaaggggctttggcaggagtctcctaactagattctcagcctttagtttttgtgcccaacaatccatgctgttaatgaattatatatctaaagctctgacctgagcactttactccccaacgtaagaacagccaatggctcccagctctcttttgttcatggcatgcaatccaaagtccttaacatgttaactaagattgttcacaaaatgaaccctccctcttatctccaattactccttgccatcaactccacttgctgagcacctttgccacacacctttcacctccatgtgtttgcttatcctgtgcccctcctggaatgcttgcatcccactatgtctctcacaaactcctacccatccttcaagacccagtccaaatatcactctccctccgaagtttttacagttaaccctctcatccaaaataggattaatgttttctcatctgtatttctgcagtactttgtttacacatttatagaacctatcattgctaaaatctgtccgtttatatgtctaccaccacttttagtgtctcatccatatattctctacgttgtattgccagtacatagctcagttctagacatagaggcaatagttaatgagagtggggtcaagagccatagtctacttccaaaacattgtaagaacgagctgtaggtggtgggaagagcatgaagcctggagaagcagctgcaggagaatttaactttgccatccccaggaagagatgcaattgtccatggttacacatcatgtgatacccaatcttaaggaagttcctgtccctgacatcgactagaaaaacatttctgtccttctacattctggcctaaagtggtttcattaactaacctagtggttggtttaaagagtggctgatatttttaaataaaatattggtaaaagcattcaaatagcaatagatagtaatgaggcttgttgaaaaccataggaatacttattcatatatacaacaaaatattttgttatattttaataacatagaaatatcttccttccaatctctgatcaaatatcactttatcagagaccccttccttgattaccctatctaaaagaacagcacccatcactttctttttctttaccctgcatctgccacctcctgaccatatgcttctgtgttgtctgtctcactcacccaaaatgtaagctctgtgagagaacagctgtatctggtattgttcattatgcatagctaagttccaaacacagagggtctggcaaatagcaaaggctcaatcatttttttatatgaatggcacaatgagttggtttcctataaggtatttctgttaacctgaaagtttacaatccactattacgaacaacaaagatgaaacgaaagtgtatatgtctttgggcttttactttgaatttagagagattatattttttaaaagtgtctttgatcacctttaattttgtagaacagacccagagtcaaattttcctgttgctgtgctgaaaaagtcatgttgcaataaaccttcacagaatcatcatattcactccatctgaaggaaagaaacaaaatcctgagtgaacccaactcaactatgaactacttttccagacaaaaaacaaaacaacacatttttatgtccttcaagctcagtatttttatatacctccctctaactttgttataaataattcatgtgatttttttttattattatactttaagttttagggtacatgtgcacattgtgcaggttagttacatatgtatacatgtgccatgctggtgcgctgcacccactaactcgtcatctagcattaggtatatctcccgatgctatcccgcccccctccccccaccccacaacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacatgaactcatcattttttatggctgcatagtattccatggcgtatatgtgccacattttcttaatccagtctaccatagatggacatttgggttggttccaagtctttgctattgtgaataatgccgcaataaacatacgtgtgcatgtgtctttatagcagcatgatttattctcctttgggtatatacccagtaataggatggctgggtcaaatggtatttctagttctagatccctgaggaattgccacactgacttccaccatggttgaactagtttacagtccccccaacagtgtaaaagtgttcctatttctccacgtcctccccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggttgtttttttcttgtaaatttgtttgagttcattgtagattctggatattagccctttgtcagatgagtaggttgcaaaaattttctcccattttgtaggttgcctgttcactctgatggtagtttcttttgctgtgcataagctctttagtttaattagatcccatttgtcaattttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcacctttctacatatggctagccagttttcccagcaccatttattaaatagggaatcctttccccattgcttgtttttctcaggtttgtcaaagatcagatagttgtagatatgcggtgttatttctgagggctctgttctgttccattgatctatatctctgttttggtaccagtaccatgctgttttggttactgtagccttatagtatagtttgaagtcaggtagtgtgatgcctccagctttgttcttttggcttaggattgacgtggcgatgcgggctccttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttgtctctctgtttgtctgttgttggtgtataagaatgcttgtgatttttatacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatactggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctatttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttgttgtgtctctgcctggctttggtatcagaatgatgctggcctcataaaatgagttagggaggattctctctttttctattgattggaatagtttcagaaggaatggtaccagttcctccttgtacctctggtagaattcggctgtgaatccatctggtcctggactctttttgattggtaagctattgattattgccacaatttcagctcctgttattggtctattcagagattcaacttctacctggtttagtcttgggagagtgtatgtgtccaagaatttatccatttcttctagattttctagtttatttgcgtagaggtgtttgtagtattctctgatggtagtttgtatttctgtgggatcagtggtgatatcccctttatcattttttattgcatctatttgattcttctctctttttttctttattagtcttgctagcagtctatcaattttgttgaccctttcaaaaaaccagttcctggattcattaattttttgaagggttttttgtgtctctatttccttcagttctgctctgatcttagttatttcttgccttctgctagcttttgaatgtgtttgctcttgcttttctagttcttttaattgtgatgttagggtgtcaatttgggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggttttaagtgagattcttaatcctgagttctagtttgattgcactgtggtctgagagatagtttgttataatttccgttcttttacatttgctgaggagagctttacttcccagtatgtggtcaattttggaataggtgtggtgtggtgctgaaaaaaatgtatattctgttgatttggggtggagagttctgtagatgtctattaggtccgcctggtgcagagctgagttcaattcctgggtatccttgttgactttctgtctcgttgatctgtctaatgttgacagtggggtgttaaagtctcccattattaatgtgtgggagtctaagtctctttgtaggtcactcaggatttgctttatgaatcttggtgctcctgtattgggtgcatatatatttaggatagttagctcttcttgttgaattgatccctttaccattatgtaatggccttctttgtctcttttgatctttgttggtttaaagtctgttttatcagagactaggattgcaacccctgcctttttttgttttccattggctgggtagatcttcctccacccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgctatgtgtgaatttgatcctgtcatgatgatgttagctggttattttgctcgttagttgatgcagtttcttcctagtctcgatggtctttacattttggcatgattttgcagcagctggtaccggttgttcctttccatgtttagtgcttccttcaggagctcttgtaaggcaggcctggtggtgacaaaatctctcagcatttgcttgtctgtaaaggattttatttctccttcacttatgaagcttagtttggctggatatgaaattctgggttgaaaattctttcctttaagaatgttgaatattggcccccactctcttctggcttgtagggtttctgctgagagatctgctgttagtctgatgggcttccctttgagggtaacccgacctttctctctggctgcccttaacattttttccttcatttcaactttggtgaatctgacaattatgtgtcttggagttgctcttctcgaggagtatctttgtggcattctctgtattttctgaatctgaacgttggcctgccttgctagattggggaagttctcctggataatatcctacagagtgttttccaacttggttccattctccccatcacttttaggtacaccaatcagacgtagatttggtcttttcacatagtcccatatttcttggaggctttgctcatttctttttattcttttttctctaaacttcccttctcgcttcatttcattcatttcatcttccattgctgataccctttcttccggttgatcacatcagctcctgaggcttctgcattcttcacgtagttctcgagccttggttttcagctccatcagctcctttaagcacttctctgtattggttattcttgttatacattcttctaaatttttttcaaagttttcaacttctttgcctttggtttgaatgtcctcccatagctcagagtaatttgatcgtctgaagccttcttctctcagcttgtcaaagtcattctccatccagctttgttccgttgctggtgaggaactgcgttcctttggaggaggagaggtgctctgctttttagagtttccagtttttctgttctgttttttccccatctttgtggttttatctacttttggtctttgatgatggtgatgtacagatgggtttttggtgtggatgtcctttctgtttgttagttttccttctaacagagaggaccctcagctgcaggtctgttggagtaccctgccgtgtgaggtgtcagtgtgcccctgctggggggtgcctcccagttaggctgctcgggggtcaggggtcagggacccacttgaggaggcagtctgcccgttctcagttctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcctgtctgctttgtttacctaatcaagcctgggcaatggcgggcgcccctcccccagcctcactgccgctttgcagtttgatctcagactgctgtgctagcaatcagcgagactccgtgggcgtaggaccctccgagccaggtgcaggatataatctcgtggtgcgccgttttttaagcccgtcggaaaagcgcagtattcgggtgggagtgacccgattttccaggtgccgtccgtcacccctttctttgactcagaaagggaactccctgaccccttgcgcttcccaagtgaggcaatgcctcgccctgcttcggctcacgcacagtggacgcacccactgacctgcacccactgtctggcactccctagtgagatgaacccggtacctcagatggaaatgcagaaatcacccgtcttctgcgtcgctcacgctgggagctgtagaccagagctgttcctattcggccatcttggctcctcctcgaaaccaattcatgtgatttttttgtgtatggttttatgtccaaagtacacaattataaataagtccatctaagtaaatttttaaaatcatagtattagaattatacttaaaatgatttctaaccaaattatttcaaataattataaaatgatttttagagcatctctagtatgttaaaatcttgttttatttcattcctctttggaaatgctctggaagaaaaactaatgataaaggctgttctattattgttaaatatgcattcataatttcattttctctttctcctataaattcagaaagcatatgcttacgcagatgaagatgaaggacgcccatctaatgactgtttgctcatatatgacatcgaaggtgtaggttcccctgctggctctgtgggttgttgtagcttcattggagaagacctggatgacagcttcttggataccctgggacctaaatttaagaagttggcagacatcagcctaggaaaagaatcatatccagaccttgatccttcttggccaccacaaagcactgaaccagtttgccttcctcaggaaacagagcccgttgttagtggacacccaccaatctccccacatttcggcactaccacagtaatttctgagagcacctatccctcgggacctggtgtactgcatcctaagcctattctcgatcctctgggctatggtaatgtcactgtgaccgagtcttacaccacctctgacactctgaagccctctgtgcacgttcacgataaccgaccagcatcaaacgtggtagtgacagagagagtggtcggcccaatctctggcgctgatttgcatggaatgttagagatgcctgacttgcgagatgggtcgaatgttatagtgacagaaagggtaatagcaccaagctctagtctacccacctctctgactatccatcatcctagagagtcttcaaatgtggtagtgacagaaagagtaatccaaccaacttccggcatgataggtagtctgagtatgcaccccgagttagccaatgcccacaatgtcattgtgacagagagggttgtttctggtgctggcgtaactggaattagtggcaccactgggatcagcggtggcataggcagcagtggcctggttggcaccagcatgggtgctgggagcggtgccctgagtggagctggcataagtggtggtggcattggcctgagcagcttgggagggacagccagcattggccacatgaggagttcctctgaccatcactttaaccaaaccattgggtccgcctcccctagcacagctcgaagtcgaatcacaaagtatagtaccgtgcaatatagcaagtagtcaggaccccagctcactttttcatagtcattgtggtttagatccaattcccaccactaaaaaaccaacaatgtgatttataacgcacaacttcgtgctcaggtcatctaggagcaaggtgagaaatcacaatgagaaaaataaatggaaacaccactgctaggggagagctctccttagcattcataaacttttctcttatattaggactaaggaactaaaacttgaggcagagtcttctttgtgcctgagtggcctgtagtccatctccagcatgtaactggccttacgatggcaattggcatcattctccttgctctgttttgcttttccatatagctcgagcaaaattcaaaaagaactaaatatgcaatatatgttcatatctatgggaaaaatctaaaatgtgtgccagatgccctgttggtttcacagataacataaataaaaattcaaccacagatttatacaagggttaaccattttttttaagtttgactacatagtcaagtccacaagccatcaagcactcctaccttaattattgcactagagaaaataaattccaaattaggaagtgtttcctaggaggaaaattccattagagagtggcaataggatgaggtttcttcagggtaaactagcaatgcctgagcctgaaccttaatgtggggcctcagttaaatctcctgtggagtcaaggattcttctgattctagtgtgtgtttagtgatagatgtagtcttgacgaatattgcttactggtgaggttgaggaatatcacactcgtctttccctttaccactgtggttttgacttaagaaagcaaaactcactaagtttacttctcgaattgaagcaagtgaggcctgacatggttgtcatcactagtggcaaatgaccttccaagtaagcagatgggaactgaattgtgttttcaggttttgtttttagtaggtgatattcattcgtatccagctctttattacatagctctgaagttaaaatgatttacataggccgagctgtggacaaaaaaaaaagaagcagcagcttgtagtatgcttaagctttggggaatttttttttaaggggatctaaaaaaatgtttttagaacatgtaaaatgtttaatggtgaaagttggaaaagaattcttctgtaaagtaataccatgctaattattcgcttttagtaagtaaagtagtggttgctttagcaaacctctgctgccattttgcaggaatcaaccaggaacctttagcagaattgacaatatggtgttgataagcatgaaataataatagaaacctattctgctagtttatctcaccctctaatttttctcactagcataaattttaaattcctgatttgatttgtcaataagatcttggcttatatatgctgatttataggtagtgtccaaattatatagtataacatatttttctagtttcaaaatttagtaatgtcctatttatgatatatcatttctgtgtgtttgctatgtagtattacccaattaaaaatctctaaaaagaattaaagcattctaagaaaaaggtaaatttactattgcatggtacagaaattttttctttcttaaatacaatgttactataagctcactaaaatgaaactctatatgacaaaataaaattagaaaaaaatttgccctggagttgtgaattatatacaacttttaaagaatttaccccaattactcaaatttcccaggaaattacaaagccaaagaatattcaacttcctccactggtcaaaagaggataggagtgaattactgaacctagagctattttgctctgtaacaacagataaggctaatattttaaaagccacagtatacatcttcttttaactctgtagaatatgtaaaattttgatagtctgtagtatgctaaatgcagaagtataaataaagtcattcaaagggagtcttttctttttctgacacttagggggccacattaaggatgggtaatctttccaggaataaagtcaaaaggtatttattaagacatacttgagtatgcctgggtccaggagttttaaggaatagaaataagtattaatgaattaattaagtaatttattaaagggaatggtagctgaccacaggaaacttgcttactgttttgataggaaatatcatcacaagcttttcttaagacatctgatatcttccagagatattttttaggttgtcttgcaaacaacaaaatcactgtctttaataactgttgctgtcaaaatccattggttgttaagatccccccaatttagttacatctgaactcctaaacactgttaaacgatgggaaaaacaagaaaaaacatggccatttgagtcattgagtcatctatctttctaggaagatactttctaaccaaacttttcttccaggattgcaaattgatgggaaaaacaagaaaaactgaagtattagtcacctatctttctgggaagatactttccaactaattttttcttccaggattgcacactgattttccatttagtcctaaattttaaaattcccttttcaagacatcaacgattttagtagttatttaaaggcatgtcatttttcaatgaagaagttttgggcagaacttcattcttcttcttagatgtttactctagatcatatacatcatgtcatagaccaagaagagatatggaaattattttataagtgaatactataattaggattcaagctgagtttcagatcaacttgctcttaacaaaaggaaaaagaaatagtaatttaatactatgtatgtatggtttgaaaacaaaccacaatgtttataaaatatctatctgactgtctaaagaggtaatctttaggagcaaaaatcagtgtattataaatactttaccatttaatatcaaccaaaataccatctcaagctaattttgacactgaattacagatatatctgctacatattatttacttctaagcatgttgtctgatgtaattgcatttgcactgaaaaattaaaagaaaaagtacatatttagggttatttatatatcttcatctagacatctgttctacatttgtgtataaagtttttagcatcataatttttattcaagaaaatgttctgacaaaat

SEQ ID NO: 617 - DNA, 8237 bp, Human
tttaaataataataacatagatggtgaattacaatttgcacttttggttttatttgcttaaagatagtgttttactgtctaggttttactgaaagaatacttaactaaacacttgagtcaaatcattccagtgtaacagtcctcacaaggaggaaggcagaagggcaaaagtgccaagctattgcctccagcccttctatttttattgattgactgattgattgattgagacagggcctcgttctgttacccatgctggagtacagtggtgcattcatggttcactgcaactttgaacttctgggctcaagtagtcttcccacctcagcctccaaagtaactaagaccacaggtgcatgccaccatgtttatttctttaattttttaaattttatttggacatgggggtctcactatgttttccaggcaggtctctaactcctagcctcaagcaatcttcctcctcagcctcccaaagtgctgggattacaggcatgagccatcatccctgctctctctagccctttttaaagtctctaatcccattcaggaggcctctgcattcatgacttaatcacctcctaaagggcccaccttttgatactatcacattggtgattaaattgcaacacttgaattttgagtgacattcagaccacagcattttggagaaaatgtcccctttcttctcttttttctcttcagtttctcctttctacagataccttgcacttcacttgcaaccttgttgaagtctctcctgtcttaaaagtttcttttcccaaaacaccagaactcattccttctgtctaactgtaactttgtacttgttaccaacctctacccatttctacccctgactccccagcctctggtaactcctaacgtactctttacttcgatgaggtcaacttttttagattccacatatgagtgaaatcacgtaatatagtccttctgttcttggcttatttcacttaacatagagccctccaggttcacccatgttgttgaaaatgacaggatttcatgcttttttatggcggaatagtattccatcatgtatatatatcacatactaattaccctgatttgatcaatacacaatgtataggtgtgttggaacatcatgctgtaccccataaatatgtacaattattacgtgtcaatttaaaaaacccaagaaaagtattttttcttagtgttgtttttttctaaagtgtatcccattttttcctttgttttcactttcaaaattcttgaaagactgttttaatctgcggcctttgttttcttgtttccaattcattcttttgaaatatggcttctacctttaacactctgctgtcctcttgaaggttattggtgccctactaaccataaaacacaataatgctctcttagattgtatcctggtgagcctttttgcaaaattttattctttgagaattctctttccatgttttcttttcttttctttttttgtggtcattttggcttataggaaatcgtactctccaaatgttctctatgtcttctatttcttctctgataatccctttactaaatcttcttgaggcatatgcttcagaatgcttaatttacatactcttaattccttcttaatttacacactgcctgtcggcaatgtcaacacccaataagaagggagacctattggtcagaacaggccagggaatagaagaatacataataaacagtctgcctagttcttctagggccccataatatgtcaaacatatatttttacttcttctcccagcccatttttagtatacctaaattactgtcagtgattctgcaggcaaacaatggttgagttgtatgacacaactttgtgaaagtatcctacccagtacctgatgatgcaaaactcttctatcttgattggttgtcaatctgaggagtttccaatcctggggaagccagaaaaacagcgatttatactcttaatgggtactttctgactgaattttatgagctcattctgaagaggctgacgattttactatctcatttttttcctttctccagaatgggttctgggtgggtcccctgggtggtggctctgctagtgaatctgacccgactggattcctccatgactcaaggcacagactctccaggtaagaacagagcaattgtttttttccagtgtgtatgcaagaattggcatgggggagtgatgcctttctttgtaagtccaggccacagaccagactggaagtggcttttggtttcaaagaacagtgttcttccctttggcagaaaggtacgccttgcctctttacatgggatggacttcatataccagagccacctattcaaggggtagggaggcaggaagagggaaacattgtgtcttgtttaggatccttattgtgtgtatcaacctcagtcagtgcctgggcgtgttgaaggccttggcttgggttcgagcctgctgggagaaacaacctgcagtaggctgggtcacagaggcaatctgtgattttttggtcaggacacggaaacaaatctcagttggggtatatgtggacaaatgaaactggaaacaaaggttgctccttctgtcatttattaagccactattatattgtcagaattgtactaaacagttttgagaagtaagagaagttgaatagaatacattgtccttgtcctccggctcaccaggtacaagttacttgtaactgttatttttctagcacaggtgacagaatatgcagccatgaagcaatgtgagatgaaagcacatattaatgagcagaaacaggatgtaatgtgctaagaacagaatcccctttgcatgttagtttcattaaatacaaaagaggaacaaacctggccaggagagatcattattcttagagaatagaaaccgccctgagtttataatgtccattaaacaatacaactgaaaaaaaaatcagcacagatgttaaatgatgatgaaaaattcagatttcccccctggtttagactactagaggaaatagagaagagtatacatgctgagaaattacaggctggaacttcatctgaaattagctactgagtgagggataagtggggttcacccaggaaggtcattcttatggctcagttcagagttggaggaggcttctgaacttagaaaggaaagtaaattacaacccaacattaatagcaattatctttcaagtcttgacttagatgcaatgtcttcaggacgtccttcctgacttacctacattattaactccatttgaatttcctttttattgtagttgttgttcttaagtgcataggattggtttaattttacccaatgagttcacagcacattgtaattattggcagtagtgcaagactctctcgtctcttctcttgcctccgttctcattctctcccctccctagagaatccattctaaacgtgtctggtatgtctctaagtatgagagtggcttttagaaatatgtagcattattgctctttatgtgtttttaaaatttaataaatgtcattctctgttgaatcccattctgtttcttttctcacttgacactgtgctttttgagcatactgaggtcaaaggcctcctcttagatccatgtggtctgacgtaatttaccaggcatgggttttcccagaggagggggctggttcatggttttggttttggttttccagaagattttgtgattcaggcaaaggctgactgttacttcaccaacgggacagaaaaggtgcagtttgtggtcagattcatctttaacttggaggagtatgtacgtttcgacagtgatgtggggatgtttgtggcattgaccaagctggggcagccagatgctgagcagtggaacagccggctggatctcttggagaggagcagacaggccgtggatggggtctgtagacacaactacaggctgggcgcacccttcactgtggggagaaaaggtgagctggaagctgaggtctggcggggctcaggaatgtcccccatgtgaacctggccatggctcttctttcttacaagcaattttctgctttaggataaatggttgtctgtgtagatgttctggccccagctgtgatatattatcctcacaagtcagccactgtgatcttggtctcagacccccaaggttctcagggacttcgagggctattgtaccctcaaagagaagcagtaattgtgggagtacctcagaaagtctaaatcctcctgacaggcattgacataccctgttactgatcttgggggctgagacttgcctatactttgtgttcacttgggtgatctgggaaagagattagacatagtgatagtccctaaagaatctcctgtcccagcttggtggttttctttcacggtgtctcatttttcctcccttcctagtgcaaccagaggtgacagtgtacccagagaggaccccactcctgcaccagcataatctgctgcactgctctgtgacaggcttctatccaggggatatcaagatcaagtggttcctgaatgggcaggaggagagagctggggtcatgtccactggccctatcaggaatggagactggacctttcagactgtggtgatgctagaaatgactcctgaacttggacatgtctacacctgccttgtcgatcactccagcctgctgagccctgtttctgtggagtggagtgagaattagtttctagtactctctgggcctgactcaggactatactgactcaatacagagcctgtgtcacttctgcgtttatcttggtcacaacatgaattattctttcccttgatctgggacagtcacagaaaccagagtccttgggttagggtgggagaaaacatggcagatatctatcctcatatcttccaagaaatgaggagatctaatcacctcattatgtgcttccaaccctatgaactggtgtcctctaattctttggtcttagtatttaggaggcattcttatgggctgtgagaatctgtaaccgatgggtggtaactccatgggtgccaactttggtttcgaagaaccttttctaaatttatttatttttctctagctagcattggatttggtgtctagtacagattctgggattccaagaaagtgctttaaatattgggatatttttactaatttaaagacctgtttcccataggagctcagtctgaatattcttggagaaagatgctgagtggcattgcagccttcctacttgggctaatcttccttctggtgggaatcgtcatccagctaagggctcagaaaggtaatgagcctgtgaggagtgccctgccacctgtcccagaccttccccactcccaccttccctaacgtcaatgatctgaggcaaggaaagctgattgtgcctctcagggatcaccgggataatttttttctgaagctagaaatgggataagcagagagagtgctgaccttgccagccatttgttcttccctcgggataatcatattgggtcctaattggggcaatccattcttttctcgatttctttccaggatatgtgaggacgcagatgtctggtaatgaggtaatgtctctttttccttgtctttgagtggcagatcattctcccggttctttggccagagggagatgacatgggggtagggaggagtaaggttgctgctgtctggatgggactgtcccctgagtctctggaacggctgtggggggtggtgaggctgcctcctgagaccttcatcactgtgcctccaggtctcaagagctgttctgctccctcagtcatgctaaggtcctcactgaagcttctctctctggagcctgaagtagtgatgagtagtctgggccctgggtgaggtaaaggacattcatgaggtcaatgttctgggaataactctcttccctgatccttggaggagcccgaactgattctggagctctgtgttctgagatcatgcatctcccacccatctgcccttctcccttctacgtgtacatcattaatccccattgccaagggcattgtccagaaactcccctgagaccttactccttccagccccaaatcatttacttttctgtggtccagccctactcctataagtcatgatctccaaagctttctgtcttccaactgcagtctccacagtcttcagaagacaaatgctcaggtagtcactgtttccttttcactgtttttaaaaaccttttattgtcaaataaaatggagatacaaaaaatgtacattttagtgaattatttaagaaaaacccctgtaatcaagtcaaggaacaggactttgccagctccagcagaagtctctgtacgtcaggccaatcaaagcctctccttcccctcgaaagtgaccatatcctgattttattgtaacctctttcatgtctttgtagtctagtcccccaggtatgtgttcctggacgccacagcttagttgtcttttacgtctcttatacttcactggtttctcccccatcagcctttttttcccccttatgattaatctgttgaaaagctcaatccatttgacctgtagagtttcccacactctggattttgctggctgcatacacatggtgcagtgtaacacatcctctgccttctgtgcctcccgcaaattggcatctggatgcagaggctggatcagactctggttcaatcttttcctttggaaaatctatacgtggtgttgtggcctttcaccatgagagacataatttccagctgtttctttttgtgatgttagcaaccattgatactaattgcttaggtttgttaatttattggggattgctaaatggtggtattctgtcattttttcttcattttatgctttattaatgctacaaagagacagttcccttcatttactagtgaagagacacttccctccacttactagtgggctacttagtggtacagtggaaaggcaggatcagtgtttgacccccgtctctactaaaaacacaaaaaattagccttgcgtggtggcgtgcgcctgtagtcccagctactccggaggctgaggcaggagaagcgcttgaacctgggaggcggaggttacagtgagccaagattgtgccactgcactgcggcctggtgacagagcaatactccatcttaaaaaaaaaatcagtcttctctatattacttctgcatctcctttcttttacaccaagaactctggttttcaaggacacagggacagacacaattagaatgtccatacttatttgcttttcctgagttaacatagacagcagtctaaggataataacactaatactacaaccaccaaaatggctactgaaaacggttgaaattctttttacctacattctccctattacctgtgttctccctttttacctatgttctcccccgctttctagttgaactatgtctatattagttgatcctgtatcattgcatagactacttactcccttgttagtcttagttctgtgagtagagatatgtttaatgctcaccatcattccttatgttgatatccctgtcatgtggtggttttcaaggtgtggtccatggatccctgggggtccctgggacccttcaaggggcctatgaagtcaagctatttttgtactaatactaagatgttatttgcctttttcactgtattatttacatagtggtacagaaatctatggtggtcacatgaaactgttagtgcctgagcacaaatcaaggtggtgacaccaagctgtacaggtaggtcatgttcttcactgccataagcttacagttaaaaaaaaaaaaaaaaaaaagcaaaagccagtgactttgatgaagcaataaaatcattagtttactaaattttaaacctcaagcacacatctgtttaatagtcagtgtaagaacataggcagcatttctggtgcatactgatggaaaggcagttgtcctgtggaaaagccattatgtaattgcatgagttgtgagtgaagttaaacattttttttttagtgggtcatcattttccttgaaagaatgactgaaaggcacactgtgattattcagacttgggtatttggtagaaattttctcaaaaataaacaaaatgagcctatcccatcaaagaaaataatattgacagtggaaattggaatttcaagagaaaattaaaattttggaaaacttacgtgtgccacagcttctcactacttaaagatgtttctgatgagattggtggtgatatt

SEQ ID NO: 618 - DNA, 40631 bp, Human
cccaaacctccatcagttttgactcttctctcgcacactactcagtcaacccattggcaaatccatcccactattaaaaacttagcaggcttctgtacctaatttgcttctagctttgtttttgggtccccagggaacaaacagtctccttcctctcccacaggatttcctttaggtagtcctagagactgtgactgtgtacttccatcacgtctcctttgctcactcttcaaggccccagctgctcactgttttggtcaccttgtctctactcgcttcactgtgtgtctttctctcctaacgcgtgagtctgtacttgaacatagcattggaggggtggtttcatgtaggtaggtagaatggagtaagtcccactgcttttgtaaaaactttcctgcctacttaaacctaagttttattatggaaaatgtcaagcatacaaaagtaaagagaacagaatagtgaactctctcaattatccctttccaggttcaacagttaccaactcatggccaattttggcatctacattgcctctggcccaactctgtgattattattaatttcttaatagactttattttttagcacagttttagtttcacaccaaaattgagtggaaggtacagagagttcccatatgtcccctgtccatgtgcccacagcttcctatcaacatccctcaccagagtggtacaatctttacaattgatgaacctacattgacacatcattgttatccaaagtccatagtctacattaggggttcacccttggtagtgtacattctatggatttggacaaacttataatgacatgtatctaccattatatcatacagaatagtttcactgccctaaaaatcctctgagctccacctatttatccttttctcccccaatcctcttaccccccatgtaactttttactgtctccttagatttgccttttccagaatgtcatagtgggaaacatacaagatgtccccttttcaggttggcttcttttacttagtaacatgtatgtaagtttcctccatgtctcttcatgactcatttctttttattgctgcataatattctactgtatggatgtcctacagtttatgtaaccattcatctcctgaaggacatctgggttgcttccaagttttgggaattatggtactattcttttaatatcgtccaatatagagttagatccagttttccatttttgggggtcatggtgagacatgaaacccaggtttaaaacatacataaacactcatgcacacaaatacacactccaaccattttcaagcagagatttatagagtttttaacggacataacctttttggagcctcgtatcagcccagcgccttaaatacggctgtttcttttgcagaatgagttcagattaggcgaggatatccatcaccatttttcagaccagctcgcagcctgggggcagtggttcaagcacaggctttggagccgaaatgactgcgcctgaagtactcttcttccacttccccgctgtgtgaccctgggcacgttacctagctcctctgagcctcactcttctcccccataacatagggcctataccaaagttcaagggctattgtcagtattcaggctactaactgaaggaatcaaaatctgaacctgggttcccccgactccaaaacccgtgctatattcaccacaaatgcgatcaacacacaaggcaccgggtcggacccaggcacatacgtggcgagaccgcagggagcagcgctcgctctgcgtcctcccttcctcccatatcccaggtctcacctgctccgggccccgaaggtctcaggatgctgtggctgcacgcggacgccagccgccctaaggtgaccgtcagggaagatgctgccatggccgccgccatcttcccgcagcctcggccggaaacggaaacgacgcgaaccgcgtgcgtaacgcacgggcccggcggggaacaccggtccgctgtaacaccggcccggcgcagaagcgggacgtcggcttctaggggcccaggccggcggcggcgatggcctcggcagctgtggagagcttcgtgaccaagcaactggacctgctggagctcgagagagacgcggaggtggaggagcgcaggtacgggaggccgccggcgccgctccctcgcggtcggtcccgccgtgtcccgggcagagtctccgaggggctcggcctcatagtctggggcgggaatttcgtctccgacccttcgagtcaggggcagggatcgtccgtcccctgcttggccacctcccgagttgtcagtctcatcacttcctgggcagcgcgttccgtttggggacccttaagaagcactttgatttcccgacccgagaccccccactaagcttacactcctgggccctggccccgaccccagttccacccgcagcgagttagcagccctttcccttattcattcagtaaacatggtttgcgcccattctcagtcaggccccggcagcatgagtcaggtgcactggctgcccccgatccggccagcggcgggctgggcataagcagagagtcccttcccctccagtgcgtccagggccggctgcgtgcgtgtcgcggggaaagagcctggaggaggaaggcccttccctggggagggtcatggtggcttcaaggagggagtggtgcctgaaggaaaattggagttaagctggtgggtgcggggtagggtggggagccgtcctgagaggtgtggggagccatgtgagagccgggcttgtttccgaatgggactatttacttgtccaaaacaatcagagctaacacttacgtactttccatgcgttaattcttttacacctcatcccatgccaaccctacagtgtaagtttcttttttttctttttcttttcttttttttttttagacagagtctctctctgtcgcccaggctggagtgcagtggcacgatctcggcttactgcagcttccatctcccgggttcaagcgattctcctgcctcagcctcctgagtggctgggactacaggcgcgccaccacgtcctgctaattttttgtatttttagtagagacagggtttcaccatgttggccaggatggtctcgatctcctgacctcgtggtctgcccgccttggcctcccaaagtgttgggattacaggcgtgagccaccgtgcccggccgcagtgtaggtttctgttactgtcattttccgtctaaggagatggagacagagaggggttaagtaacttgccccggggtgacacagtgtagcccgatttgctgtcaggcagtctgcttccagagtttgcagtcagccatatgtgggtaggatttgtctgagatgcttttgatcatggcaatggagagcttttgcagttatgttgagtttcttagaatcccagctgtttcatttatggctgtgtgactttgcaggttctgtctctgagccttacttacttcatctgtaaaactgggatgattcccacctcacaggcttgctctgagaatgaaacgatcccctgtcagtcaggtgctcagcgtggtgccaaggacagagtcagcccccatggcagtggctctttctgaggatgctgagcagactggcagggcgagcctgggaagggcctggctaaggagctagtcttctgttctgtgtatgaaggatgggccatcagcggggttaagcaggtgagggaggcgaatagctttgcattttaggaggatttcttgggtctcctgcttttgattggacgtggagaggccagaggtaaggtagttgagaggctctgtttagtccaggtgagcagtgatgtggatttgaaccggggctgtggcagccaggatgagaggcagagaagtccaggtagaaatgggaggggcctgataggacttagtgacagatgggaggagagaggggaatgctgattgaaagatctgtctcaggtaactgagagaagggttgtggcattaactgccctagggggatgtaggaggagcgggattgggagtggagccaattcggagttccattgggacatatttagtgcctgtgagtagatctttatctatgtttctttctcttttacttttcctgggtgggtggaagtagaaactagtaaaaatcctgaagcatcaataccgggtgtcttccaggtcctggcaggagaacatctctctgaaagagctccagagccgaggcgtgtgtttgctgaagctgcaggtatccagccagcgcactgggctgtacggacggctgctggtcacctttgagcccaggcgatacgggtccgcggcagctcttcccagtaacagctttacttctggtgtgtgcgtattgacctagacagacattgaaatttactggcattcagaccgtgacttgtaccctcgtaaagactggattaaaatgaccagttggagaataaagcgttgcaatgaagaactcttaatcagaagtccaacaattgatgtgggttttagttgtctagatcagcgttgtccaaaatggtagccattagccatgcgtggtcatcaaatgtttgaagtgtggcttgtaattgccgcagatacagaatacacaccaaatttggaagattatgttaaaaaaacaattgggaatatcttgagtaatttttctgaatactgattacatgttgaaataatatttttcatatattgggttaaataaaaaatatcttattaaaataatttacccatttcttttctttttttttttttttttttgagacagagtttcgctcttattgcccagtctggagtgcagtggcatgatctcggctcactgcaacctccgcctccggggttcaagtgattctcctgcctcagcctcccgagtagctgggattagaggcatgcgccaccgtgcctggctaattttgtatttttagtagagacggggtttctccatgttgttcaggctggtctcgaactcccaacttcaggtgatccgcctgctttggcctcccaaagtgctgggattacaggtgtgagccagtgcacccagcctcttttaaatttcttaatatggctactagaaaacttaaaactacacgtgactgggtgcctgtaatcctagcactttgggaggccgaggtgggtggatcacttgatctcaggagttcgagaccagcctgggcaacgtggcaaaaccccatctctgcaaaaaaatagaaaaattagccagatgtggtggtgtgtgcctgtagttcctgctacttgatgggctgaggcaggaggatcgcttgaacctgggaggttgaggctgcagtgagctgaaatcacgccactgcactctagcttgggggcaaagtgagaccctctctcaaaacagacaaaaacaaaagaaaaactacatgtgactctctttatgtttctatgtaatgggcagccttggtccagctggtaaacatgcaggatgtgtacttctgtattcccaaccctttcttgtgccaagcatgctttggctaaacttgtgccagcctggttggaaaggagggacagttagaagaagcttcttaaccacacgcctgggatgcttgtgttagacaaccacagccttggaagcctggaggaagcagcgttgccagggctgtactttttactatggaagtgtctctgccttgttttggtggtgacggagttttaaatttcatattttgatttcgtagactttagcccaacaattactggaatactggctggatttggagaagatgagatgagggtattgagagaggagagggccaggaggggaacctgtaggttggagtcagacctgagcagagtttgagattttttttttctgagatggagtctcactctgtcgctcaggccggagtgcagtggtgcaatcttggctcactgcagcctcagcctcccgagtagctgggaccacaggtgcccgccaccacgcctggctaattttttgtatttttagtagagacgggctttcactgtgttagccaggatggtctcaatctcctgacctcgtgatctgcccacctctgcctcccaaagtactgggattacaggcgtgagccaccgtgcccggcctaacttactttcttttttttttttttaactgttactgattgcatttactaaagaaagtaacaaagataaaatatttgaagtatagtggattttattacagaaaatgatattgaagctttccccagtgtcttgtgtcactgagtctttgtttttgcaggtgatatcgtgggcctgtacgatgctgctaatgagggcagtcagctggccactgggatcttgacccgggtcacccagaagtcggtcacggtggcctttgatgagtcccacgatttccagttgagcttggaccgagagaattcctacagactgttaaaacttgccaatgatgtcacttacaggcgactgaaaaagtaagtggatgggactggaaatcctaagtaccatcttccttcaacacagctaatccattcttacatgcctgtcgcacaaaagagagcaacaagtcatggtgtgggtgtggccctcatgggagttggtggcagcattggggcagaggctcgggcactgaattgcaggtgttctaattttagttttctcccttggcagagccctgattgctctaaagaagtatcattctggcccagcctcctcactcatagaagtgctctttggcagatctgctcccagtcctgccagtgaaatacgtaagaacttctgagttttcttttttggttgaaatcactactgaaagtatagagaacagtgtgaccttgggccgttttaataagagtttgagaaagtatgactagaagaagtctccctgaacatctttgtaggagtgtctcggagggccttgcatgaactggaccgtcctccttgtactcagtcctaatgaactggctcgttccattgaggttttttttttttttttgagacagaatcttgctctgttgcccaggctggagtgcagtggcgcgatctcagctcattgcaaactccgcctcccgggttcaagtgattcttttgcctcaacctcccaagtagctgggactacaggcatgcaccaccacgcctggctaatttctgtacttttagtagagatgaggtttcaccatattgaccaggctggtctcgaactcctgacctcatgatccacccgccttggcctcccaaagtgctgggattacaggcgtgagccaccgtgcgcctggccccattgagtttttagttaaaaaaatttttttttggcggggggggtggagggggggggcggatggagtctcgctctgtcacccagactggagtatagtggcatgatcttggctcactgcaacctccgcctcctgggctcaagtgattctcatgcctcagcctcctgaatagctgggattacaggcacacgccaccacgcctggctaatttttgtatttttagtggagacagggttttgccatcttggccaggctgttctcaaactcctgatctcaagtgatctactcacctcagcctcccaaagtgttgggattacaggcatgagctaccgtgcctagcctccattgagttttaaaataatgttctttttagtgtatataaatcttttattttgaaatgtaatgatatttcttttagcttagtactttgtgaaaatagaggaaagctgatcatactttatgcttgatagcaattttaggttggaaaaatcttttttttttttttttgagacggagacttgctctgtcaccaagagtggggtgcagtggtgcgacctcggctcactgcaacctccgcctcctgggttcaagtgactctcctgcctcagcctcccaagtagttgggattacaggtgcccgccaccatgcccggctaatttttgtattttttagtagagacaacatggtttcaccatgttggtcgggccggtcttgaactcctgacctcaggtgatctacctgcctcggcctcccaaagtgctgggattacaggcgtgagccaccgtgcccggtctgtgcactttttatgtcctttgctgttcttggagaacgtcatttttgggaggagtttgttgtctcatccagtcactgcccatgatttaacagtcctgtgagtattggacttggcccatttgtaaagcggtggctttggccaagcctcatgcaagggttaccccacagctattttctatcatactgtgctaggcaagccagtgttgtgttagcttcaaacacacaggacgactttgtagcactctttcagcatgcagtccctcaagatgtgttgtttttaaatactcattttctttctgcattttcctttggaaattctaaatgcagtcacatttcagtaatgctttatttctatgaaatatttactgaagggctcctatgcgtcacaaactgaattagaaatgtatttactgtgtcttagggactctggaatggcttggctagagcacgggaacgtggggttcaatggcctgttactagctgcacaccctgccgtcttccatgttggcttcagtctcacaagtcagggtcagcaaacaccctttgcttatgagctgctccttatccgataggcgtctctgtgtagtgggcaccatgtagcgaatgccatggctgcagggctgagcacagcaccacctgctctcaagagcacagcataagaagcaggtcttggccaggcgcggtggctcacacctttagtcccagcactttgggaggctgaggccggcagatcatgaggtcaggagatcaagaccatcctggccaacacggtgaatccccgtctctactaacaacacaaaaaattagctgggcatggtggcactcacctgtagtcccagctactctggaggctgaggcaggagaatcgcttgaacccaggaggcggatgttgcagtgagctgagatcatgccattgcactccagcctgggtgacaagcaagactccatctcaaaaaaaaaaaaaaaaagaagcagatctttagtcttggtcgtggaagattcaaaatagaaacacgatcctagaatttgttaatcattgtttttgtcatttgtctttatcattttatgggcactttaaagagggacattatgttagaaaggaatatgctctaggaaacatttccttcattcctgttactctagagcaggggtttttcctgtaaagggatggattgtgaatgttttgactctgtgggccatatcatacgtaccgtctacagctgcctgctgtagacggtatgtaaatcaatgggtgtggctgtgctccagtaaaactcaccaaaaccggcagctgactggatgtggcccacagtttgccgattcctgttcaaggagaaaccttgtgaaaataaagcagacttaattttgtgttgattgggttgcccctggggaggtccggcgtgttcctgacaggcatcactcatcccccggggcacacactctctgaggaggaacacccacagagctccccagagcacctgagcctcacgctgctgcttcttccacagacccgctgacattcttcaacacctgcctggacacctcccagaaagaagcggtttcatttgcgctgtctcagaaagaacttgccatcatccatggacctcctggcactgggaaaaccacgactgtggttgagatcattcttcaagctgtgaaacaaggcttaaaggtgggcagtgcatgccacttccctgtcagagcccgtccgctcctggtctgttgtgttcagtgggtgctcagcgacctttcagcctcagttctggtgggatgggtcaggaacattactgagcatttattgattgagccttggactgcccctgtttgatttccagcatccccgtgagtcttggggagcacgcgcaggagccgtagcctgggttgttgaggaaggctcctggagccctttgaggcgtggcagccttcgtgtcggccaggccctgggtcagggtttatttgttcaccacgcttgctgtgctcgtgctcctccgtgtgcacgcccgtgcaggggcctggagttggcctgggcccggtctgtgcccgtcaggagctcagcgtctggttgaggtgttaacagctaatcagatagtctggttaatggatacgatgcacatgtccagtgcacagatgaatgattttctgagatgtggaatataacattgtacattattattcacttacattttaaattttttttatttttattttttggagacggagcctcactctgtcacccaggctagagtctggagtgcaggggcgggatcttggctccctgcaacctccgcctcccgggtttaagtgattctcctacctcagcctcccgaacagctgggattataggcgtgcgccaccatgcctggctaatttttgtatttttagtagagatggagtttcaccacattggccagtctggtctcactcctgacttcagttgatctgcctgcctcagcctcccaaagtgctacgattacaggcatgagccactgtgcccggcccagttacatttttaatggctgaaaaaggatcttttatcatcatctgcatcagcttgagtcattgtggatcttggcacatggagagttttttttttttaatttatttatttatttttaattatactttaagttctagagctttttgaaaaaactttctggtttataaaaatgttggataatgatgagaattggaataatggccagttttgtagtttgatgtttactgggtgctgcctaccaccaggcatcgttctgagcacccatttaatcctcactgaaaccctgtgccaaggcaggtggttagtggccccagtttgtagacaaggaagccgggtgtggtggctcacacctgtattctcagtactttgggaggctgaggcgggtgggtcacctgaggtcaggagttcgagaccagcctggctaacatggtgaaaccccgtctctactaaaaatacaaaacaattagccgggtgtggtggcacacacctgcaatcccagctacttgggaggctgaggcaggagaattgcttgaacctgggaggtggaggttgcagtgaaccgagatcgcaccattgcactccagcctgggcaataagagcaaaactccatctcccaaaaaaaaaaaaaaaaaaaaaaaaccaaaaaaaccacgaggaaactgagaaacaaggtcaaatgcccagcactcagagtggcagagccagcaatggaactcgggcagagcgcagggaagcctgtcacttgcttaaaagattacgtccagcggttttccaatgtgtgagtgtctttgcacatgtttgaaaactggtaagaaaagatgacttattggaagggagcagattggtggttttaattgggtgccgactattcactaaaagtgagccaagacacacctgtgtgcacgctttggtggagatatgcctttggacatgccagtggggttggaggcgatgctgggcatagagagtgggtggctgagcctccttcctgagctgctgtttgttttgagcttaagggcctgtagagactctgcctcctctgctggttgccacctcctcttttttttttcctcagagatggggtctcactatgttgtccagggtggtcttaaactcctgacctcgcaccttggcctcccaaagtgctgggattacaggcatgagccaccgtacttggccagcgtctcacttttaatagtggagctgtggctgggtgcagcggctcatgtctgttatcctagcgctttgggaggccaaggggggaggatcacttgaacccaggagtttgaggtcagtctgggcaacatagcaagacccagtctctacaaaaaatagaagaaattagctgggcatggtgatgcatgcctgcagtctcagctacttgggaggctgagccaggaagatagcttgagcccagaaagtcacgaaacaccaggagtgtggtctaggtcttgctgctcgccacacagaaagccagttactgaggacaagtattgccaaggaagaggctttataatcagatggtgcagccgaggagatgagagctcatcctcaaacccatctccctgactaaaactaggggtttatataacagggaagaaatgtagcaatgtgtaaaaaacaggaactagggagggcaaggaggcacctgtagtggtctggtgattttcagatctttgatatttttttgagaggcctcaatgtccttttctgaggaagaaactcacataaataagtttgaagctttaacagcagatggtcaatttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgcagggcgtgggatgggggagtggctcgcttcttcagtgtcctgctgctcagacctgcaggggagcatacagatgggcaggctgtgggctctgacctcatggcagtgtctaggggtgaatgtttacagctctgtgagttacagggtgctctcttagtttgccgtctataggtggcttatgttaaccaactcaattagatccccttccttgtcacaaggacagagggctttctgtatcctgggttcttgccttggggtaccggaagaatcggatcacacgtgggcttggaaaatgaatgcaagatttgattgagagcacgtgtgtacatgccttgtgcttctttctacctttaaggctttttgttgttttagtgtcaacttcagtggtttgattacaaagtaaatgaccagatcctaacttgcggttcccaggttctgtgctgcgccccctccaacatcgccgtggacaatctggtggagcgcctggctctgtgtaagcagcggattctgcgcctgggacaccctgcccgcctcctggagtccgttcagcagcactccctggatgcggttttagcgcggagcgacagtgcccagattgttgcagatatcaggaaggacatcgaccaggtctttgtaggtgtcatggccagtgtccatgtggggcgtgggcttctgatctgcagtctttttaaggagcaaatttatctgtctgcattcctcttgaccttctcttgcttctgtcgattcctttaataattttaaaaattgggctgcccttttttttttttttttttttttttttcagagttttgctctcattgctcaggctggagtgcagtggtgcaatctcggctcactgcaacctctgcctcctgggttcaagcgattctcctgcctcagcctccctagtagctgggactgcaggtgcgtgtcaccacgcctggctaatttttctatttttagttgagacagggtttcatcatactggtcaggctggtcttgaattcctgacctcaggtgctctgcccgcctcggcctctcaaagtgctgggattacaggcgtgagccaccatgcctggcctttgtttttgtttttttttttgagatggagtctcgctctgtcacccaggccggagtgtagtgctgctgtcttggctcactgcaggctccgcctcccggggtcaagtgattcttgtgcctcaccctcccaagtagctaggactacaggcatgtgccaccacacccaaccaatttttttatttttagtagagacgggggtttcgccatgtgggccaggctggtctcgaactcctaacctcaagtgatccacccgcctcagcctcccaaagtgctggattacaggtgtgagctactgtacccagccaggctgcccatttttgatagagaactatacttagcatttaacagagtctcaactgtcttcagagcacttggttagtaggtgtgaggaattgtaaagaaaacattttccggccggatacagtggctcacacgtgcaatcccagcactttgggaggccgaggtgggcggaacagttgaggtcaggagttcgagaccagcctggcccacatggtgaaaccccgtctctactaaaaatacaaaaattagctgagcatggtggcgggcacctgtaatcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtctttctgtctggtcctgttgtcttgctagtagtggcaatgggagaaaagtagcctgaacataaacattgaaaaaattggcatcctcctagagctttccgtccattccaccttctccttgtgaaagaggacaccagtcggctggagaagtagggtggtggtaggtttcttccatttgagagggccttttccccccagcccgacactccgacacttttgagctctttggttctcccgtggacgctttgttgtagtgtctgtgctcacgtcctgtcctgtgtgctcactgtcggtactggtactccttggtgtcttagtctcagaggagtgatggcagcagggagggtgctggagccagtctttgctctaatgtctgtgctcacatcttgtcctgtgtgcttacggtcagcacctgcaccctcggtgtcctaacctcggaggagtggcggcagcagagagggtgctgggagccagtctttgctatgggcccgtggcatcgaggctgcttgcgtggctgcttgcatggcagcgtggggatgggccgcctgctgggagggggaggaaggatagatgcatgtcatgcaggttcgaggtggtggaggaatatgcatgatgtttgctcatcacaaatgtgggtgatttcatttcctgttgaaattggtgcttttgaggattttctttctctgtaaattatacacagtaaaatacctcctgtcacccctgctaaaactccatcccccaaagtagaaatcacaaataaggaaaggttacatcttttttttttttttttttttttttttttaaagaatcttgctctgtcgcccaggctggagtgcagtggtgcaatctcggctcactgcaacctccgcctcctgggttcaagcaattctcctgcctcagcctcccgagtagctgggattacaggcacacaccatgcccagctaattttttgtatttttagtagagacagcgtttcactgtgttggccaggctggtctcgatttcctgagctcgtgatctgcctgcctcgggctcccaaagtgctgggattacaggcatgagccaccgcgcctgaccagttccatctttttgagatattaaagtaagttgaggttttgattatgggttgaaaaaattttttttaatctcttgaaaaatgtagaataatatgtgaagctcagtctctccattcgtaagctcctacaacccaaatcctggggcgggcaagcgctttttcttccccaagatcaaatgcctgtgtgcagggcagggctggtccaatttctggtctcctctgagttaaaaacgtggtctctttccaggacttaaaatgtctcttcctgtgacttcaaggcaagtgaggatgtaaggtgcttagttgcgtgtgtgtatctgtgtctctttcaaggaagatttctgagtgttttttacggagtttattgaactggactgaatgatagaagcacttcataaatagagttgaagaagtacaaagttggactgaagtaagtgtatctcctttgtttttctttataggtgaaaaacaaaaagacccaggataagagagagaaaagtaattttcgaaatgaaattaagctgttaagaaaagaactgaaggagagggaagaagcagctatgctcgagagcctcacttcggcaaacgtggtccttgcaacaaacacaggtgagggggcgtctccatcctgcctgtgtggcctcgaagaaggagttggggtgtgttccctcttctgttttctggaagagtttgtttagaattggtatttctttcttaaaagttgggtagggttcactagggaaggcctccgtacctgcagttttcttcatggagaggttttgaactacaaattcaacttcttcaatagataaagggctgttcaggttgtttttcttccatgagcttgtagctttcaagaagtttgtccattttatctaaacggttgaatttagaggcatgaagtggttcctaatatgcccttattcttcttttactgtctgcaggatctgtcatgatataacctgtattattcctgatactggtttgtgtgctcttttttttcctgctcttctggctggagggtttttttttttaaatttagattttatatatacatacatatatattttaagagacagggtctctgccaggcgcagtggctcacacctgtaatcccagcattttgggatgccaatgcgggtggatcacctgaggtcaggagtttgagacctgcctagccaacatggtgaaaccccatctctactaaaaatacaaaaattagccaggagttgtggtatgcacctgtaattccagctacttgggaggctgaggtaggagaattgcttgaatcctggaggtggaggttgcagtgaaccaagatcgcgccactgcactccagcctgggtgacagagcaagactccgcctcaaaaaaataaaaaccccaaaaccaaaaaaacaaagcaaaacaaaaaaagagacagggtctcactatgttgcccaggctggtctcaaactcctgggctcaagggatccccctgcctcagcctcctaaagtgctaggattacaggtggacccaccgcgcccggcctggctggaggtttcaattgatcttcccaaagaaccagcttttgctttttctctattgtttttctgtttcatgtatttccacattgatctttatcgttttctgttttcttgggcttgttctttttcttgcttcttaatgtagaagctgagatcattgatttgagacctttctttttttctgatacgagcatttagctccataaatgtctccctaagtactgcttttgtggcatcccacaaattctgatctgttatatttcattcatttcaaaatgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcttcttctctcctctcctcatccctgtccccatccccatccccgtcgccttccctatccccatccccatatgggatctcactatgttgcccaggctggactcaaactcctgggctcaggtgattctcccagctcagcctcctgaggagctggggctccctgcatgtgccactgcacctggcttactttctgttattggtttctaatttagttccatgtggtcagaggacatactctcatgacttggatagttcatcgagacttactttatggtccagaatctggtctctgtctttgtgagtgttccatgcacacttgatagaacgtgtgttctgattttattgagtgttctgtaagtagtcagatcatgatggttgatgatgtggttcaagtctgctgtattgagagagggacgttgaaatctctgaatataactggacatgtctgtttttcctgcagttctattggtttttgcttcatatctttggaaactcttttactggggtcataaatgtggggctatgttttcttgattaattaacaaatttatcattatgaaatgaccttctttatccctgataatattctttttttgaaatctactttgtctgacattaaaataatcatttcagcatttcagcttgcttttcttttcattatggtcaaaaacctgtaaaatttaccatcgtaaccctttttaagtctgtagtacagtagcattaattgtatgcatgttgttgtacagcagatctctagaacattttcatcttgcagacctgaagctctggatctgttgaacagcaattccctttttccctgtcccagatcctggcagtcaccattctcctgtctgtttctaagaattttattattttacatacctcaagtaagtggaaccatgcaggatttgtcgtcttgtgactggcttgttttatttagtgtaatgccctcatggttcatccatgttgtccagctttctttttatttttaagagacagggtcccaatctgtcacctaggctggagtacagtggtgcggtcaaagctgtactccagccttaaccatgaatgtgggacctccagcaatcctcccacattgacctcctgagttgctgggattaacaggcgtgagccattgcacccagcccccacctttctttcaactagtgttagtgtgatctatctttatcctttttcttagaacctatttgtgtctttatgtttaaagtgatcttttaaaaaatatttgagacacggtctcactgtgttacccctaactggagttgcagtggtgcaatcatggctccctgcagcctcaacctcctgggctgaagtgattctcccacctcagcctcctgagtagctgggacaacagacacgtgctatcacaccctgctcatttttttgatttttaatagagacaagatctcactgtgttgcccaggctggtctggagttcctggactcaagtagtccttccacctctgcctcccacagtgctaggattacaagtgtaagccactgtgcctggcctgtttatttctttttaaagagagagtcttgctctgttgctcagactggagtgcagaggcgtgatcataacttgctgtagccttgcattctttggctcaagtaatcctcccacctcagcttcccgagtagctagtactgtaggcatgagccattacacctggctaattttaaaaatgttcttttcttttttccttttagagatggggtcttgcaatgttgcccaggctggtctcaaactcctggcctcaagtgatcctcccactttggcctaaagtgaatttttttgtagatagcatatagctgggccttgctttattatccagtttgacagtttctgccgtttgttctttgttatattttcctcctcttctgctttcttttaattaattaattgaacatttcttttttttttttacataagttctcactatgccccatgattgaagatttcttaggaatttatttttatttatttatttatttttaaaagataatttatagagacaaggtcttgctgttttgcccaggctggtctcgaactcctggactcaggggatcctcccaccttggccaccttggtgctgggattataggcatgaaccatcactcctggcctatttttgtttttgttggcttgttagctatatatctgtatttgattctttcagtggttactttaggccttacagtatgtgtcttcaactcatcatagtctgttcatatgccacctcacatatagcataagggctttatgattgcaagctgacatttctctcctcttagcatttatgcttttgtcatatatttttcttatacgcatattctaagacttacaatgcttgttcttgttttaatggtgaattatctttaaagagatctaaataataagaaaaatgtcttcgtatttgcccgtgtagttaccacttttggcgctttgttttcttttggtttaggtcgtgtatttccacgtggcatcattttccttccacctgaaaggcatccatgatcatttcttgtagtgtgggtcagccggtgatgcagtccaatagcttttgtatgtctgaaaatatcttgtttcacctgcagttttgaaagatatttttgctgcgtgagaattctagattaacacttttccttgcaatattttaaagatgttgtccactgtcatctgcctgagtatttctgaagagaaattggtcatccttatccttgttcctttgtatgtaacgtgtcttttttcttctgtctgcatttaagattttttcagccaggtgtggtggctcatgcctgtaatctcagcactttgggaggcttaaggcgagtggatcacctgaggtcaggagtccgagaccagcctggcccacatgtactaaaaatacaaaaaaattagcagggtgtggtggtgggcacctgtaatcccagatgctcaggaggctgaggcaggagactcgcttgaacccggaggcggagattgcagtgagctgagattgcaccactgtactccaacctggacgacagagccagactccgtctcaaaaaaaaaaagaaagaaaatgatgctttctttatcactggttttaagcaatttgactatgatttgccctggtgctatttgcttcatgtttttttttgagacagagtctcactctgtcacccagactggagtgccgtggcgcaatcttggctcactgcaacctctgcctcctgggttcaagcgattcttctgtctcagcctctggaatagctgggagtacagatgcacaccaccacgcctggctaatttttgtatttttagtagagacggggtttcaccacattggccaggctgctctcgaactcctgacctcgtgatccgcctgccttggcctcccagagtggtgggattacaggtgtgagccaccgcacccggcctcatgttttttaacattgtggtgagaacacaacatgagatctaccctcttaaatgtttaagtgtactatataatattgttaactatagacgtcgtgttgtgcagcagatctatagaatttatcttgcacagctgaacctttatacttgcttattgctgagttcactaatttccttctttcatgcctaatctcacatctgtcccatccagtgtaactttcatctgacatccagaaataagagtctttttatatctttgatgttcttatttaatttttttaacatttggaatacaactataataactgttttgaatattctagactattatttctctatcacctgtgtcatttttggtctctttcgatgaactgttccccttgagtggttgtgttttcctacctttttgtaggcctgctaatgtttgtttggataccggacattgaggattttacgttgttgcatgctgaatattgaatatttttgtattcctataatctttttttttgtttttttgttttgtttttttgagacagcgtcttgctctgtcacccatgctggagtgcagtggtgcgatcttggctcactgcaacctctgcctcctggattcaagtgattcttttgactcagtctcccgagtagctgggactacaggcatgcgctaccatgcccggctaatttttgtatttttagtagaggcgaggtttcaccatgttggccaggctggtctcaaactcctgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccctgtactgaggtaagaccctttgagctttctacccaatgcaccctgtatcatgagatttttgagtttgactggtgggattaggtgctgttcccggccttgtgtgagcactgggcacttttctctcattgttttggatggtatttttcccaggcctggagtagttttctcctaagcatgtgctaatcacaatacccaagggaatctcgcagcagatctctggggttttttctctctgtgtagcagtctctttggcattttgtcctggaaactctgcctgcattggtcgccacagattctcagccttgtctcctcaactcagggagccttctaggttctacctggctgccccttctctgtactctctcctggaaactctcaaggcagaaagctggggtaaccccagggctcacctcctttgtctctcgttattcaggggttacttttctttgttacctgttgtctagtgtcctgaagagtgtggtttcagttattttaaaaaaattttaaataactggctgggggggttgttatttgagatgggagagtaaatgcagtccctgctattccatcttgggcagaggtggaggacgcacattctctcttgtagccaggagagagcactcccgttacagagctgtgtaccttgtgactgttgtgggaatcttgtcaaccactcttttggggtttaggaatgtgtttgtgagacctctggtttgttcctgtgtgataatagtaccacaaaggtagcagctgaaaacaacccacgtttattattctacagtttatctgggcggagagcccaggcccggctgaacaaggtgctgtgctcaggatctcacaaggctgcgatcgaggtgtcagtgggggctgcagtctcatctgaaacttgcctggaaaggatctttcttcaggctcacgtggttgttggcagcattcagttccctgtgggttcttgctgggtgttggctggaggccgctcttagctgtttgcccttaggccttgccaacatggctgcttgcttcctaaaagccagcaagagacacagtctcctagcacaatgggttatcgtcttatgtaatgttatcaagggtgtcacatctcatcacctttcccctgttctgtggattagaagcaagtctcaggccccacccacatttgaggggaagggattatgcaagatgtgaataccagtggccaggatcctggggcataccttaaagcaagtttgtctaactaaaggcctgcaggccacatgtagcccaggatactttgaatgtggcccaacacaaatttataaactttcttaaaacattatgagatttttgtctctgtgttttttttttaagctcatcagctattgtcaatgttagcatattttatgtgtggcccaagacaattcttcttcttttaatatggccctgggaagccaaaagattgcacatccctgccttagagtctgtttgccacaacctctcagctggtgggctgctctaaggaacagagtccaggttctttttttttttttttttttttgagacagcatctcactctgttgcccaggctgtagtgcagtggcacaatcttgattcactgcagcctcctcctcccgggttcaagtgattcttgtgcctcagcctcctgagtagctgggattgcaggcgcatgccaccaggcccagctaattttttttgtatattttgtagagactggatttcaccatgttggccaggctggtctcgaacttctgacctcaaatgatgtgcccaccttggcctcccaaagtgctaggattacaggagtgagccaccacacctggctagattctaattggctttgtagttattgctttatccagttgtgttttaaatcagacaggagaaaaaaagggtcacaagcagaaaatacatttatggggtcttttatatctacccatgtagttgcctttatttcttcatgtagatttgagttactctctccaaaggactccctttggtatttcttgaagggcaggtttgctgtgacagattctctaagctcatctttatctgggcatgtcttagtttctccttcattttttgaaggatagtcttgctgggtatagaattcttggttgacagtctttcagccctttggacgtgtcattccattgcctgcatactttctgatgggaaagcagctattgatctcattgagggctccttatatgtgacaagttgctactctattgctgctttcaagtgtcgtcttttgtcttttgagtgtgtgattatcatgtgttaggtgtggatctctgtgagtaaattacatggagtttgtggaccttcttggatgtttagattcgtgtttttcatcaaatttggggagttttcagccattattttttcaggtattctttctgcccttattctactctcgtctccatctacaactcccattatgaatcagttgattcacttgataatgccccacagatctctgaagctctgttcattttcctccatttttttctttctgatcttcaggctggatcttctcaatggacctctcttcaagtttgctgatcattctctcctgttgaatccttctagtgaatttcagttattgtacttttcaactccagaatttctgtgtggtgcttttttttttttttttttttttttagatggagtctcgctctatcgccagactggagtgcagtggtgtgatctcggcccaccgcgacctctgcctcccaggttcaagcaattctcctgcctcagcctcccgagtagctgggtctacaggcgtctgccaccacgcccagctaatttttgtatttttagtagagactgggttttaccatgttagccaggatggtctctatctcttgacctcatgatctgcctgcctcagcctcccaaagtgctgggattacaggcatgaaccaccatgccagcctctgtgtggtactttttaaaaaattattcctgtctctttattgatattctcttatttggtgagacattattctcatattttatttctttagacttgtttcccttttgctgtttgaacatacttagaatcgctgatatttcaagtctttgtctagtaagatcagcatctgggctttctctagtatccagtttatttatttatttatttaattttttggagatggagtctcactctgttgctcaggctggagtgccgtagcgtgatctcggcctgctgcaacctccgtctcctaggttcaagcgattctcctgccttagcctcctgagtagctgggattacaggcgtccaccaccacgcctggctgatttttgtatttttagtagagatggggtcaccatgttggccaggcaggtgtcgaactcctgactcaggtgatctaccaaccttggcctcccaaagtgttgggattacaggcgtaagccactgctcctggcctcaagtatctgttgattgccttttttcccctgaatattggccatattttcatgactctctacgtgccttgtagttttttgttgaaaatggatgattttaaataatagaatgtagcaactctggaagtcaggttctcttcccaccccggggtttgttgttgttgccacttgttgtttgtttagtgacttttctggactaattctgtaaaatctgtattttttgtcttgcgtggccactaaagtctaatacaacttagtggccagctagtgattagacagaaatccccctgaactcctggagccataaatgccccagtctttgctgagtggctctgtgtgtgtgcttgggcacacctccaacacagagccaggctgtttgtgactctcagctttcacttcccgtttgtgcagtgcgttgagctgagccacagatgagagctgagggcctcccgaggtctttcctgagccctgtacatgtgtgtggccttctagattcccaggaatatgttggagcttttcaaagccccctgaggatatctcattccccagcttaaaactttggttatcctatcatttgctccgaccattattctctgtcttagaaaactgtgatgttcaacaattacctctgattgtttttgacagacaccaccagggaaaaggctgtttgtattacatgagctcagataaagtcttttgagtgtggtctaccagaggattcccagacagatgagataagcacagtttctggagtggggcttttcaggaatgccaaccctgttctgcaccccccggggctggcaggtgctggttttcaccctgacttcaggctgagggtttcaaggctgccatagggatggctgggaatagggcaggtttcagtgccaccgagctcccgtgctgacggggattcagatgcttttctggaatgaacacttccctgattgctgcagcctttggcgagtttccagagttctgagaaagttgattctgaccatttgccgatgtcttgttgctttcgtggaggagagaattctcagagcttgtgagagtctctttgctgacatccttctctggcttcaaggacagcacttgctggaaatcaggaggcatcccctgagccccacaaggtcagcttgtggcctttgtggcctttctgttccctgctggttgttggggaactagagtgagttcctggaagtgcttctccatcatgaagtctggtttctctctgtactgtgaagtcacatctgtgacctaaacatgtctcttaattatccaaagcccagccaagttctgtctcctctgtgggtgctttttctagccatctctgaagagtcaatcttgagaaatttctcagtatgtcttcatcatggcattatgtacatatcattagcataattcactcagatggaaggcagaaagggtgggaactaacattgatcacatttatggaaacctgccttctcgtgctgggcactttatatatgttatctccctttgtggtgcaatctcatgacatgcagtcattgtccatgtttgtgggtgaggaaacaggcttaggggtgggaggctcgcctgaggccccacactgttggctggagacagcgtggggcctgagtcttgctcacagcctgaacgctgcactctgctgctccgcgtcccaggaaggaaaagctgctgcagtgggtttgtgttgccaaatacatggaggcttttttctgggtgagtgcccagcagttgattgttctgtatgtccaagaaagtcaccttagaaaagaattaggttctaaatttagaaaataattgagttacaatatttagaactcagacagcatcccttgggcttggggtcacagccccgaaggggtgattaattttgccaattgaagatcagaggggcctgtggccagagtacccactgcttaagacacaggtgagctggaaccatgagttttaaaatgtcttggccaagtttttattacaagatacaaatttatcccacacagttgcaatgcaagccttgatgaaaccccagcttgatggtgtctcctctggtgtggctgcgctgttgggaagcagctgtgcccctggagactcccggctccctgtttccaccaggtgcgtctgccgatggccccctgaagttgctgcccgagagctacttcgacgtggtggtcattgacgagtgtgcccaggccctcgaggcgagctgctggatccccctgctgaaggccagaaagtgcatcctggcgggcgatcacaagcagctgccccccaccacagtctctcacaagtaagacccctttgcctcacatgcccttctctgcccccgccctcctgcggtccttccacgctcagccaggagccccaggctcaccaggagcccctgcggtgcctcctcggtttctcggcacagctcctaccccgtcttacagcattcattcatctcaacgtcgcatctgtgagatcatgtactccccgagggtggggtcgcatcaccttcatctttgtagcttcagaactggacacagggcctggcacgtttctggtgttccgtccctgcttgttgagttgaatatcccctcatgaaccaggcaggtttgatggtagagtgccgtgagagccttgggctgggctaactggcctctgggtggatgtgggttctttagtcttcaatctgtagacacatccctggatggagggcactgggcagagactcagcaaaccatggttctgccgtgcggagacaccggagccctgatgcagtggcctggcccaggctgtcctggtggagacactggagccctgatgcagtggcctggcccaggctgtcttggtggagaaagtgctgcccgcccccccagcccccctctcacctctccccatactacccagcactcactgcttcagccacacaggcctcgctggcccctctgcctggaccactcctgcctgggtgtggcgggcgtgccctctctccagatgaaccctctgcatggtatcccttgactgcccttacacgaggcctgtgaacagggcctggcacgtgggctgtccttggacaagtccctgttcagaaagttgtccctgaggaatgaaacacttctgagactcctgcatcctggccctcacttccaccgggggaagattgatttcttcagatttcggttgccttttgaaacacttctctgtttcactgtgggtgtgtagaagctatgaactcggaactttcgttgttttccgaggaccggaagaagatgtgcaagaaatcctgtcgagtagaatctcatcacaggggcgtgggcagcccaggagttggcgggtatgtagagagaggtgtcaaaaatagtaattgagagtgagctttgggaggaagatgttggaaataaagatggtggaagaaagaggagtgctgaggaaaggtgctctgaaagatcgtcctggtgggagacacatggggatctagagtggaaatgttacgggatctctggggtgttgatttttctggctggaaacctctgcggccgcagcacctttgcctcagttcttgtcctgcatccaggaagaatgaggtacgcagattagtgaagggtgaagaacagttttatttagtgttagaacagctcagagtagtgggtagctcctctctgtaggcaggtcatccgtcgagtgttcagctgtcagcagaggaggccctggagagggtggctcctctctgcaggcaagtcacttggacatctctgcaggtctctgaagctctcagcagagagcatagatcctctctgccctctccgtcctctggctgtcctctcgccttctctgactgagcccagggcttttatggacctcaagagggaaggaaggatgtgccaattggtccatgggtggccatgggcgggcctggaataggtaccatgagtcctcactctggtccacaggactggcagcccagctgccagccttcaggcccttcctggccttccactgtccccttccactcaggactctgtctgcctcccgctgccattcatggccctggggcttggctccaatcccactctgagatccgagtgggtgctgggcgctgagagaggccaggcagtggaagcagacacccatgaccctgcagggatggtgtgggggttgtccttcctggggcgcctgagggtgcaggctgcagagtgggagggcagctacagctgcacccaagagctcccgacccaccacctcagaagaggccaggctcctgcttgttcccggctcctgcctgcttcgtggagcaggaagcccaggtctgcagccacagatctggcggctgcagctgcacgcggaaaggcagatcctacctgttcccggctcccctaagagcaccgggagacgcagatccacagctgcagtttgggcggctgtagccccgcccttctggagcaggaggcctgggtctgtagctgtgaccctgtgtctgggctgcagcggccactctacctcagaaggggcggggctcccactggcttcatggagtgtgcagccacagccagggttccctgctgcagccggcatgatggcagcagccactgccatcagaacctccctgggagcagggaggacaggcgtgggaggacgcttattcagtggcttcttccagggagaggttctcgagatgtccttaaaggaggtcttcatcctctggaaagcctttgggtggaggaagtttggaactgtgcccttgagcagggaccctgttgtgtaggagggagtaggatggtttcgggggaagacgttgggtggcgttccctgcagagagtaggatggttttgggggaagacgttgggtggcgttccctggagagagtaggatggttttgggggaagacgttgggtggtgttccctggagagagtaggatggtttcggggaaaacattgggtggcattccctggagacagtaggatggtttcggggaaaacattgggtggcgttccctggagagagtaggatggtttcgggggaagacgttgggtggcattccctggagagagtagaatggtttcgggggaagacgttgggtggcgttccctgcagagagtaggatggtttttgggggaggacgttgggtgacgttgcgctgagtgttttgggtttgcagttggtactgatcatcgcgtcctgtcctcattttgttggaattaaaaatacgttaatcacagaggtctggtaagtttccagagggaaggtctctgaagtggagctgggtactgccccagggttttggtggggttggtgagccgtagtggtgcagagggtgggctctggcaccaggtggcccgggcaggtcctggctctgcagctcacccgggcagctgtgggctggcagcctcctctgtctcacccttcttacatgtaatatgggagtcataacagtagccacctcatgaggttgttataaggatgaagggagttaatccacatctggcacacccagcagtgcctggcgcctgggcagtgctcagccgctgcagccgttcttggtgggagtggacttgactgctcacagttggagcatgttggagtgtgttcgttccctgttatggctgtgacaaatgaccacaagcttagtggctgacaacaacagattttctgacctccagaaacgacaatctgggggtcagatgtccaaaatcagactcaccggcttaaaatcaaggtgtgggtggggttgcttcttctggaggatccaggggaaaacccatctcctggtcttttccggctcctagaggccattgcttgacttgttgccctttcctctgtctatgaagccagccgtgttacgtcttcaaatctctcccctcggtgaccttctctgactgaccctcgcatgcccccttataagacccttgggttatcacctgggtcatccagggtcgcctccccatcccaggatccttaacttcatctcagctgcagcgtccctgttgtcctgtaagggaacattcacgggccttggcgattggatgtaggtgcctttggggctgtgattcagccaaacccgccccttggttacttctgggtcagaatccaggggagagttgggtcctgaggtttggggcctgtcctcctcacttgctgtggttcacacctggactctggggctcaggcctgccttccccctttctccctcctgggcgcagggctgcgctggcaggactgtcactcagcctgatggaacgcctggctgaggagtacggcgcgagggtggtgcggacactgacggtgcagtaccgcatgcaccaggctatcatgcgctgggcctcagacaccatgtaccttgggcagctcacagcccactcttccgtggcaaggcacctcctgaggtgagtagctcggcaccacccgccgccccatccttctgccctggctaatcctctgcgtcacctgtttctacgcagcaagctaaagtgaagctttctgcatgaaagtcgactctgaggctagctttttggaagagagggtggccttgccctggagagctgggtcaggcccgctccctcccttctgatgtcctgatgtgctcattgtcctcccctacctaagccttttcctcgtgggaggggtcggttctgttgggtggggcctcagtgctgcactgtggccccctgatgtgctccctctctgcctgtgtgccagggacctcccaggtgtggctgccacagaagagacgggtgtgcccctgctcttggtggacaccgccggctgcgggctgtttgagctggaggaggaggacgaacagtcgaaagggaaccctggtgagcttgcttgcagatggccagcttttttgtttaaacatacctccagctctttaaaaataaaaggcactttaattgcctaattccgggaggagctgagagcagttgttgatggccgtgaaaaaacggagccccacactgcaagaggctgagcagcatcgttttctccagggtgagcagaccgctcctgggtgagatgggcctggcagcattttacggccttctcctgaatggtggcccagctctgcctggctggtctggtgatgggaactgtcattgctcagctgacaccaccatctccccagttccacgttgaacaggatgcacggccataggagtcaaaaggccttcattgctgatgtgaaattcaagttagctgggcatggctggtcctggggccctgggacacagatgattagctcccaggaagccacctgagtggaggatcagctggccatgatagacagaaacgtgcccgaaacacgtgttggtggtggatgcccacttggggcgaccttgtgctgctcacccgttctttctttccctccaggcgaagtccgcctcgtcagtttgcacatccaggctctggtggacgctggtgttccagcccgtgacattgctgtggtctcgccatacaacctccaggtacgagggtttccttttgtccctctacagagcagctggggctcacacaacctagagggtgaaagaaaaagggtgatttgttggctgtggtgaccgaaaagttcaggggtagggctgaccttattgtgactggatccagggcccaaatgatgtcgtcaggggcccctctgcgtgttcgtctgcccgccccaccttgccccgccctgcccggtgccccagccttctgcactggcttgtgttctggccagatttgctgggtgaccccggcagcctcaggctgacacagtccttccacgggcagccctggcggaacagcctgtccttttctggcatttcccacaggagtctcagccttgagccttgctggtctggctcaggtcgtgttcccatgcgtatctcatttggtaggaaaaatgtaccttctggagtatcgggaggatctgtggaagtggccatcataccttcctggtgtgcaggcatcacacatagggctgtctgaggctggcggctgtcataagccaaaagaaatgatcaaatgccagggacagggtgtggtattggcgtgcatgcgtgcccgtgaggagggcgaacgggaagcctttccccatggggctcctgcaggctccgcttcccaggtcctggctgtttcacagcgtgaggccctctgctgagctgaagggcagggtcttgctgcgctggcatgggtgggtgaggaaaccacagcccggctggtgtttcaggtggacctgctcagacagagccttgtgcacaggcaccctgagcttgaaatcaagtctgtcgatggcttccaaggccgagagaaggaggccgtgatactgtccttcgtcagatccaacaggaaaggtacggagccctcgccagagtcctttggggacagcacagaagtgaatttattgattgaggggcatattgggtgtctgctgggtgccacactggtttctggcagtgtgctcatggtgcagcttctgtccttagtaagttcacgtcaggcaaagcacaggcaagagagtctgcagaggctcagaggcgtgagtgtgctgtcagggagcaggtggctggggtggcagctgggggcgcagggtgggctgggaatgatcaggacatcctgccgaggaggtgaagccccctgcagcccagagctggcctttagcctccatgcacggagccgcggggtgtggtggtcgtggctgtggtttctgtgctgctgtggtgtgtgggctttcccatttgggatgagcattgttcccagaagcaggtttagtgaacgggctttgtgagacattctcagaaggcagaaagcaggtgaggcctggctagaagctatgggggaaagaagggaaggtcctggaaggtttcttgtgctttctccctggtgccagctgcagccacaccccaggcggcccctgaggctgggcttagaaggaaaggagcgacagaacccagtcgggttccccagagccccactcagtcagccgtggcagccagatgccagggcaggtgtggcatcacggtgccacgcgtggccgggcacccgtgtggatggtgggccacgcgcaggggactacacttttggtggtggttactgataagggcgtaggagcctgactgtgtttcttagtctgaaacctgcttctcactcccctctggccttttgtaggtgaagttggttttcttgctgaggaccggaggatcaacgtggctgtcacccgtgcccgacgccacgtggcggtcatctgtgactcccgtactgtcaacaaccatgcatttttgaagaccctggtggagtatttcacacagcatggggaagtacgcacggcctttgagtatcttgacgatattgtcccagaaaactattcccatgagaactcccagggttccagccacgctgccaccaagccccagggacctgctacgtccaccaggaccggaagccagcggcaggagggaggccaggaggctgcagcacctgccagacagggccggaagaagccggctgggaagtctctggcctctgaagctccatctcagcccagcctcaacggaggcagcccagagggagtggagagccaagatggcgtggaccacttccgggccatgatagtggagttcatggccagcaagaagatgcagttggagtttcctccttccctcaattcccacgacaggctgcgggtccaccaaatagccgaggagcacgggctgaggcacgacagttccggggaagggaagaggaggttcatcactgtgagcaagagggccccgcgaccccgagcagccctgggacccccagcagggaccggtggcccagcccctctccagccagtgccccctacccctgcgcagacagagcagcctcccagggagcagcgtggcccagaccagcctgatctgaggacgctgcacctggagagactgcagagggtcaggagcgcgcaggggcagcccgccagcaaggagcagcaggcctcagggcagcagaaacttccagaaaagaaaaagaaaaaagccaaaggtaagtcaactaataagaacttggggcagtgtcccctcactggggtgctggccccacttggagcccacctgccaccatcaacagaaggaagggcttcctcctggtggcaccgtgcccgtgtcattttagctttattttcagtcatgccactcccagctccgtctgggctcccctaggtcggtgatcaggtcacgggcaccttcttttcccagaccctgtgtgggactcggcaagtaggcagcactcagagcatgtctgcagcagcaggaggggcctggaagagcaaacatggatggctccctggagcccctcgggaatggagcgatcacggggtcccatgcaacatgtggccctggagggtggaggtcttgcacagcgaaagggtgcactctgcctggaagttgtcctgggcaaaatgctcagaaccacaggggctggctgagcgcaaaaccattcttgcccttgggccatgtggagtccctgggtgggctctgccccgtttgccacatcctgcattgtgcccaccccgcaggagctggctaggcgtgcagtgggagttggccaggcatacgctggcagagcgtgtagcggtcttggggaactcctgctactgccattttcctcagcaagagcatgcaggagttccagcttgcattgattcattgaattcctgaagcgaagctacaccagcacatgggtggctttgaaaggggcctcccagagcctggggctccagaggaattcactccccaaacctttgttgagcagctactgtatgccacgctttgtgctagaggacaggactgatgccacccctgcccccaggcactgacagggtagcagagggaagacacatgagctgctttttaattttttttagaattaatagagacggggtctcactctgtcactatgttgcccaggctagttttgaactcctggccgcaagcagtcctcctacctcagcctcccaaaatgctgggattacaggtgtgagccaccgtgcttagccatgaattgattttaaaaccttaaatgaggggccaggtgttgtctttccgtttgcctgagtgacgcgggtcttctccaggacatccggccacagatctgcccacggaggaggactttgaggccctggtttctgccgccgttaaggctgataacacctgcggctttgccaagtgcacagccggcgtcacaaccctgggccagttctgccagctctgcagccgccgctactgcctcagccaccacctgcccgaggtatgtcggcctcccctcctgcgatcaaacagtggggaggggtggtgggttccgtctccaggaagcagaccctgggcagacttgttccagtcggaacagttagctccttacaagctccagataccttcagaaacagaaatcagacactgactcatgatcggttttcagcacatcagggcacaagcaaacaaaatgccttatttgctgagctgcagccacgttagtgggaattctgggcagagggaattttgtcccagtgtccttgggttctgtcagtggcctaatctggtctgtttggcataggggaggtgggaggcagagcctccagcccgtcatctgagctggccatggcccggctgctgtgtcattcattccttgagccggggttgatgagaaccccctgggccaggtgtgggcgcctgtggaaagccgaggtctgaaccagccttgtctctaccctggaggatgctgggcctggtgggggacctgggtaagagaccagcatacagtaccaggtgttgagtgctctgaggaagaaaacccagggccagggtggcagcagggtcacccacccagatgcagcagtcagggtgggcttcctggaggaagtaacactggagctgagacctgtgggacagaaggtgggagctgggctgggaaggacagggccgatggcgggtgggcaggcaggctatccacccttagaacatgcataaagccccaggcccagtcagagagttgggagtagagtgtgaggcagatggctagagttgaggctgggcatgtcctggcgagctgcctggaggagtcaggcctgatctgaaggcagtggggtaccctctagggtgtcagcagggctgtgatgtcaccagtcttggctgcagtgtggattaggtaggcggaggctgggaggcagtgggaagtggccgcagggactgtgtggtcagtcagggtggtgccatttcctgtgtgcacactcgggggctcccgccacaccagggtgcagaccaccccgccgctctcccgccaggcagcctgcagggtgaaggactgacatggcgggaggagtggccttctctgttggggcgcctgtggccccccagctctttgatgggcagagctgcaggatctgcctccttgcccctgtgagcccagcagtgattcttgtgtcctccccagatccatggctgcggtgagagggctcgcgcccatgcccggcagagaatcagccgggaaggggtcctctatgccggcagcgggaccaagaacggatccctggacccagccaagagggcccagctgcagaggaggctggataagaagctgagtgagctcagcaaccagaggaccagccggaggaaggagagggggacgtgaccggccgcatccttgcacgccccgcggagctctctccatggtagcccagggcgctggcagaccatgctccgcctccaccagggccacagaggagcggaggggcctatgggggaggagcggagggccctgttggggaaggttgggtttttggaccccagggataagcttttccgatgtcacaatgtggaggaaagcacctgggggacaacagtgctcgtgcaggtggggcttgggaaatgcacgtcccttcccctcactccccgccaaaacccacatcccagcctctggatcctggggaaggttccagtccctggagaatacccagggcctcaaacttgaagtcactcctccaatgtctgggacttgccagctcagcccgttaggatgagggtgctgagaggaaacaggaaacaagactgcgaatggcgctcaggcagggagcagggagtggcgtttggcttgcacgttcccatgtggccagatgctggggccactttccttctgtctgctggtgactgcagtgttccccctcctcctcaccacggggctcctgtgagtctggggggcacctctttctggcctgtgcacctctctctggcttataaaggtgcctggcctgtgccagcccctccttgttgcgcctcaccgtggggaccaggtgagccggctctcccacgtggttgtcccgggaaagctgccccacagcctcagcatcttcagcacttaccgatccagagcctcccggccttctccggtgtcctgtaccaactcttctatttaagagaacctcagatgatgtacctgagcctcagggttttgtttcagagggatataaattatttaaaaattaaatgaaaacgttgcacactgccccagtgtgtctgctgcgggtctaaggggcgcgccctttgcctgttctgctcagctgctgtgccctccccgccgcgtctctcaagccccctctccttctgacctctctgcggcagactctcccggtgcaggctcctctctccttaaatcccattcatgtccttttatgtccccgatggttctgagtgaggttgagcttccctgacctgcacctagggtggctgtcccccagaggccatttacgcagcgcattcggctaatgtgtcctcaggccaggcctgcacgctttgactgccgtgttcttgctggtcctgggcgactctcccttcctacccggactgacgccccaccctgggccactagagcccctcctcctccccctgtcctgtccttgtctgttcccgtcaagtggcttttggactgaattgtttgggaaggggaccaggactctactgcattttgtgtcaagtgcggcagagttaatctggttgcttccataagtgctgagcaccatgcacagaaggctgcagttctcatgctctttgaggacccgtggctgtgggaggcatttgtgtaatgatgctcttgggggatgagggcaccattggaagcatctcccggttgacacagcacacagggacaggtgttcttcctgtgggggcgggggtgcctgcttaagctccccaacttcccagaatccaaacagctgataagagtcctgccctggggttgacacggatgctgaaagatgttggctcttgggtgggagacagccgacagccacactccctgcctcctaggtagcctgtctgcaggagagaaggaggccaaagagaaacagacccaaaaatgggggtgggagagtgacctgatgacactgtttgagcacctggatgtagccatgcctgacctccaccccattcttcctggtgtcctgagctagtaaatccccttttttagctgaagaagtctgccttgggtttttgtcacttgctgccaaagaatctttgctgacccagtcatgcccacatctgtttatcttattgggcatacccctcccagcatggaggcagtatggaattagtgtcgccccactcattagagaaggcacgattggaatccaagccctgtacctttatccaggtgttcttctgtgggccgtcccaccaggaggagcttgaagtagaggaaggcagccagcatcagcggcgggccgggcgggtggggggtggaagcttctggaatcggagggacctgagtctgaacgccagccagcaccaccgtccactgaggtgtggcctcagcaagtcacctctcctctctgagcctgtttgtcatctatgaagcaggacgggaacagttgctgccgcgccagctgtgctaagtggaagacatgaagtgcagcatcacgtccttgcgggacctggctccgggtttgtcgtctccctggctgtgccccccagcctcctgcatggagccttctccccttcagcactgaccaccgcggcccttggtgatgcattgttaaaatgccagaacccaaggttgcaacataaaaagtttccatttctcatcccagagaggccttgttaggaaaatatttgtagctggttgtttgaaaagtaccctacagtttggcctggatagggtaacccaagaaaaggaaaaaaatttcccaagccaaacgtctccctggccagctggagtgtggtcttgctgacagtagctgcaggctgtagcccacccgggccggaaccgggtggaagagagtagaggactcccttctaaggagaactgcccacctccacccgtgcggctcccctgaggtagccccgccatgtgctcctttccgggggtgctgggcagggcagtgggcacaggcaggagcccctgccagctctgggctttgctcctgagtttacttgggatgtgctgcgtgccttggggcctcagtttcctcctctgtaacatggggaagtaacaagacctg

SEQ ID NO: 619 - DNA, 57932 bp, Human
gccaaggcaggctggtgtgttgtgacatatcaatccacttctgtgtacctgcccttccccgtccagcaaaatatcatcatttttaatatatgttgtgatactaaaatatttcagaagtgttgaccgagtagacattcaataatgattatagctgatacttacagagcacctactatgtgccaaacactgtatgtattttaactcatttaatccttgcaacaatcctgttaggttggtattgttattctcattttgcagatgaagaaatttgaaaagacttgcccaaggtcacagagatgagaaatagaggcatcagcatttaaacctaggcaatctagaaccagagggtacatttaaccactatacatctcccctaaatacatctttgcatcacacctgttatctcagcactttgggaggccactaaggccggaggatcgtttgttgccagcagttcaagaccagccgggtcagcataccaaaatcttgtctctccaaaaattttaaaaattggccaggtattgtaggggcacctgtagtctgagatacttgggaggttgaggtgggaggatcgctagagcccaggaatttgaacgtgcggtgagcatgatccagccactgcactccagcctgggtgacagagtgagactgtgaacaacaacaaaaaaatcaagtttcctggatctatacaaaattttcaatttaacaaatttttataaaaatttgttttaaaataaacacccctctaaatggcaaagctagaacagaatctggtcacaatctataggttagatataggatgacagggaggagcaagagctgaacacatcagctgcagcaccatctactttgcctgcgactccgttagcaggcccactttgcccttttataaattatctgatcaacaactaagagattaaaattcgatctatgttttactctatctgaatcctcaatataatgaagaactttataattgttaatttatggatataatttaagttcattaaaccattatttccttcctatatcctctcattcttccacaaaaacctctacctttgggtgtttacttttacagacacccacgcacacaccccacacgcacgcacgcacatgccttatcttttaactcaagattctcatcttcctttggggagaaacaaacatcatgagccttgaggtccattttctgagggaaaggggggggcggaggcgggatgaataggtttttacccggtattttttatcataaacggggaggtacaaaccgcaaagaaacactagtcgcttggtgggccaccacctctggggctcactgatcaatcgcacccaaactcatttactaatttaaaaaagtactgtggcaaggctcgtttacgtaagtcttggagagaagccgccgccacaatctgccgcagtctcgtgcggagtcacggccaccgagctcttcactttccccaagaggctcccacgccttccccatccccaagggagctaggcggtccctcgcggctctgagtccctcggggaaggccgcgaagagaggccgcaggcgccctggcgagaagggagggcgggggcagcgggcggcgggcagcacccgggctccagttcatgaccccgttattccacagaaaaatggaacattccgctctttccgcccacagaggggaggtggggggaacccttcgatctagtctgggagaggcgacgcggacgcagccaccggaatccgggacgcgaagagccgcgttacgggaatcgctacccctcggagtcccgccccctcgtcgacaggcggccactggaccaatgcctgggcgcaaagggtctctcaggggccaatcagcgcctaggtcccggtagggggcggggcgcagcgttggccggccgggggcgcagctgggcgggattggggagcgccccgccccgccgcgggactggggtggcgcgctacctctgcggagaaggatctgacagtgttccggagccggggcgagcagccaaaaggcccgcggagtcgcgctgggccgccccggcgcagctgaaccgggggccgcgcctgccaggccgacgggtctggcccagcctggcgccaaggggttcgtgcgctgtggagacgcggagggtcgaggcggcgcggcctgaggtgaggaggggccgggtgctgggtcgcgtagctggagttagagtgtcggtggtttcggacgggctatctggcactcgaggagacctcccttccccctgagagcagcgcccggaacttgtcagcccagcctggaaatccccacattccttccccttcctgctcccggacctccgaattctacttccacaactttgtcacctcgattatcgcagccctgagtacaaacttcacccaggcgcacgcacgcacccctcttaacgcccgccccgcagaacgcccttcaagaacaaacccccctttttgttaccagatcccacgtttttcccaatccccttttcatctcccctgaaattctattcgctccgcacttgtcttcattctcgaggtggatttcccttccccaaagccgttttttcatcttgaaatcgtaacgtttcagctttgttgaaagttcacaatgcttataaacactattaacgtttctttccttcttttgatcttttctattaataattatcattcctaacgaattccacatctcactgtatcccaaggagaacaaatcagtttttaaaattttacctcctccgacctaaacttttgaagatagtgcaggaagcaagggtctgttcttcagtggatgaacagcattttatttcataatccgaaactgaaaaaaaaaaaaaatcacaggttaaaaataagacgtcaccttttttttttttttttttttttgccttcagaaggaaacgcattttggcttagtttgtgaagtatttcaacaattatactgccttaaaataactagttattagaatgccagggtgaattttctgaaagattgtggtatttgcttttgacagtgctgtaaacaaaccctttaaactgtgtatgactgccagcttcaagttggaacaactcttaatttgaaattacggactcagatcatcagtttagctgtgtgccattatgttaatttcttaaattcatgttaattcctatttggaagtatttttgaactatgaactgaaatattacatttatagaaccaacttgctattaaattgtgctttccaactatttctctttagggataatcttgaacgtttgtttttaatcttgagtgaaagaaaaaaattacaggaaggagaaagtgtcaaaaaggacagactgtagtgggatttttttcttattttaagtatgtattgacaataccagtttaattttctcacaggcaatttagattattataaatactgctgccacctaatttaatataatatagtcttacgtaactaaaaatgttgttctcactcttatttgtgaattgcagtattttcaatttatttaaatttgtttccaaggctttgcacttcagttcagtgttagggcgaaagttaaatacatgtgaagtaggtgttaaaatgtcccctttatagagaaggaaacaggagtctcgctgaaaactagatctgtgtgactccaaatcctgtgctctgaatcattttgtcatgttgacacgtttctcataaaaaccccagtgccacaatttggtttgggaacttaagggcaacccataaatcctctacagtggcagggagggattccccgctccctcctttcagagctgctcattttaatgggagtcagaattctctggccctaatacatttgcagcttggctcctagagaagcatggaatgttctcacagcttctccgtttctttgattgcaaaggcagaatgatcagagttgaggttcctattgtgctttattattttacacagcaaatactaagcaattactacctgctgtacgaactcacaaaggtgcaggagatgtaatcaggaccttcaaagagtttataataattggattgacaaacttatacgaaaaaaactacaaggatgcaaagcagttttaattaaatgcagagtgatgcagaaaatcctgtagatattaaaattagggaatgatcgtttaaggattggagtgagcatttaaggattggaatgagcaaaggatttaccagaagttggccttgaaacctgggtaggatttggataaagggaaaaatgaagacagcccattaataatagcgaatggaggacaaaatgtagaatggagaatatagaacataatataggactagcttgtggaaaggatcagcagtaactaaggtctattaattaaaacaggcaatatatttagtgcttatgttgtgccagttgctgttttgagcactttgcccatattaaggcatttaatcttcataatattatgaagtaggtctaataataataggataaaatcctctttttacacatagggaaacccaggcacaagaaggttaattaatttgcccagctaagtggtagatctaaaggtcatacatagacagcctggcttcagaatctgacctcttaaccatgatacatcctgcgtctccatacagtacgcttgagcgacagcgagtagatagaaaataagatcataccagaaagtctataaaaacccacccttaattgtccaccaggtgcctcaaactatggtagattctgaggatatcaagatatgtgaaacaattactgtgcagtgttctgagtcctgttagggaatgatgtaagagtacactgacagcaaagatgtttgaagtggggggaaattccatataagagatgatacttcaaaagcagtttgtagtgcacagcagagtcaggaaagacattggaataatatatgtagaagcacagactgaaagaacaaggtatgttagaggaagtctagtggtttgctgagtctacagggatggttagtagggagtgatgaaagataagaccgaattataaatggcatggtgtggtcaagcaaaatgaggagcttaagtatttgctttgcagtttggaaactacaagaataatttcagcattattggagtaaaaaagccagattgcttgcaattgcaagcagttctctctagaagtatagtagtaaggtagcttgagggaggagtctgaggaaaggatttttttttttttttagaatagagaaacttgagtattggaaaagatagattggataggcacatcaaagccaaaattttaggttcttaaatagttagaatatttggcattattattcaccctttaaaaagctgttgaggagaagaatgacaggtttaaagttgtgttgtagagagagtgatccaccaacaatgttcagaatgcttggtggggaggaaagagactggaagcaggaacacagttgaaattattgaggtgatcaatgtccaaattaggttagtttgtggtagagagtaaaaagaagagatgggtgggaaagatattatgggagagaagacaggataagatttgtaactgagaaaagctaaaatgtactgcatagatgagagaaacgatggactccattgacttaggcagttgaagaggatgagttgtttgtagatagggaaaaatggtaagtccttgtgactttttaaaaagtgtgtgggcattcatcccattactgggcatatacccaaaggattataaatcatgctgctataaagacatacatgcacacgtatgtttattgcagcactattcacaatagcaaagacttggaaccaattcaaatgtccatcaatgatagactggattaagaaaatgtggcacatatacaccatggaatactatgcagccgtaaaaaaggatgagttcatgtcctttgtagggacatggatgaagctagaaaccatcattctgagcaaactgttgcaaggacagaaaaccaaacaccgcatgttctcactcataggtgagaattgaacaatgagaacgcttggacacagggtggagaacatcacacaccagggcctgtcatggggtagggggaggggggagggatagcattaggagatatacctaatgtaaatgactagttaacgggtgcagcacaccaacatggcacatgtatcatatgtaacctgcatgttgtgcacatgtaccctagaacttaaagtataataaacaaaaaaagtgggtgggcatttatgtgtatatgtgttcatgagcatgtacctatggtgtattgtttttagacctcttaaattgataagactcagagacagaatatctaagaagatgaaatgtaactggaattaaaagaaagatccaagccaaaattcttgaaattattttgtttgaaggtagtagttgaagtcatgtcttcaaagaagttggtatttaaaaagaaaagtcgatgcccagtactttatctttgggtaccttcatagcctggagataaaagctagcagagaattcagtaaaggagacaagaaagaggataaaggaaagaattcaactacattatctggttacatagaaaccaggatataggagaaattcaagaaccagggatggtcaacaatgtgaaaggcttcagaaacacttgtgatatatatagtcaaaatggctacagtctcttcttcttcttttttttttaaactttgcggctatctagtgtatcttagtaagatttaataagaaattagctgattgatcgtgaataagagagctacattggctgaaaaatggctatagtatatagatgattgttttaaagctgtgtgtatacatatccagagcaggagattcattcctttcagcactgtaaatctgttgccctgttacatttggaatgttctgcctccaaagtttcattttcttttaagcaatcagcttcaccctttgctctaaggttgattgatctgctcagtctttttttgtttggatgttctgttttatgtattacccccaaccccaccccctagtgcaaagtgagttaatcagagctatgtttcagatagcatagctctggttagactggcatgctctgggattttgtcattggtaatcttcacttgacaattagagtcaaagatgatgtagagttcatatgtgtgctattttctctatctaggaacccctacccttattttaagactgggcgctcctggcccctgtctgaattgggtattttctgtgctcctgtggcactttgtgcatattctgcatctctaaactttggacttcttaaaggcaagaactatttatatggcttcaattatgtttgtaacggaataaaaattgaataaaagcttgagcttttatttcttaagcaatggtgagaacatggatgttcatcaaagtgctctgtaaaccttttcatttggctaaaatagtctaattttaaaaggccctaaggtcataagcatattctatgtgtttttcaatatgcttataattttgcttttgcatttaggtccttaatctggagagagagtgtatgcttatacatgcatgtgcacgtgcatgagtgtgtgtctttttgtctgatgaaatggggttcttttttttcttttttgcttatggagccagttgtcccaatactatttattgaatagtcctttattttcccagcaaatgagcaaccttttaaaaaatcagatactaaattcttatatacacttgagtgtgttttgttttgtaccattgatttagttgtctattcatttgccaatcagtgctatgtttactttacctttagactgccctttttttttttttctgcgagactttttttttttttgagacagagcctcgcactgttacccaggctggagtacaatggcaagatcttggcttcttagcttgctgcagcctctataagcccaggctcaagtggttgtcccacctcagcttcctgagtagctgggattacaggcatggtccaccatgcccggctgatttttttttttattttttttttattttttatagagatggggttttgccatgttgcttaggctggtcttgaactcctgggctcaagcaatctacctacctcggcctcccaaagtgctgggattacagccgtgagccactgcacccagccttctgttacattttctaattagttattactggtatgtaggagagcttttttttttttttttggagatggagttttgctcttgttgcctgggctggagtgcagtggcgacatcccggctcactgcaacctccgcctactgggttcaagtgattctcctgcctcagcctcccaagtagctgagattacaggtgtgcgccaccactcccggctaattttgtattgttattagagacagggtttctctatgttggtcaggctggtctcgaactcccaacctcaggtgatctgcctatctcggcctcccaaagtgctgggattataggcgtgagccaccgcgccagctggagagctattttttgatgatgttttgtttgactgttatgttaaactctaaatagtcctattattttttgatgatgttttgtttgactactgtgttaaattctcaatagtcctaatagtttgtcatgtgattctcactctttcttgatagatgatcatatcattcacaatttattttccatttttagatcttatttattatatttttgcttaagccctttagagcagtggtgaataactgatgacttcaagcatcttgtctgaatcttgacattaataggaacgcttctaatttttacctttaaacctatagatgcttattataggtttctttcttccttttttttttttttttggaggcagagcctcactctgtcgcccaggctggagtgcagtggtgcattctcggctcactgcaacctctgcctcccgggttcgagcaattcttctgcctcagcctcccaagtagctgggactataggtgcccaccaccacgaccagctaattttcatatttttagtagagacagcgtttcaccatattggccaggctggtctcaaactcctgaccttgtgatccacctgcctcggcctcccaaagtgctgggattacaggcgtaagccaccatgcctggccttgtaggtttcttatagtagtacctgtggcagcaacagcaagagctgcactaataataacagctgttaaccttttattgagtagttacaatgagccaaatgattctaagcactttatgtataatgagttatttaatcatcataacattcctagatgggtaggtggtggtggtaccccatgtttacagataaaggaagtaaaagtgaaggctatttaaaaacttgcctaagatgttaaaatatagggactgaaatttgaacacaagcaatctggttctagagtccctgtatcatctttgttatccttcaccaaggtaaggatggtctctttcagtcttagttttctgacactttgttgttatttttaagttttagatgaacagttgttgaatgttatcagatgcttttcaaacatctgttggaatgaccctgtcattttcctttggtctgttaatatagtaattagcagtatcttttctcattttgaactgtgcttattttaggctaaatacttgttagcattcacactttggttttgttttcaaatctatttagacttttctctaaccatactacaaaaaaatgttaaaggcagtttttcaggcccaaggaaaatgataccagatggaaatacggatctatacaaaggaattaaaagctctagaaatggtaaccacacgagtaaatatgtgccagtctcactctgtcacccaggctggaatgcagtagtgcaaccacaactcactgcagcctcgacctccaaggctcaagcagtcctctcacctcagcctcctgagtagctgggacaacaggcatgcaccaccacagctgtctaactttttattttttgtagaggcgagagtcttactatattgcccaacctgatcttaaacttctgggcttaagtgatcctcctgccttggcctcccagagtgatgggatttcaggtgggagctaccaatgtgaagttttaatatatgcaaaagtaaaatatatgctaaaatagcacaaaggtctggggggagaaatggaagtatactattatatactatgcctgaggtgacataatattacttgaagatagattgtgaaaagttaaagatgtacactataaacctaaagcaaccaataagaaaacaaagaattatagcttattagctaacaaggaaaagagaataaaaaataattaagaaaaataaatgcagaaaagtaaacaggaacaaagaacagtcaagaagaaaacaaatatgaagctgatagctttaaacctaatcatatcacaaattatattaaatgtaaatggtctgaacacccaattggaaagcagagattatcagattggatacaaccacatgctgcctaccccctaaagatgccacttaaatatgaagaaacatacagattaaacaaaaaagaatgggagaggatatgtcatgataacactaatcaaagtaagacagaattggctatagtaatatcaaagtagatttcagagaatgttaccagtggtaaagaagggcatttcctaatgataaaagggtcaatttatcaaaaggatctaccaaataacatagtttcaaaacacaacagggtaaaaactgcaaggagaagtaaatccacagttatattcagggatttcaatatccctttttgaacaatgatagaagtagtagtcagaaaatcagtaaggatatggaagatttgaacactatcaaccaaattcacgtaatgaccatttatgtaacactctaccagcagcagcagtgctttttaagtgcacacagaatattgatttcaagatttataaggctaaagtcatcacgacagtgtggtggtagcatataaataagcaaattgatcagtggaacaaatagagtaggagtcatcctaccttctgttttcataaagtactgttagaacacagccacccctgtttgtttatgtattttctatggttgcttttgtgtcgtaacagtagattggtagctccaatagagaccttatggctcacaaacctagaatatttacctcctacctcatacatgaaaagcttgcccaccctggaattgagagtagccaaatagacccacacctgtgaacaactgatttttaagaaagacgcaaaggcaattcacttgagaaaggataattttttcagcaaatagttttgaaacaattatccgtatatacaaaatgaactcaaatttcagcttgacaccacacataaatattaacttgaaataactgagacctaaatgaccctaaaactataaaacttgtaggaaaaaacctttttgactttatttttattttttatatttttttttttttgagaaggagtctcattttgtcacccaggctggagtgcagtggtgctatctctgctcacttgcagcctcctctgcctcccgggttcaagcagttctcttgcctcagcttcctgtgtagctgggattacagatgtgcaccaccacacccggctaatttttaaaatattttagtagagacagggtttcaccatatacccaggctggtctcgaacttctgaactcaggtgatctacccacttcggcctcccaaagtgatgggattacaagtgtgagctactgcgtcgggccctttatgattttagattaagcaaagacttcttagatacatcaaaaacacaaattgatgaattgaactttattaaaattaaacctcctattcgtcaaaagatactgttaaaagaatgaaaagacaagcatacaagaaaataatgcgtaaatccattttctaataaaggccagaatatcttcttagaactttcaaaacttaatgagaaaacaggaaacccagttgatcaatatgtttgaacagacacatcatcaaagaagatatagccaagcacacacctgccgtagggcctagccattccactcttcacttaccttctattttggggacacacactatgtgttagtttcctaggggctactgtaatagagcatccctttgttacagtatcccttacctgaaatacttagtaacagaagtatattggattttggatttttttttttcagtttgtgttgtatttgcattatatacttaaagttaagcatcccaaatcctaaaatctgaaatccaaaatgccagagctcaaaacgttttggaattagagcatttcagtttttagatttgggatgttcaacctgtaccacaaattgggtggctcaaaacaacaaatttattctctcaaggttttggaggctagaagtccttttgagactttggatagaatcttcctttgcctctcctagcttctggtggtagccatcgtcgttgagattccttagcttacagctgcataactccaatctctgcctgtgtattcacatggtattcttcctggctctgtctctttaaagacaccagtcatattgtactaaaggcctattatactccactataacatccaattaaatctgcccatagagtaacattttgtgctactggggttaagacttcaacatattttttggggggaacagttcagcccataacaaacaaaaagaaaattaatttaattatattgtatttagaacaggggttggcaaactatagcccataagccaaatccagcttgcagccatttttataaataaagttgcatgggaatatacctatgcccacttatttacatattgtgtatggctgcttttgcactttaataacggagttaactaattgcaagagagaacttaaagcccacgaaatctaaaatatttattatctggccctttacagaaaatgtttgctagcctattttagaaggtgttaagtgttgtagaaaaaaaaaaaatcagtaaaggggtataagaaacacagggtggttagggaagatctctatgaggaggtgaatttgagcaaaggctacaaggaattactctctatatattaacttatgaagatgtccactatgtagtgttaagtgaaaaaggttataaaacatttctcacttacatgatcccatctttgtaaaatagaaaagtgtgtatatttatacaatgtaaagttatataatacatgtataaaaaattttgcaagaatatccaccaaaatgttcatggtagttatctcttggtgggattatagtgcactttcacatggcattttttcagtttcttttcattagacatttaaaaaatatttttataaatttaattccttatgtgttattaagttatatcaaaggcttaatgtgtatgaaacaataatggaagattcaactccttgcctaagtttgaagttacttgttgtatttcaaagaggagcactagtacttaagctagaatttaagtgaacaaatcttaaaatggatttttatctctggttacatagaatagttgttagcaggcttaatttagtgctagtagaagaagaaatatgtgattgttaaagaactccgtctgtcataaatgttcctgtcatgtttctgtgacattacatagacgtcagggaagtttgcattaggtgtgggtgagccaataatgtttgcaagcgtatatcaaatcatagcactagggctgggcgcggtggctcatgcctgtaatcccaacactttgggagtctgaggtgggcagatccctttgagctcagcctgggcaacatggcaaaacactatctgtactaaaaataaaaaaattagctaggcatgatggtgccatctctagtcccagctactcgggaggctgaggtgggagaattacctgagcctgggaagttcaagctgcagtgagctgtaattgtgctactgcactgcagcctggtgatgggagtgagacattgtctcaaaaaaaaaaaaaaaaagcactagaatatttgaatactcttatacaagtgtttatgggtttattttattctgaagctcagaacatatctaaagtaggatactttctgcaaacccaaaagcctaagagcagatggggatttttaaagtacacatataataaaattatcaaagccagccttctgaacaagactctcctctctttacagtgaaacccaatggaaaaagcatgacatttagaagtagaagacttagcttcaaatccctactccttcacttactaattttgtgatttgggtaagtaattgatcttgtctgaattttttgtttttttattttacaaagttccaataaataatccctgccctactcacctgattctttaggatattaggagactaaagtgaaataatttatgtgacaacattttgtgtaatgtaaaataatatcctagtgttaattgttatgaactcataattgatactaatggaagagaacagagtggataatttaaaaactaatttaataattagttaattttgtgtaggtattaccaacttctggcagtttattcacagtaacactgtactgtgaaagatatatagaaattttcttcatcttgatccccacgcaacttattaattcaacaagcattattttgccttctatttggcaattttagttcatatactgttctacaattgtaatagtaatgttaccatagtaacaaagtttatattgacattctttttcacatgcaatgtaaatctaaatatattcgtgctttttatttcatccttaggttaagttagaaaatgaaaaaaaaatcacaatccataggtgacaaaaataatttataaagagcctaaccattaaatatttatccattgtaactctactgctttttctctcacttgagaaaacatatggaaatgaaagtaaatgagaatgaacaactatagggataatcttgaatttattctattttaaataaatcatttatgaactttgtttctctaacattaaaagtagcaatacttgttatacatcatctagctcctttcggcacactaccatgttatatcaccatagttgaggaatgattacagcttttggttttcagaaataatctttcctgtatttatggttactagttaggttttggcttcatagaagcttctcaagttacctgcaaatttcaaggaaggttagtgtatgcaatgtatggttataatatatgcatagaaaactctgcaagaggtgaggtaatagtgctattaatataattttaaattaaatattagtatcaacagaaggaaaggagggaaaaaataagcaaactactgtcaattctgtcaatttttttttttatttttttgagatggagtctcgctctgtcacccaggctggagtgcaatggcacgatcttggctcgctgcaacctccgcctcccaggttcaagtgattctcctacctcagcctcctgagtagctgggactataggtgtgcgccaccatgcccggctaatttttgtatttttattagagacggggcttcatcatattggttaggctcgtcttgaactcctgaccttgtcatccgcctgccttggcttcccaaagtgctgggattacaggcatgagccaccgcacccggccataattctgtcaatttttaagcaagccccaagtgaagttaactgtattgcatataatattttatatagtgttactgtgtcttcatctcttagatttggactatgaaatcaagtcccataatagatgtttcttcatcacctctccattacaatcttttaaaaattaggaaagattactttctaaatgtgaaatgtggaatctacctttgcctagttcgctttgcttgtgttccatggtactactcaaacaaatctaattgctttgaagtaatcataaattctttcatggacctcttgttctggagcagctttgttgcaagaatatagtacatttggcttggcacagtggctcacacctgtaattccagcactttgggtggccaaagaaggaggattgcttcagaccaggagtttgggacctgcctgtgcaacatagtgagacccccatctttacagaaaaatttttaaaaaattagctgggcatgctggcaagctgttacatgattagggagtgcataaaatcaagttagtatgtatatttaataaaacaatattgtgttccaagtgcagaactaggaagccatttctcatcaagaagagttaatagttttatttagaagaaaaaaattacacattaagtattttgtctttaataattttagcttttattttaggttcagggagttcatgtacaggttacatgagtatattgtgtgatgctgaggtttggagtacgattgaactgtcacccagttggtgagcatagtacccaatagtttgaaccttaagtatttatttattttatttattttttgagacggagtttcactctgtcgcccagcctggagtgcagtggcgccatctccgttcactgcaacctccgcctcccgggttcaagtgattctcctgcctcagcctcccaagtagctgggattacaggtgcccaccaccacgcccagctactttttgtatttttagtatggacggggtttcaccatgtaggccaggctggtctggaactcctgacctcagatgatccacccacctcggcctccctgagtgctgggattacaggcgtgagccactgcacctagctgacattaagtattttttaatttaaatttattttttgcataagtactaaagattcacatggtcaacattgcaaggctgcagagtatatggtggagcgtctccctaccaccctgatctctcaaataccctgtcacagccagtatttgaacttttatcctcctagagatactgtgcatatataaaaaaacgaatgtgtgttttgttttcttgtatattgttttgcccacaaataatagcaaatgcgttgttctgtaccttaacaatgtaacaatgtattttagataactttatgtttctgtacatatagagcttcctcattttttttaaatggctacaagtatttacatttacatggttttggtataccatcatttaactagtgtcccatcataatcaggttgtttcagccttttactgttaaaaacaatgcagtgaataactttgtacatgtgttgttttattcatatctgtaggataaaataaagtagaatcattagaatcaaatgtgtgtgttttaattttgattgatattgccgaactggctctctgccttgtttgggtagagcttttttctttgtttttaagtgaggtctaatttacaaacaacaaaactgaccatttttaaagtgttcaatgtattgggaagcttatgccaatttacactataacctgtagtgtgtgacgatactttcgttgcttagtctcacaacaccctgttgatactttttgggtttttatatttttgccaacactaatatgtaagaatggtattgggataatttttggtttgtttaccttttgttacatactgcaaaacagaactcataagtgtacagctcagtgaatttatcactgtccagatcaagatacagaacatgctcagcacccagaatgtccccttttatacccttcctcacaaaaaacaactgctctgacctctgtcaccaaacaccgtagacttttgcctctttttgaacttctgtaaaataaatcatgcagagcgtactttcttgccttttttctcttttaaaatttttttgtagagtcagggtctcactattttgtgcaggctggcctcttaactcctggcctcaagcaattcttccccctcagcctcccaaagtgctgatatgacaggtgtgggccactgcacccaacctgtctgatttctttcattctgtattatatatgagattcatccatgatgcatgtatctgttgttatttttcattgctgtgattcaattacttgaatataccataatttatcctagtgttaatagatatttggttgattttatttttcatctattttgaataaaacttctgtaaacattcttgtagatgtctttggaggtattaagcactcgtttcttttggttataccttatctgggcagattttgtttgtttttaaggtctaatttataaacaataaaattcaccattttttagttacaacttgataggaaacccatgagtctaacatttctgcgtttcttatcagcaaaaaccctgatggctgccttttttctgaactttgttttgagacggagtctcgctctgtcacctaggctggagtgcagtggtgtgacctcggctcactgcagcctccgcctcccaggttcaagcagttctctgcctcagcctcctgagtagctgggattacaggcggccgccaccacgcctggctaatttttgtatttttattagggacagggtttcaccatgttggtcaggctggtcttgaactcctgacctcatgattcactcgcctcagcctcccaaagtgctgggattataggcgtgagccaccatgcccagccaacttaccttttaaagaatgttggaaggtagactctcagagccgtggagcaaaggacaggcttacttacagtcttcaaagatacagataatgtctccctctagagtaaatggcagacatgcttcctgcatatttttcaagtttagggttacttaagatctgtctttctttcctgtgaagcagcctgttcaggtgtcatctgacttcacaatgccctgtgacagttgggactcaagcagctggcgcaagaaaatgctgatactctgactactgttatgagtaatacagtcctttgcttctgacgcaaaaatgtcatgccttttgccagtatccatgacactgtggtaggctgacttgttagcttgaaagtaaggtaaaatctcagtgcctttgaaacagttgacacagaattcagtgaattttgacaaatgtagtctttttttttttttaaatagaatttcgctttgttgcccaggctggagtgcagtggtgccatctcagctcactgcagcccctgccttccgggttcaaacagctctcctgcctcaagcctcatgagtagctgggactgcaggcatacaccaccacacctggcgtgtgtgtgtgtgtgtgtgtctgtgtgtgtcggggtctcgctctgttgcccatgctggagtccagtggcatgatctgggcttactgcaacctctgtttcacgggttcaaacagttctcctgcctcagcctcccgagtagctggcatcacagacacccgccaccacgccaagctactttttgtatttttaatagagatggggtttcaccatgttggccaggctcgtctcgaactcctgacctcaagtgatctgcccacctcggcctcccaaagtgctgggattacaggcgtgagccatcgcgtcctgccaaatgtatagagtcttatagtcaccaccacaatcaagtcatagagtatttttatcaccccagatttcctttatgcccttttacgtgtgccttctctacctcagccctaggcaaccctggatctgctttctgtcaccttagttttgccgtatcaagaatttctgaggcacatgcctgtaatcccagtgctttgggaggctgaggcaggaggattgctcgagcccaggagtttgagacagcctgggcaacatagtgagacccccatctcttaaaaaaaaaaagaatttcctgtaaatagagttatacaatgtataacctgttgtgtctggcttcgtttattcagtgtaatgcttttgagattcattcatactactgcatgtatcaccagttcatactcttttttttttgtttgctgagtagtattctattatatgtctctaccattgtttgaatgtatgtttatacattcagcagttggtggacatttggattgtttccagtttgggacttatgaatgaagctgctgtgaacatttgagtataagtcttattgtgggcatatgtttttattttggggagtacgctctttggagtggaaataccaagtcttatggtgtgcttttaacttggtaacgaactatcaaattgtttaccagagtgtctgtatcattttgcgttcctatctgagtagttctaatttatatctctcattttgagtgaggttgaaagtatcttttcacatgcttgatttacttgtatttccttttctataaactattcaaatatgtttgcctgttctattaggtgttagaattttttagtgatttgtaggcattctttatatatcgggaaaatttttggccatgctatgaattacaaacatttttttccatttgtcaggtatcttttaaggatacatattatggtgagttttgccatgtagaaatttgtcagtctgaagttcttaatctcacagttatttactaatataagacttcacataagaaagaaacaagatatctcttttaattaaccttaaagtataaattatgttttctagcagtgttttccatagccataacttcagtgggaataaagaaaaataatgtgaagacttaagttttctacattctcataagaattttaccaccttttagaaacacagctacagcatggaaacaagattgtgtcttaaattatgtgtatataagagaaaaaatattaaaagtaatattacatgtgtctgttgcagaaatatccgcgcaagatgttgacgttgcagacttggctagtgcaagccttgtttattttcctcaccactgaatctacaggtaaggttcatgaaataccctatcttctaacttcacaaattaggtttatatatttttatattattatataattaagcttatgtttaattattatgttcatatattctttctaggataatcgagagaataatatcttaaattgattttaataaaaatattcttgataatctgtttttgtataatttgagttgtaacagtcatcttacatgctaagtcagtaatttaagtcagtaatcttaaatgctgtatatcaatactaacaataactttaaaatggggaaggaaagaagtgtgtgggtttttttttttttcttcagtaaatgaataggagaaaatttgttaaatcttgttaaattttacgtcattcatactacatgctcttcaggtattgaagggctgctttcctgtgtctgtaagtcctcgtccccaaattacagttacccagatatctaatcattctataggatctggtttttaaccctgtgcatgctgattaccctactgattcttctcttagttgcctgtattacatttaaaatagaatactggctggacatggtggctcacacctgtaatcccagaaccttgggaggcataggcaggaaaataacttgagtccaggaattcagtctgggcaacaaagcaaggccccatctctacaatttttttttttaattagccaagtattagtccattctcacactgctataaagaaatacctgagactgggtaatttataaagaaaaggtttaattgattcacagttctgtaggctgtgcggaagcatggtggcatctgcttctggggaggctttgggaagtttccagtcatggcagaagacaaagggggagtgaggcatctcacatagcgagaacaggaggaagagagagagaaagggaaggtgctacaaacttttaaatgaccagagctcacaataactcattcctcatccaccatctcgaggcagtaccaagtgagaaatccacccctatgatttaatcacctctccaccaggccccacctccaacactggggattatgatacgacatgagatttgggtggggacacagattcaaaccatatcatgcctctagtcccaactactcaggaggctgagccaggagaatcatgagccctggacctcgaggtcacagtgagccatggtcacgccattgcactctatcctgggtaacagagcaagaccctgtctcgtaaaaatatttatgtgtacgtgtgtgtgtgtgtgtgtgtgtgtgtatgtgtgtgtgtgtgtgtgtatgaataatactatcccagctgtcccccttactagctgtaggaccttggtcagtcattttctgtacctcaatttcctgatctatgaaatggtgataataaaggccactacctcctagggttattagtgaggattaaagaagttaatatagaggccaggcatggtggctcatgccagtaatccaagcactttgggaggccgagatgggtggatcatttgaggttaggagttcaagactagcctggccaacatggtaaaaccccgtatctactaaaaatacaaaaattagccaggcggtagtgccgcacgcctgtaatccccactactcaggaggctgaggcaggagaatcgcttgagcctgggaggcggaggttgcagtgagccaagattgcaccactgcactccagtctgggtgacagagtgaaaccctgtttccaaaaaaaaaaatctgagcttggtagcacatgcctgaaagtctcagctacttgggaggctgaggtgggagagtcacttgaacccgggaggcaaaggttgcggtgtgtggagattgtgccactgcactccagcctagggtggcagactgagaccctatctcaaaaaacaaccaaaaataagttaatatagaggaaatatttggacagtgtttggcctacagtaagcattataaaaatgatagttactgcatatttattataaaggttattgttgtctttgaataaaagtttctttatgaaaaaaataaacgtaatataccaaaaccaatctgactacagtggcactcatacttactttgatctgaacatcatttttataaagttacgtaactatgtggtagctgagatatacccttgtttcatgttgagctagtgatcagtgaaaattctcaggtggtttttacatgagttactcttaaactagttctccctcacccaatgtatatttcttattacctaaataggatatatttcctctgttgctaatttcattttatcagttttagcctggtgttctactctttcagcataattttaaatcccaacattttcatccgaagtgttggcagttgtttgtagtcctgtcctctgctaatttgataagcatgtgtgtctgtcttttcccaagttgttgattaaaatgttgaaaataacaggactgcattagctacctgttgctgcctcacaaatactccaaatcttcaaggcttaaaatgataataatacctctcatgatttgtataggacaagactatagataggcaggcacaatcagacgtattcatctttgctgtacaatgtctggggcctcagctgcaatattcagactgggggctggagtcatcttcagactccttcgcttatatgtctgttgttaatggtatctgcaggctgagggctttgctggggccattgtccaaaacaccatacgtggcctctttttatggccctggctttcttacaatgtgtggctgggttctaagggcagatatcccgggagagagaaagaaagctaattggagtctgtattcttttaatgatctagcctctgaagtctcatagcacactccattggctggagtggacacaaggcacccatacagatctgatgtggttgggggaaatgcagtccccacctcttcatgaaaagagtatgcgtgacatcgtaagaaaaacatgtgggatgggataaatatgtaggtgtggccattcttaaaatacagtcttctccaaggattgagggcatgcacttcagcatattctacttaagactatcctctaattgacttttttcttaagtcagtttttttatatatgggtaatcaaatataaatttgagtatgaacctataaaagtagcaaaatatcagcaatttcataatgttcattgtaatatcggttatagtatattctttttttttttgctttttttctttttttttgagatggaatctcgtttcgttgcctaggctggagtgcagtggcacaatctcagctcactgcaacctctgccccccaggttcaagcaattctcctgcctcagcctcctgagtagctggaattacaggtgcaggtcaccacgcccgggtaatttttgtatttttagtagagacgggatttcaccatgttggtcaggctggtctagaactcctcatctcaggtgatccatccacctcggcctcccaaagtgctgggattacagacgtgagtcactgcgtccaacccagttatagtgtattctaattcacatttcttcatcttgccctataaacattcaaaataactttatcagatacctttcttaattaaaatactttctttttacaatttaatctcagcctggtagccctgtaaaatgggattaatttgacatgggatggtattattgaagctgtgtctcactttgaaaaacggaacatttgccccttttttttcgagactgaatctcactctgtcgctcaggctggagtgcagtggtgtgatcttggctcactgcaagctccgcctcctgggttcacaccattctcctgcctcagcctcccaagtagctgggactacaggcgcccgccaccacgcccggctaattttttgtatttttagtagagacagggtttcactatgttagccacgatggccttgatctcctgacctcgtgatccacccacctcggcctcccaaagtgctgggattacaggtgtgagccactgcgcccagcccatttgcccatttttaatatttctcttattctgtgtgattaaaaattattcatactgagtctctaattatatctttttagaactctagagtatatttcatatttaacatccctatgattactttagagaaagtataacaagtgattttgccaaagaataaagtgatgtctagggaattgtaaggtctgacccagtatcagagagtaacttagtagagattctccactggatgaaggaccatgctattggaaattgagagtaatatatgcactaagatttacagtaggcatttataaataacagcaagatgatataaacagaccacattataagtttgaaacaaagaaatacacattccagctctgggttttacaggctttgtgagaggtcctgggattccatttggggatacaattttgactgcaaaaactgtttttaattttttctgggctcactgcagccttgacctcttgggctcaagcaatcctcctgcctcagcacacgaccctcacccccaagtagctgggactacaggcgtgtgccaccatgcctggctaatatttatattttttttgtagagatggggttttgccatgttgcccaggctagtaatttttaatctcaaaaacacttcatgggtaactacccaggaaccccacagcaaataggattcattgaggaaagccaccttaaaattgtggacattgaagctagagaaaaagaataaaatcatgtcaaatagttgggacttttatcttggtagtaggtagccactaaataatttaaagtagacaaatgtcctaattattttagaacagtaactgacagtagtatgtaagataaactggaaggaggtcagactgatatagtatcctgtgcttcagcagtcaaagtagcattggaaagaagatgttgatatgcttattaagcatatagaaccaatacagtgcactattgttaagttggaggttagaggaggctaattggagatgttggaagatgactacagagtatctgtcctggatgtctggatgggagtggtgctgttagcagaggcagagaaataagaataaaaaataataagtttgaaaagattatgatacataatagttttggacatgctcatttaaaaatagctatgggatatctcaggtagatatatgtctaatgggctattgaaagcatgggggtttagtgctagagatagggattgagatgtcatcaatgtggagtaggtgataggtaaagcatgtagttgtgtttaattctcttttacccaatctgattctttgtgttttgttttgtttgttttgttttgttttgttttttgagactctgtctcactctgtctcccaagctggagtgcagtggcgtgatctcactgcaacctccacttcctgggttcaggtgattctcatgcctcagcctcccaagcagctgggattacaggtgcccaccatgacacccagctaatttttgtatttttagtagagactgggttttagcatgttggttaggctgattctttgtttttaaataggggatcctatcccatgcatttattttcactctgttgtccagggtggagtgcagtggcttactacatccttgaccccttgggctcaagccatcatcccacttcagcctcccgaatagctgggactataggcgtgcaccaccatgctcggctaattttttttgtttttagtacagatggcatctccctatgttgcccaagctggtttcaaactcctgagctcgagcgatcctcttgcctcggcctcccaaaagtgctgagattatagacgcaaaccatcatacccagggccatgcatttattcttaaaactaaactatttggccatcttgttctattcttcctgttttgtattggtcccttgctgtttcctttgttgtctgagttttgatgtgtggacaatgtatactgtctgtgaccccaactgtactccacaacagcattcaggactgtagaggagaccaccactgcctgttttctggagagtttagtttagacctgggatctaaatggagggacaggatacgttgtggggcaagtatgaatcatgctgcaggcagtctgtgtttcttaaagaaatagtttataccatgggctataaagcatgaatgggtttttcttaattcagctctattatctttataatttgtatatttctttacaaattcaggcattaaattctaaccatattaattttcagttgtgtattgtctttttctgtgtctttagggatattttagtgacggttgagggactctacattgagtgctaccagctagatatcattttgtaccagaaaaattcagtccatttatatattttctattgttcctttttaggtgaacttctagatccatgtggttatatcagtcctgaatctccagttgtacaacttcattctaatttcactgcagtttgtgtgctaaaggaaaaatgtatggattattttcatgtaaatgctaattacattgtctggaaaacaaaccattttactattcctaaggagcaatatactatcataaacagaacagcatccagtgtcacctttacagatatagcttcattaaatattcagctcacttgcaacattcttacattcggacagcttgaacagaatgtttatggaatcacaataatttcaggctgtaagttttgtttttgtcttatttcagactttgtcatgactattgaactgcatttttaatgttgtcctttcatctttataaaatgtagtaacttgtggacttagtgacttggacatgtttggtttttaaaaaataagcttagaagtaggaaccacaagtctcctgtctttcctgaaagtcaagcagtttcactttactagagaaatatttgacatgagaccccccccaccacaggaaagtattgttgaattgacataatgatggtaattctcagtatcccttaattgctgagaaaatgcacgtgtaaagcagctacctgaagaaagcgaacaaatactggagtaaatcctttttttttttttggtgacagagtctcgctctgtcacccaggctggagtgcagtggcatcatctcagctcactgccctcccgggttcaagcaatcctcctgcctcagcctcccaagtagctgggactacaggcatgagccaccacgcccggctaatttttcatatttttagtagaaatggggtttcgccatgttggccaggctggtctcaaactcctgacctcaggtgatccacttgcctcgggctcccaaactgctgggattacaggcgtgagccactgtgcctggccttggagtaacaaagtaaacaaaataaacttactatgatccaaaagtgggttatctaatttgtggatcacccagactttactgttttggcatttgcttttcttccaacgagtttgggaaagcaataagaagagaaatataaatgaatcattttggcttctacttagttgcctcttacaaacatatgtatatattacttttaaaaatatacttaatggagaaatcagttgatatttttttccagttataaatgaaagttgattttacatagaaaattaatgtgaaacaaaccagttgatgacagttaggatggatgtatatatattacttcctgaaaagaagtgtaagagttgggatagaaaagaaattgtcatcagcctttcattgtgtccatactttttgcttgggtttgatttttttcatctaatttagatcgcaaatgccttgggtagtatataaattgcataatatttgtggatataaagctttctgaaagatgctaattaatcccttttagtgcctccagaaaaacctaaaaatttgagttgcattgtgaacgaggggaagaaaatgaggtgtgagtgggatggtggaagggaaacacacttggagacaaacttcactttaaaatctgaatggtacgttattttaaatttgtttcatgttagatttattaaagttagtcatttttgctggaatttttattttaccaagtaataatattaaatgctattttaaaacatttaattttttattctgtaacatttcaaatatatgtaaaagtagaggccaggcgcggtggctcatgcctgtaatcccccaggcgcggcggcccatgcctgtaactccagcacttacggaggctgaggtgggcagataacttgaggtcaggagttcgagaccagcctggccaaccagagcaaaaccctgtctctaccaaaactacaaaaattagccaggcatggtggcgggtgcctgtaatcccagtgactcggaggttgaggcaggagaatcacttaaatccaggaggcggaggttgcagtgagcccggattgcaccactacactccagcctgggtaacagagtgagactccatctcaaaaaaaataaataaataaaaaataaaagtagaaagaatagtagaatacccatacatacccatcactcagcttcaacactggtcagctcatgaccagtcttatttcaaaggtactctttgcctatattgtcttgaagagagaatcgcgggcatcatatttcatccaaagatatttcagtatgcgtctctaaaagatgaggacattttaaaaaaaagcataacaacataccactgttacactcagatataaaatattacattttcagttagtgttgatttcccctattgtctcatgaatatgcctatatgtataattttttttacatttgtttcagtcaagattcgaataagctccatactttgtgaatttatgtcttgtctcttaaattataggttctatttgttcttttttcttacatttcagttgttaaactgttatacattgtacattgtttaacatattcccttgtctttttttttttttttttttttttttttttttttttgagatggagtcttgctctgtcacctaggctggagtacagtggcatgatctctgctcactgcaacctccgcttcccaggttcaagcaattctcctgcctcagcctcctgagtagctgggattacaggcatgtgccaccatgcccagctaatttttttctatttttaatagagagggtttcaccatgttggtcaggctggtcttgaactcctgacctcgtgatctggctgcctctgcctcccagagtgcttagatgatagacgtggccaccgcgcctggcccccttgtctttttctttccaaaaaattgcttttagatctacagatttcatcagatttgggtttgattttttttttttccccaaaaaaatattttgtaggagtgatgtgtacttctgtcaggaaagaccagataatgtttcactgtttttcttttttctgatactaagattgagcagtggtttcgggtgttgtcagccttattcctttatttactaagtttcccatttgttttttccaaacagaaaagttgaaagagttttacagtgaacactcttgcataccctagattctacaattaacattttactatctttgctttatcacctatttatctatgcatccttctctccatctctcaatctatctcttttttatgtatttcatagtgagttgcagtcattaatatacctcacccttaatcacttcagtatttcatagtgagttacagtcattaatatacctcattcttaatcacttcagtatttacatgaactagagttcagtattatgtttttaaataaaatttacatatagtgaaaacacaaatcttagtgtatcattcagtgagttttgacaagtacagacacctgtgtaactcaatcagtatcaagacatagaacatgactaacacacctaaaaagttccttcctgctccttcagtcaatcccagcaagtgccccaccccatgagcaactacctgtctgatattcttcaccatagattattttttcctgttacagaatgtctcatataaatgggattatatagtatatactcttctgtgaaaagttttataactcaacagaatgtttccgaaatttaatcatgttgttttcccactagtatttcccttacagctttgagcagtcatcagtgattataatttgtatataaattacaaaactatggtattctgtgttttgttttagctgaaatacttaaagaaaaacttgcctttatcaactgtggtttaccctgaagtacagttcagataggagaagcaagataggtttaatatttttccttaattaccagttttataattagttgattccctagtatcctccaaaggtagaataatgagggcttttctttctcattataaatttatatttaaacatatttgatatgttttaactcattatggattgtcccatctttgatcagtggcagtttactcaaattggctcattcatccttttttttttttttttttgagacagagttttgctcttttgaccaggctgtagtgaagtggcgtgatctcggctcactgcctcccgagtggctgggattataggcacccaccaccccgcccggctcattcatcgtcttgacacaacttccttagcctttgatagctctctgatataacatgcttttacagggtcatcatgtatttcctcacccagacctggaatcaaccttttcccaaaactctctggtttcatttagtgtgaaataatatttacagactacaatctgggtgctacaggaattcatcactactggtttgtcatagtttttagattttttagattttttcagtcgaaagagctaggacatgttttgtggtttgagatataatactatcttttaaaaatacaaattcatactgatattttcagtttaaaattagggctataggtttttacataattatatttacctgacgtctacatcttctttcttatgaactgaaaaacatagttgacaacaacactaacataattattcatttgctttatcctacggttaatacagcagctgcagaataataacaacagtattagcaccaacaaaatgattaccaagaatgattttaagattgtttttctctgtgaaggatgtgtaatagtcagattactgtgttttaatgttacttggaatagttcttttctatgtggttatactacatactcagtacacaagttcatatgtttcattttgcttttaatttttaggaatttttcttaataattatataaaacaatccaaaaagtcaaatctattaatagtattaaggcttgttcagaaaagtctatattctattcctgaatcctctaccttatttccttctccttagaggctaaccatttttgttttggttcaatttggggtttggtttatcctatttttaaaaacagtgttgtatatgaatatttttaattgaggcataatttatataattgtaaataaatatagtaatattacttgaaactttccatggtgatagaaatcagaaagtagttgcctaagtttgactagaaagaggctaagagattttagccctaagactaaaggctaaggggtaatagaaattcttacccctaacctcctgtcaccttctagcatattgtgcttaaagaaatttgtggtacagtaagggttctgttttaggaaaaagaaaaaacagcactgggatcacaaggaaatagataatttttggagaggagtaagtggggatggagcataaaattttaaagcacaatatttttagactacaaatttgaaaataattttatgttttaagatatagatcaaagttaattttaaagaaaggtttatttttaagaaattttgttagtgaccagcagttatattgcaaagtttgctacaacaatctaggtctcatcaaactctttgcaagtaatttttttcactctaattttttcagatgtgtttttaatgactgattcttcaattttttgtatttagggcaacacacaagtttgctgattgcaaagcaaaacgtgacacccccacctcatgcactgttgattattctactgtgtattttgtcaacattgaagtctgggtagaagcagagaatgcccttgggaaggttacatcagatcatatcaattttgatcctgtatataaaggtagttataaacctgaatttgagagtttatttgacactgtagtcgtttacaaattaaagtagtttttatatttagattttttaagattttaatgtagatttttagattttaattaatgtagtttttagattttacttttttagattttaattaatgtagattttagattttaattaatgtagaaacaagcatttatcttagtgatttttatgaagtcattttatcaataatatcaaatagaatttggaaaaagaaaaatatccataatccaaccacacttaacagctgttttcactttgaatgttttctgttctcaaacatcttacaccattgtaattacagtatgtatgttccatttttattcttttttaaaaatttgatatcataaatatttgtcttttgacatatgaacctgaagagattaacaaatgtaaattaacaaggagaactgaagattctttagaaatctttttttttccattataaggtatatagcatagcataattttcagagaaattagttcatttggtaaggataaattattgtaaaataaaggaaggacaatataaagagtatatttgagtttgtatatgaaattggaaaacataataaaccttaggatttattttatttttcagtgaagcccaatccgccacataatttatcagtgatcaactcagaggaactgtctagtatcttaaaattgacatggaccaacccaagtattaagagtgttataatactaaaatataacattcaatataggaccaaagatgcctcaacttggagccaggtaaattgaaagttaccgtttattcaaatagtccttctttcaaccctctaatcttaaaaagtttcagtcattttctaaatgtctttaagtttctggttatgtgaaatattttgcttgataacctcttctgggttgttatttcaaacaaggggaatcaggaagatatccagatagaaaatacagctttgctaaatacagtagcctttaagtaaaacatgaaaatgatatagggtgataggaaatggcttttttttttttttcttctagagacagggtctccatttgcccaggccgctggctcactgcaattttgaactcgagcttaagtgatcctcctgccttagtctcactacaggtgtgcaccaccacacctggctttttaaaattattattattttttgtggagatggagtctcgccgtgttgcccaggatggtctcaaactcctggccttaagcgattctcctaccttggcctcccaaaatgctgggattacagatgtgagctaccactaccagcctagaaatggcatttttgatgggtgttacaaagaatacaagtaataaagcaaattaagtagaggagcaaaaataaagagattataaggataaggtagctagtgtagggattggtgtgctgcagtccaccaaaatcagcctgtgacttgtttttgtaaataaagttttactggaacacagccacactcatttctttacatattgtctctattctacagtggaagagttgagtagttgcaaaaagagtctctggcccacaagcctaaaatattagtaaatattttatctacctttttatagaaagtttgccaaccactgaggtagaggaagggattgatagggagcttgtaagactgaaaatgatagtatacccaaagatgatgctaccagcaaaagaaatacttggagcttttaaaaaggctatcaccatagcattcagctatccatactcttctctgttttgattccatttatcacaaacagtatgtctttgcttttgttgctctggtcacagtgagcttgttagggaattgggctaatgactttactacttctctccttaccccacttatctaaagtgctcagaatacaatcagaaaaagcaataaaacaaaattggattaatgcttcatgttgtacagagaatatacatacctgaagttcttcaaaatgtggtattaagtatagaatcttaattcagtgctacaaaaaagactgatgtttattttgtatctaatactaaattatcagagtaatatgaccagttatttatctgtatttaatctcctctttttttctgaaagccaagtttaaaagccaggaaaacttttgtttttcttgattgggctggatatcttccttttgcctgtccacatctacgctctacccttctctttgttgtgtcatgctgacctgtatagatttcatctgtgggtttccattctttctagcttccttgtgactgtggttaatggaaggaagggactaggcaggagagaagacagaagaaaagtgaaattggcatgttgattttccctgcttccttccaggaactggctgtctttttttttttttttgagatggagtttagctcttgttgcccaggctggagtgtaatggcatgatcttggcttactgcaacttccatctccctagttcaagcgattcttctgcctcagactcccgagtagctgggattacaggtgtgtgccaccatgcccagctaatttttgtgtttttagtagagatggggtttcaccatgttggccaggttggtctcgaactccagacctcaggtgatccacctacttcagtctcccaaagtgctgggattacaagcgtgagccaccgcacccagccggctgtctttcaacttagggtcactacctgtcaagacagccctctctagctgaccggcttctttcaggttctggtacttcccctcatccctttgggcctagaggtagaaacagctctaagccccagagtactaactgcactgtctaaggattccatatactctgcatgtagtccctttatgaagccctccttgaattattctaaatggagtgtgccatctgtttcctgcagaaatcctaagttatattacaggccctgtggaagaaataaagggaaaaaaggaaagataatagatgtttccatacttctaaaaccaaataactttactgatttggactgctttttaacttacacttatttctctccagaggttgagtttaatgtattagtcttgtgtcaataaaatagtttcaagaggctgaggcaatagaatcacttgaacctgggaggcggaggttgcagtgagctgagatcgcgccattgcaccattgagctccagcctgggcgacagagggagactctgtctcaaaaataaatagtttctaggctgagcgcagtggctcacatctgtaatcctggcactttgggaggccgaggcaagtggattgcttgaggtcaggagttacagaccagcccggccaacatggtgaatcttgttgatactaaaaaagtacagaaattagctgagagtggtggcgggcacctgtaatcccagccactcaggaggctgaggcaggagaatcgcttgaacctgggagaggtagaggttgtgttgagccaagatcgcaccactgcactccaacctgggcaacagagcaaggctgtgcctcaaaaaaaaaagtttctgaattttaacacaatttagaagaccttactaattgaggttttctgttgtttggtttgctttgtttcagattcctcctgaagacacagcatccacccgatcttcattcactgtccaagaccttaaaccttttacagaatatgtgtttaggattcgctgtatgaaggaagatggtaagggatactggagtgactggagtgaagaagcaagtgggatcacctatgaagatagtaagtacataagtatatgaagaagtaaagctattggaattccagatgtgaactggttctggttttaataatatagcctcattgcttcttagtttgtgatcattttattcaaactgcagtattttaacgttttaatttttaaggacattaagatgtaaaattgaatatggatcattgatagtataagtctatttgatacctaattaaattatcatggaggccagatgcggtggctcacacctgtaatcccagtactttgggaggccgaggtgggcggatcacaaggtcaggagtttgagaccagcctggccaatatggtgaaaccccttctctattaaaaatacaaaaattagccgggcgtggtggtgggcgcctgtagtcccagctactcgggaggctgaggcaggagaatcgcttgaacccaggaggtggaggttgcagtgagccaaggtcacgccactgcacttcagcctgggtgacagaacgagactccgtctcaaaaaaaaaaaaaattcatcatggaatggtgacttagatacatctatcagaaaaccgttaactgttgataagtctagaacattttattcaaggagacttgtccagagatactcctaactagagaatcatatcctgaatcattaaaaccacactgtctagcaaactacaccttagatccccactatcaaaaatatacttgtattataccttttattcattttttttctaatagcacttgataagcccctgggaagcggttgatcctggaattttggttggttagtttttattttccttttttctcctatagataatatatatgatatagaataaaaaaggcacaaaaagagtgtacagtctaaagtaagatcctcactgcaaagcatctgatgttactaagttcaagaaataatcccgtggcatagatttttcattttgagaccttcctatcacagactcatctcttagttatcaatggcagtagctgtggctgaaaaaatcccctaccacctatatccctttacttccagctcttctagaggtttaggtcatgtgacttgagaacatcaaaggcagaaaagtacccttctgccctaagatttctctcataaatgctgagaaagaaatcaattttgctattgctgctgtgggagtcctcagccagattgctttgtcttgaccaggaattcttaaaatgagatacatggggaggagttcatgaaatagtttaaaatgtaggtaaaatattgtggttagtgcctgtgtgcatttttaatggacaagtgtacataatctttgtcaaatcaatgcgtgaatgaagtctctgggttccctttatgttaggaaatatttccagctcataatttttttttaataatttcatgttctttattctgtttgagtgctgcactgtactcatgtgaatttatctattttaacttctgtaccagcagcctttttcccagccttcctggtctgcctgtcctatcctttctgttttgctgtctgtaattgcctcttcatgattaacatatcagtacttaaatttttttttttttttttttggaaatagtgcctcactctattgcccaggctggagtgcagtggcatgaacacggctcgctgcagcctctacctccaaggctgaagcgatcctcatgcctcagcccccaacatagctgggactataggcacgtgtcaccatgcccagcaaatttttgtatttttttgtggagacaaggttttgtcatggtgcccaggctggtcttgaactactgaactgaagtgaaccacatccctcggcctcccaaagtgctgggatcgcaggcacgagccaccacacccagccttactgcttagattttattcaactcctgtcttattctactgactaccatatcttgttattatattcataaaaattttgagaaatcagttaatgccattgatttttttaagacaaactttttacaaaaagcttaacaatgataagtaaaaatgaaatgtcagttgatattacttattgctaaaaaattaaaaattatatgctacatttaatggctattataagttttgaaaaattaatactacaggtatttttaaaaccgaatttaattactggtatttaacaatttatgttttggctgggtatggtggccaaaccccagctacttgggttgctgaggtgggaggatcacctgagcctaggagctgaaggttatagtgcactatagtcatccactgcactccagcctgggcaacagagcgagacactgtctctggaaaaaaaccactatgttttatggattgctttttcagatggttagtgattatcacaacaatactgtgaatttgtttttattacatcccatcactctcaatcatccttatataaagtaataaacttattttagtacatttatcttaatttgttttattattcttgtgaatatttaggagtaagcaatgtgtttaaatagattttccagtttgattttcagcgataagtagtatcaacttatgtttatttcatttttattttttactgttaaaaactttattttaaaaagtttttttctttaaaaaatcatattaactaatttttcaaaatttttataaatataattagaagacctggtatttaatagaataagagaggagttgaataaaatctaagcagtgatgtgttgatcatgaagaggcaattacagatgacaaaacagaagtgaggacaggcagaccaggaaggctgggaaaaggctgctggtacaggagattcaagtagataaatacagtgccagcacacaaacagaataaagaacatgaagttataagaaagagtgatgcctctttagttgttgctcagaatacatttttacctttacaattttgaggttagaaaagagttccagtataattgatcaggctatcaccctgactaaaggaagagccaggtgttttgtgctgggttgggaaaatgctggtataaagaggtagagacaccatgcaattggagggcaagagtattaagaacaaagtaaaagaataatttgcagaattttattttactgttaaaacctttttattttaaggagtttatgtcttttctttaggaccatctaaagcaccaagtttctggtataaaatagatccatcccatactcaaggctacagaactgtacaactcgtgtggaaggtaaaaaatcacatttatattttatctcttataaatcttttttttttttttttgaaaccgagtctcgctccattgccaggcaggagtgtagtggcgtgatcttggctcactgcaacctctgcctcccaggttcaagtgattctcctgcctcagcctcctgagtagctgggactacaggtgtgcgccaccacgccccgctaatttttgtatttttagcagagacagggtttcaccacggtggccaggatgatcttgatctcttgacctcatgttctgcctgcctcggcctcccaaagtactgggattacaggcatgagccaccgcgcccagcccttataaatacattttgtatggtattatgaatggaggtcttttaaatagataaatttttattcattttaatagcaaagcatttgattactatttttactaaatagaaaggtaatgctttatatgtattaatattatatagaagtcaggttcataaactacaaataataccttataggtatttaagtacagttctgtgaaagtataagttctataagaagaggaatgttgtttttgtactttggaattttccagagtaactcagaaaataataaaagtttgtgataatcaaaatgtatgctggtaagtgcatgagtagatcatactaaaaaagaaggtagaaaaatactcaagcataaaataaataatttagacctacatagccacagtgcagaattgatacagaaccaaaagctaacggaatgatgctacttacccttttttagttgaggtcatgcttttactcttcatttagtatgtactagttttattttagaaccaaatttaaaatggagattgtgaatcctttccagttaaatatttagagatttgacataatggcatgatttgtgaatatgaagaaaaactgattttttattcaagatttatgagattatttttaaaaataaactattttattacagacattgcctccttttgaagccaatggaaaaatcttggattatgaagtgactctcacaagatggaaatcacatttacaaaattacacagttaatgccacaaaactgacagtaaatctcacaaatgatcgctatctagcaaccctaacagtaagaaatcttgttggcaaatcagatgcagctgttttaactatccctgcctgtgactttcaaggtttgtatctgtgagatggagcctgactcttgggtggaaaaatggtggttaggtatggacagggctcccataaaaaacacaagttatctaagactgtctcctcagtatcagggataatcacttgtttattttttaattttttaaattttataaataatgattttctttttttcagagactgggtctcgccaggttgctcaggctggtctcgaactcctgagctcaagcgatctcccctggcctcccaaagtgctgggattaacaggcatatgccaccaaacccagctagtgatcgcatttttaggaatcagtcagcagacaaatttcatcaggatgcaagaacatttccatcactacatgctcacttaaacttcacagtaagctacttcattcatttaagcatattctgattacttacctggtttttaaaatattatttcaagattttgagaactttgtatacatatgactgaaacgtttatctgtagctttattcgtagctttcaaagaagaaaaattgcaattacaaaccgaaagcatttgaagaatttagggaaagcaaatttttttttttctttttgagacagtcttgctctgtcgcctaggctggagtgcaatggcacgatctcagcctctgcctcctggcttcaagcgattcttgtgcaccagcctcccaagtagctggaattaaaggcacgcaccacaatgcctggctaattttgtatttttagtagagacggggtttcaccgtgttggccaggctggtttcgaactcctgatgtcaagtgatccacctgccttggcctcgtaaaatgttggaattacaggaatgagccacagtgcccagcggggaagcaaaatctaagtttaaaaattgactactttacctgtaagttataataaagtgcttttaggcaaggaagtatatgctacaaaaattgataaatcacatgttttggaaatgactgtaaaatatggaaatttcaaatttgttaatatttattatttcaatattcaaactttgttttaaagctactcaccctgtaatggatcttaaagcattccccaaagataacatgctttgggtggaatggactactccaagggaatctgtaaagaaatatatacttgagtggtgtgtgttatcagataaagcaccctgtatcacagactggcaacaagaagatggtaccgtgcatcgcacctatttaagaggtatacctggctagaaacatctaaattgatatcctttttctaactctttaggcagctttttcttttgcttatagtgttttggtccgttgaaacgacttccaatttatcatagcctcactacttactagatgtgtgactttcagcaagtcatacttaacctctctgaattacagtctctttatgaacagagtggggttaatactttcttctttttgtaccccaatatgattttatcgtcaagggaaaactcctaaaactatagagtatagagaaatataagagtccaacctttgctgctgattagttatatgttctctgtacctcatccttcacatgagaaaatagtttcctagagcatctggatgacttgtgtaatgtcttagaaccatcagatagaggaagcagaactagaactcagatttccttatgtctttcaattggaagtagtaacaaaggacagaagtaatgaatcgtagcgctccagtctgtgtgttatggtgctgcttaagtggttataaagtgatacaacaactttgaagagaaaaaaactcagtttatagtcttttgttgataattaataattagaattcagctgtgaataatatggttaattagagaaaagccctaagcagagagattcctgccataaagtttttgagctttagtcataatacaggctgtttggacttacatgttattagtgtacagttttaataagcttggttatctagtttactgactttatcaaattaaaaacatggtggagcttaggaagtcctgaaacaggctggaaataactatagaaacttcttaaaaaaaaataaatacagggtctcactctgttgcctaggctagagtatggtggcatgatcatggctgactgcagccttcaactcccaggctgaagtgacccttctgcctcatcctctggagtatctgggactacaggcacatgctgccacactcagctaattttatttttttgtagagagggaatctcactgtgttgcaaaggctgatctccaacacctggcctcaagcgattcttttacctcaaactcccaaagtgctggtattacaggcgtgaaccactgctcagagccaatagaaactttttaaagcagcagccgatgcggtggctcacgcctgtaattccagcactttgggaggctgaggcgggcaaatcacctgaggtcgggagttcgagaccagcctgaccaatgtggataaactccgtctctactaaaacaaaatcagctaggcgtggtggcacatgcctgtaatcccagccatttgggaggctgaggctggagaatctcttgaacccgggaggcggaggttgcagtgagccaagatcatgccattgcactccagcctgaacaacaagaacgaaactccatctcaaaaaaaatagaagctagcataagttgtggagacattaagtttgggtaggtagtcgtatgttgctcagtaaccctgaaagcatcacattagagtagaatataaaaattgttcattttttggtaatattgaatcattaagaaaaggtaaaatctgtttaagaaggtaaaggagcatgtaacttcatgagtaatagttaaggaatatacattcttattgaaggtataaatttcaataaaacattttctaatatgtacagataatatactgtataaataagaaaaattttagtggtgcatgctaaaaaagataaaaataaaggaagtttgttttgttttttgtttttttgagacagagtctcactctgtcgcccaggctggagtgcagtggtgcgatctcggctcactgcaagctccgcctcctgggttcaagtgattctcctgccacagcctcccaagcatctgggactacaggtgcccaccaccatgcccagctaatttttgtattttcagtaaaggggggtttcaccatgttggccatgctggtctcaaactcctaacctcaagtgatcctcccaccttaacctcccaaagtgctgggattacagacgtgagccacagcgcctggccgaggaaattttttaagatacccttttttccaactcgcaaactaggaccgttagtgctttcccctaggtcttactgctttagtcgtcttgctccttaggctgttctctcttgtaggtaagacatacaaaaattgtcagactctataaaatccagagtaatttgagatcattgttttataaattctaaatgtaaataccatcattgttcttaacaatgtattttttatccactgcattggcaatacttttacagacagttttacctgattaagcttgaatccagtacacaaaagacaatgcttacttagaaaactgcagttttaaaagaaaattaagtggtcatgaaattataatgtaaaaataaattacggtattaacttgactttttcattatggaaaaacatgcttaatctgctattcttgctttagggaacttagcagagagcaaatgctatttgataacagttactccagtatatgctgatggaccaggaagccctgaatccataaaggcataccttaaacaagctcgtaagtccaaactcacttctttgaaaaaaaaagtttagggctttgtattaacagaaacattttatcgcttttaaataaagatgtatctcattatgttcaaatgattttatgacaaggaaattttactagattgtaaatgattttcagttagcaaatgtgttcactctgttacagcaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactggtaataaaactgtatcagttattaagaatcagttattttttccttaagcttttaagtactaatttaagtctgttcttcttatacatcttatagtatattggcctcaggagacacctgagaatttgccttatggttactttcatggatttattgaaaaagtattgtgttgtgctttagaacataaaattatgtcagaacattataaaagttgttttccaacaaaaatacttcgcttcttttttaacactttcacaatgccaaatataggccaaataagcaaaagcattgaatagttgaatgaagcacagttcttatttcttccagctgtgaatgtggattcttcccacacagaatatacattgtcctctttgactagtgacacattgtacatggtacgaatggcagcatacacagatgaaggtgggaaggatggtccagaattcacttttactaccccaaagtttggtaagaaataatgaagtttggttttttttctttctcaaacttaggttagaaatgaacttagtttatgtgctaaaattgtgttaaaaagtacatctttggattcatgatgatttttatattatctggctttggttggtggtttctttatagaaagtgttattcctcacctttttggtattttattaactgcttctgactatattcagctgtactaaaaatcctaaaagaatttgtgtatctttccatgtgggttcatttttttcactggtttgggtgtgttctttccttctctatcctcatttctttcttttattgagagattacttgaaggactagtccactttacagtcttcacttccgtacctcccactcagtatttaacatactgaaattaggggtcctaccccacccctgcactgaaacctctctggtgtcactcagaagacctcttgatcatcatatgtactgcatgctttttagttttcatcttttttctactttttttttttggaggcagggtcttactctgttgcccaggctacagtggagtgcaatggcatgaacatggcacactgcagccttgacctcctgggctcaagtgatcctcctacctcagtttctcaagtagctgggaccagtgccaccacatccagctaattttttttatagagatggctggtctcaaactcctgggctcaagtgatccttctgccttggcctcctaaagtgctgggattatagacataagccactgcctccagccttttctgcatttgactctgttggccttccatccttgaaactccctcctcccttgggttttctaaccatactttttctgctagcacagtctcctgagtctccttgttctttggtgttttcttcttcttctcctttttttgctttttttttttttttttttttttttgagacagagtctcgctctgtcacccaggctggagtgcagtggtgcgatctcagctcactgcaacctccacctcccaggttcaagtgattctcctacctcagcctcccacgtagctggggtagaggtgcccactaccatgcctggctaattttttgtatttttgtagagacggggtttcaccatgttggctgggatggtctcgacctcctgacctcaggtgatccacctgcctcggcctcccaaagtgctgggattacaggcatgagccaccgcacccggcctcttgaccctgttttcttacttgcctattcaaactctgtccatggctttagccatcttctctttccttcccaaatacattttccctccctcgttctatgccaaagccataaatttaaatgtgattacaataaatgtatttgtatatttttctctcacataagctgagtgtcaagtcctgttgattgtgcgtaccctttcatcatcattttcttcaactgcaagctcctcatgctaacttctcttttcttagtgcattgcccccagtgaggtcttcacctcatcatctggctcttctgtatcttccctaaagcaaacttaaccaacattctttcttgctccccctacattttgaatcattatagaaaattaccttattttaccataattgtaacccccacccccaagtgccagcctagttaatgataagtagtaaattccatgtgccttgttggttgaatgcttgctgaatgagggaataaatgaatgagtgactacataaaataaatgataaaagttcctgagctttgctgttagggtcagtaatgaatatagtttctgggataaggttggtcccatgtggtggtatgttaataggtatgttatttaaaataaaactttataccataatcttgagaaaaattaaaaaataaacttaaaaatgtatattttatgtatttctgtggagaccagccatctctacagagctttgtatatatgtatgtgtgtgtgtacacacacacataaaagcccatatgtatattttttgtttgtttgtttttgagacagagtcttgctctgtctcccaggctggagtgcagtggtgcagtcatagctcactgcaacctcaaattcctgggctcaagcaatcctcctgcctcagcctcccaagtaactaagactgctggtaggcaccaccatgcctggctagttaaaacaatttttttggtagagatgggatctcgctgtgttgcccaggctggttttgaactcctggcctcagtcctcctgccttagcctcccagagtgccggattacaggtatgagccaccatgctcagcctaaaatttttttattacataggtgttcattatagggaatttagactgtacagtaaaatgtagagaggaagaaaaattagtcctagtcccttaccccaaaataacatatttgtgtatccttttagtgtcttctttgtatatatttttttcctaaaattaaattatacttagtattattttataacctaccttttttcaattctctatctgtagtctcatggatccattatggcttcttcacatggcatgagtcttgccaacgaggaccttacagcttagttgaagaaattttgcataagtaaatcagaaaaaggagaacctgtggactatgtagacagtaaatagagtaggaatttaaatataccagtagtggataattttaccttcaaaggttttatgaagaagaaaatacttgagccttgagttagtatgtggacaaataggaagaaggtggcatcttagagagcagcatgagcaaaggcacaggcttgaaaacataaaagcagatgtttaataaagcaaagtttctgcctaaattagatttggcattttatatatatatacacacatacatacccatatcaatatatatatacacacatatatcaatatatacacacataaatatatatacatacacccatatatatatatatatgatgcttagcatttaagagttaatatttgccaacccatagtttattctcaagcatttaactgatttcttgatttctactgagcttcataggatgttagttacttacaaagggatatgtgtggtggaaggataaaattaagtgaatagtatatggctgcaatattactttcatacattttttactgtaaaagactaagtaaaattcaaaattaatcaggacagtcatttaaaaaatctccaatgttaattatcccaattagtgattaatttgatgaacaagtcctcttttaaatgcagatgaggatttgtgtggtatttagggatcttaggcttgtttactttttagtttattcctactcgtgccactcctcatgcccattgagcagctcctaaagttcttagccctgtaccagctatatcctccttttgaaaaatggtaaataactcttaaaacttctgagagttgcatttttattttttagaaggttaaatgtgtagttcaattatgtttttatagcttttccattttacccagtatttatatttgttctgacataatttctctgttatacagtattagaactcagagataaacttttactaagattctaccaaatgcagatcataaatgttacaaatggttatgtttgaaagctctaacccagtagattacccgatacactgatcatttttatcccccaaccaacatatattttatgctatgcggccaggttaatgtataagacataaatggttgggatgtgatttaccaaagagagaagagggtaaaaatcatcaagtctgaagagaccttgaaaaataattaggattgtattttatcttttcaacagtaagtctggttgggaagttgtattatgtcttcttagttcatatgtcaacattatttcccatcacacctctttttttttttttttttttttttttaagctcaaggagaaattgaagccatagtcgtgcctgtttgcttagcattcctattgacaactcttctgggagtgctgttctgctttaataagcgagacctgtaagtaactttattcatatttttgcattttcccccagctttattgagctgaatttacatgcaataaaatttatccattttaagtgtacagtttgatgaatttttgtaattacatacagatgtataactaccaccataatcacaatatagaacattttcatcacttttataaagcttccttgttctcctttgtaatctgtcttcttctcagcccaaccccaggcagtcattgatctgcttttctgtaactgtagttttgccttttctagaatttttatttatctatctattttgagacagagtttcactcttgttgcccaggatggagtgcagtggtgcgatctcagttcactacaacctctgcctccctggttcagactcctgcctcagccttcaaagtagctaggattacaggcgcccaccaccacacccagctaattttttgtatttttagtagagatggggtatcaccatgttggccaggctggtctcgaactcctgacctcaggggatccaccctcagcctcccaaagtgctgggattacaggtgtgagccacggccaagaattttatataaatagaatcacatagcgtgtagtcttttgcgtatgtcttttacataatatttttgagattcatccatgatgttgcatatacttctccctttttttttttttgagatggagtctcactctgttcccttactggagtacagtggcatgatcttggctcactgcaacctctacctcctgagttcaggtgattctcctgcctcagcctcttgagtaactgggattacaggcacttgccaccatgcccagctaatttttgtatttacagttgagacggagtttcatcatgttggccaggctggtctcgaactccggacctcaagtgatccacccaccttggcttcccaaaagtgctgggattacaggcatgagtcaccacacctggcctacctttttcctttttattgctgaacagtattctgtagtatggatatatcaaaacttagactgatctgttatggaagtttaggttgtttctaatttttagctattataaataatgttgctatgaatattcacatacaaaactgtgcgagcatatgttttcctttatcttgaacaaataataggagtgagagtgctgggtcatatggtaagtatatgttcaactttataagaaactgccaaactttttcagagtggctacaccatcttggattgcctccagcagtgttccatattatcaccaacacttagtgctgtcagacttctttcattctagtgggtgtgtagtactatatcgttttaattttcatttctccgatgactagtaatggatcttttcatgtgtcacttacatattttcttttgtgatgtgtctattgaaatcttttacccattttcaaattgggttattttgtttataattgagctataagagtgctttatatgttctggttacaacattgttaaatacgttttgcaaacttttgtcccagtctgtgctttgtttttttgtcttaactgtggctttagaaaagcagaagttttacgcctgtaatcccaccactttgggaggtcaaggcgggcggctcacaaggtcaggagattgaggccatcctggctaacacagtggctaacatctctactaaaaatacaaaaacttagccgggcatggtggcacacgtcagtaatcccagctactcgggaggctgaggcaggagaattgcttgaacccaggaggcatgggttgcagtgagccaagatcacatcactgcactccaacctgggtgacagagtgtctgaaaaaaaaaaaaaaaaaaaaaaaaaaaagcataagttttttattttgatgaagttcattttatcagttttttttctgtggttcctgagttttgtgtcctgccaaacacagtatcaaaatattttctcatgttttcttccataagttcaatagtttcagctcttagtctatgatccatttcaggttatttttgtgcatggtgtgaggtcagggtcaaggttcattttgttccttcagatgtctaattccattgtcatttattttgaaaagagtgtcttttccccattgaattgctttggtacctttgccaaaagcaattgtctttataagtctgtatctatttccatactctcacttctgtttcataaatgtatatatgtccgttcttatgccaataccacattgccttgatgagtatagctctatagtaaattttgaaaataggtagaattcttccagtgtgttctttttttaaagaagttattttggctaggttctttgccttttcatatacattttaattcagcttgtcaacttttttaaaactatagttttgattgggattttattgaatctataggtcagatttaattgaatctataggagagaactgcagtctttttttttttttttttttgatttaattcctcagctaaaacagcggaagaggtgatttattatatggttgttacactcggccacaaataaacacagaaatagtccagaatgtcacaggtccagggcagaggaccaacatgggcattttgtttttgagcaaggtgggtctcagaggtgatcggcgatcagagggcgatgaagttctagatccattgagacaagctctagacagtagcatgcagtcccacaacttgtaccagcatccccagcgtctggcattccatgtttctgctcctgtggcctccacggtgcaacaagctagcggtttacttggacctctgcctcatctttcttcttttgcgcttcagcctgcgcattcgcttcttcctccacttggctctcatggcgccgaggtttccaaaaaaatggcgctaaggccgagagagaactgcagtcttaacgctactgagtctttcaatccgtgaacctggtttatttctttatttatttgggttttgtttaatttacttttgcagtgttttgtagttttcagtagacaggccttgcataactttttttgaattcatgacaaaagtattttttgttattataaatgaaatgtttaaaaatattttctaattcttagtatatagaaatgcaattgattttttaaaatatattcatcatgtatactgagactttgataaattcatttattagtagctttttggatccttaggattttctagatacacaatcatgcttcttgggagtaattatagttgttctaatctttatgcttttagttctttttattgtcttaatgcactggctaagacctctagtacatatagtacatctagaccatataagagcattgctttgttcctaattttagaggtgaaagtatttagtctttcaccatcacatgtgatgttagctgtaggttgaagtttttgctttgtggggtttttttgttttgagactgagttctactcttgttgcccaggctggagtgcagtggcacaatcttggctcactgcaacccccaccttctgggttcaagcaattctcctgcctcagccacccgagtagctgggattacaggcatgcaccaccatgcctggctaatttttttgtatttttagtttagtagagatgggggtttcaccatgttggccaggctggtcttgaactcctgacctcaggtaatccacccacctcagcctcccaaagtgttgggattacaggtgtgagccaccgcgcccagccgctttgtgtttttttttcccctttactactacttgcaggggggaagttcttatttctgttttgccttgctagcaatttttatcatgaatgggtgtcacaatttggtcaaatgctttttctgaatctattgagatgatcatatggtttttctccttccttccatgaatatggtgcattttattgatttttcatataacatctttgcattccttggattttgctgcattcagtttaatactgtttgcatctgtgttcatgagtgaagttagtctgtctttatgtgccttatctgtctggttttaaaatcaggataatactggcctcataaaatgaatgggaacatgttacctcctctgttttctgaaagagtttgtatagtattaatacaattgtttccttttgcccagagttttgtgggaaggtttttaattaaaaattcaatttctttataaatatagctttctttttcttcaatctgttttggtaatttgtgtctttcaaggattcattcattggtttgtctaggttgtcagctttactactttttatattacttccaaatgttataggtatttcctacaggagagtcagtctggtaggctctcactctttgaagcaccattctcagtcacttttttaaatttgatttttatatttgaacttttttggtatcagtgggaacattaatttgttatctggattcttttaattggaataccacaacatgtggcctgggtaaagattttaagtggttttaattgcagaattttgagagtttaaaaaaaaatttgaacactgattagatttagctttgttaattcattatgaatacattataatccttatgcattttcaacagtatttttctattggttataagaaaaataatttttgtttggggtagagtaggtattttttgttcatttaggtaattggtttggtttgtaagagtctttgatgaacatgtttagaaatagggactatttattgtttattatgtgtggttttacataggccatttttcttttctcttcagaattaaaaaacacatctggcctaatgttccagatccttcaaagagtcatattgcccagtggtcacctcacactcctccaagggtaagagaaaatgcttctgagttgtttataatatacagacatgttagtaggtatattgagtatctacagttagtaggtatattgagtatctacaaatgtaccaaaagataagatattcaagctgaatcaaaaagtaaatgaagataaaacagtacataactgaaaattttaatcaaaatttaatatgtatgacatattttaggggttttatcaccatcatagtatatttgttctgatattttaaattgtttagtacacattacagatgtttggttgaacttgcaaactgaaaacttgaggtgctgaaactgctatgtgatggtaactacctcaagcattttgggttgagtattaaaaccaagttcaacagtttatcattttagcactgatgaaatgatctctgggaacctactctaaactctgaattttaaatatgccccaaaggggaactcatttatatttattatcctccggtagtccttaaattttatattaacagattaaaatgtattatgtatttttatattctacaaaatctctgtcattcaggtttgattttccttaatgttttctagttttctgtccagttaatcctaggctgcctagtctaggcatgaaatattaaatactacttgtagaccattagcttatcaaaatgtaacaccaacaatattgatttagactacttagactcattttatagtatctgcattttgggtagttgacagtgacttagtgacataatacaggttatttctgtaccactgagagttactgggaagtttcagagatgcattagctctgtggctttaactaatacttgccatatacaattttttctcttccttagcacaattttaattcaaaagatcaaatgtattcagatggcaatttcactgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtgatgaaaatgaatcttcacaaaacacttcgagcactgtccagtattctaccgtggtacacagtggctacagacaccaagttccgtcagtccaagtcttctcaagatccgagtctacccagcccttgttagattcagaggagcggccagaagatctacaattagtagatcatgtagatggcggtgatggtattttgcccaggcaacagtacttcaaacagaactgcagtcagcatgaatccagtccagatatttcacattttgaaaggtcaaagcaagtttcatcagtcaatgaggaagattttgttagacttaaacagcagatttcagatcatatttcacaatcctgtggatctgggcaaatgaaaatgtttcaggaagtttctgcagcagatgcttttggtccaggtactgagggacaagtagaaagatttgaaacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcactacataaactgactttatcctcagactagctgaatgattttgtgctgtttcaggatgtttgcactgaagaaaaacagaaagcttatctgaaatttataaaactttttgttttgctacatagaaaacagaaggtatttgaataataagcagtgatatgcttagtgagcacagctatactgattttgattagaatagtcatcagagtggcttagggacagttaatataaaagaggagcaaggtgtagaccatcatctacttctgctaaaataacttaaaaagaggtccataggccataactacatgagcccagcttttgtaatctgacaaaaaaatgaggagcagcttcgtgtatatcagtgtacacggtattccttaggtcccttccattggtagtgatgctgcgagttattactggagaaaaggaattctagagctttaacttggcagattaaaagtactcattttttattcatcaataattagtaatctcactagttttcaaaaatttgcatattattgacaacctctttgaagatgcatttcacaaactcaacagagtgccatgataagagctagggatcccccaaactatctcaagcatctaaaaaattgccatttttaaaggcttaaattgtagtagtaaaggggaaaacaggaagtagtagtaaaggggaaaaaaaaccaataaagcatctaaaaaattggcatgttaaaaggcttaaattgctaatgtgtgtatatatatatatatatacacacacatatacacacacatatcattgacttttcttaagacttcagagtactgggtagatgaacactttatacagtatatatcttcagcttaaatttgttttgagtattttttttatttttaaataagtaggcaaagatttaaatttttttatttttagtaaatgtttgaggcacactaagacaacttgggcaatatttgccaaaacaaaacagaaccccaaaaaatgtacatcttgttcttagcaaatatcattattgtagagacacttaataaagagatggtattttaatgtctgcagttctgaggtagggtggaacttagttctacattgtgatttaggaatttttaaaaccttttttcttcaagggagaagtgacccaggcctcgagtttagtgctaaagccgctagtgtacttatgctgtcccctaaccaccacgtgcgatatggaagcagatgctaaatataggggttttcttagaaagtaagaggaaattagcaagcgttattagtgattgactactgctatcaagtgaattcaaaggaaacaggtttttatgccatatttaagttacagaaaccaggcatgcttagaatagtttctagaggttattggagaatagaaagctaagaaaacttggtatacatttacaatggaaatataattacactttttactctcagaatattgttcacattagacttcctgtttatcttttatattcttgcatttatataatgcctcatcctttcaaagttctttcacatattatatgatcttctttatgaaaaaaatagatgtttcattctgatatattcagtttcccactttaggcaaaagtagattaatagaatgacgaattcaaagtagatgaggaaaatcaggcacagagaagtaaaggtagggatagacccaaatttacacaacaagataatgacatctccagcttttaagttgatcatcaaaggctgggctggatttgtcttgctgtatgtgtcaggaaatttatacctattacattttccattttctcaaaatttaagtcacatgactaatatttagctgcaactttcctcataacaaatagtgtcatgaagaatgttgtagtgtgaagtttgtacattt

SEQ ID NO: 620 - DNA, 23797 bp, Human
tggcttggaagggttttgaaatgcccagagaaggccctgacaaatggagaagatggaatatgtccccttcagttggattcttgctccgaagtattccttgagcctatactccaaagtgtggcattataactggtgcagacggagtctgtcttaaaactgaaaaggaggatccagagactggtacaaatgtcccacctcctttttttcttacttcgttattgtcaaataattgtaatgatgggacaagctaaatcatgagtcttttaaagtctcttcgatttgctttacacctggggggttgttgcttgtctctgctaattttagccatttcacaggcccatgggagcaattctacctaatgacagtgaatccaacagaagttcataactcactgatcacttagtttctctgcactcctcaccttataactgcagtcttgtggcatttttccaaaagagagccactgtgaatcaagcatagagttttatggcctgaatccaggttagattatttttttcaagaaaaagaaaaaaaaatctaacagttaccaagaagcagtcaggctttacaaatatcaccactttaaccatgaggccatattaggaaggcttttgactggcattcaggtttgggggagtctgaattttctatgccatggtctcagatttctgccccatatacctaggcactaatttagttcatatgtactatgtgtacctgaaaagttgtgtggcaatcaaattttcacaaatagaatcctgttttaaatacactaagaaagtacctactttatcctttaaacaagaggtcagcagactttttctacaaagggtcagatagtaaagattttacaccttttgtacaatacaatctctatctcatctacttagctctgccattgttgcataaaagcagctgtagatgatacacaaatgggtgaggctgtattccaatgaaacgttatttgcaaaaacaggtggtagattaaatttggtcccaaggcttacttgggaaaaaaaaagatcttttgaaaaagaaaaaataaatgaataattttttaaaaaattgttccctaggtcatagtttgccagcccctgccctaaacaaataattcttgaatgcctactgtggtgtgtaagatatgagtaaataccagggatacacagagaacaaaagagaaaaactgctattcttgtgaaacttggaagttggaggtaagctatttaaaataaacccacaataaagtacttcacatagtgcagactgtttctttaaatcaaaactcactccaaacaaccaattgattcactttgtaagtttgaatttttgtcttcagattcttttaaagtgggcccttagtcaggagcggtggctcatgcctgtagtcctagcactttgggaggctgaggcaggcagatcacttgaggtcaggagttcgagacaagcctggccaacatggcgaaaccccgtctccactgaaaacacaaaaattaggctggcatagtggcatttgcctgtagtcctagctactcaggaggctgaggcaggagaattgcttgaacctgggaggtggaaattgcagtgagccgagatcatgctattgtactccagcctgggcaacaaagcaagactctgtctcaaaaaaataaaaattaaaaaaataaagtagcctctagcctaagatagcttgagcctaggtgtgaatctactgccttactctgatgtaagcacagtaagtgtgggggctgcagggaatatccaggaggaacaataatttcagaggctctgtctcttcatgtccttgacctctgcttacagcagcaatacttttactcagacttcctgtttctggaacttgccttcttttttgctgtgtttatacttcccttgtctgtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaagttttcttatggattttggattatctgtagcatggtttcaggttattcagttccctaacagacctgagtcaggcactgggtttgaatgcagtttgagaatttcccacatattcagtcattttttttaatgttctaaccaccatgacagggggcaggggatcaatactatgggtggtttataagacctcagtattctcaagaaggaatgcatttcactcccaagtgtagatcttaaatgttgaatgattactctgctcttacaaaaagaatgctcatgtagatgctatgactgtacttgtaggaaaatgtccaaagtaattttaccttgtcaggagatcaaactggattcattttgtttgactttttaagaaatcctgaaagcataactttcaggataaggtaatgtacagaagagaagcaatagctttgtcttcagtgaccagtgctatatcctcagcacctaaatcagtggctagaatatagtagacatccaataacttttgaaagtgttttcaaaatactttagttttgagagatttatgtgagattttaagtaaataactgactagagaaagatctaaatgagtttactcattgaaatacactgaattgcctccacaccaacaaattggccatatgtaataattctttttgggatctaaaaaacttagtaccgagaagccaaccctgcccatacataaacacattgtaattataacaaaactaggcagaagcttctaacagcagcaggaggcatgtgggaatttagaccatcaacttgctcctgcaaattaagccctttctctttaagagttaaaaactatttggctatagacaatatcaaacacatcagcctaatgactcagcttatgcattttgagtcatgtaattacgaaggatggaaatccctagaattttctcattaagggaattgtcagagagtttgacattttttacagtatatgactcactttatgggggatgattattattctatgctaaactttgccttggatttccacaaagactgatgggaggcaggaaacataaatcttactctctttcatgtcatctatactcactagttcaccctggtgatcatactatttttaaaatatataagaatgctagttgaaagctgggttttcactccaactttttaagtttcagattttttagaagatgtataattaccctattcacatgattacgtcaaaatacttcccagtttggggtataggaattcacattcagttgctgcttgttgaaagttgtcaattttctgatcatcacaaggatgatcaagagaagaaagggatactttttaaaaatccaaatcatttacactattaatcaactaactccattcagtaggaagaagacttctagatgacactggcttgcctatgatacatattccacacaatttaaatttttatggataaatatgtctagatacctatttaaatatgaataatattaattattgagcatttaaagaataatagattaactcattattcaaaagctctatgtaatttcaaaaccatagtaattataacaccgtcaattgacataaactttttaaagagaagctcaaatgtttcatgtatattttcagaattagaattcttattttaccttttcattacttatttctcagaaaatattatactcatagctaatccctattaaatccttactgtgttctaagctacctctttgtaaatatccattcagtgattgctcatagcacgagtttacatattagaacacatgtcttagagaagttgcctacctgacagaggaccacaggtagagtatccagaatttaaacgcacatctgtccagctctaacaccacaggtcttaaccactgtgtacattaactactcttagccaagaatttttcagctcacgtcatgtagaatattctttttgtaaaatgccatcacattttataagtcattgaagggaatttttcttggttacaaagcaactctgccccataatatctactgaaaagccagtgagctgcttcctaaaacacagccattttaggtgcaggaaacagtgtataaatggctcattgtatattgtatgctttgccagactgagtggcagtgggagtcctttgttatgtgggtgctgacatctgctagagtgtgctgtctctattgaagaatcgtgaagacaaagccgacccacaggatgtctgaatccaaataataatacatgttctgtgtatagaattggtggaagagaaaatgtcaggacagtgtgaggactgccatgtaaggtcagaaccactgcatttagaaagctaccactgcacagggaagaaatctaagtctacaaaattagtgggctgtctctcattatttcgtgctgtcatcagaaggagggccataccctgctgaaactacataaagagcttttgctggtggcagaactgtgaactggatggattctgggaatggccagaaaaacaaatgcctgtggttgtgagcagtgcccacacccatggtctagctagggctgtttgagatttgttgctttgactgaaccaacctgtcattcaactggttggtccattcacagtcagctttattaactttcccattttccctactgagttatttaagtaaagaaagtgctattcggacagcccttggtctctgggacaatcaactgggatttgattttagtatattctgtctccagtgtaaagccttggaagcatctaatttctagtactgatgaaccaaaaatacatggaagcagtcctaggctcacacttgagcactctgagaatggctttgcttactccagattttctcaggtcccagtgggtgtatattttctgacatatttattccagcctcactttcctatcatgtaaaacatacatacaaaatgtagatttcattatagggtctacaaaacagcttaagaaaccaaatactatgtgtgacagatcacactttccaaaagtaatagcaaaaaaaaaaaaaaatctggttccccactttcttccagcatcctgctagaatctatcagatactgcgtctatagaagaatctataagaacagaagcagtatgtacaacattcacaggaagtttcaccaaatcggagtcctgccagatctaattttttttccctaatcacgtttgtctcagtcagtagcttaagacaatggaaataatcagtgccacttttaattgggatgcctttttaggcaagggaaagtgacctcttaaaaaagcaaaattctgactgcaagatagctatcattgtccttcatttaagacaaaaaaaatactagggagggaataaattatgatttgtaataaagtgaaaagtgagattaggtagcatggggataatggaaataaagtgtctcttctttgaaataatatgaacaatcaatgtaacaaatgtagcagaaaaaactccagtttaaatacagaaaagaatgtgttcaatgcctctggttctttaactcagaaatatttggaggttacttactcattatgatggattttttttttctattggaaaactctgttagcattgagcgtttttgttttttgttttttgttggttggttggttttgaagcatttttcttgtctttgcccttgggcttttcttccttgaatactacataatccattactatttcatgtctgccacagagtctgctattttattaaggtcatgccatatttcaaaaggatgcatttatttgtttcattaacagctgcatgtttgttcctccccaggagacttggaagatgcagaactggatgactactcattctcatgctatagccagttggaagtgaatggatcgcagcactcactgacctgtgcttttgaggacccagatgtcaacatcaccaatctggaatttgaaatatggtgagggatggtggttttaatggttgcttagacatcctctgtctctcttttcatatgctctttttagtagccacaaaagaaagaatatgtggcctaattaacaaatgttaacatctaaggaattcccaaaggcctcctgaaactccttgtccttcaccaaaaacactcatacaaagctcctctcacggttcagctttcagaccctgagactcagtcaaatgatgctctggatcttggggatcccacatccctcccaacttcatatcagaatttaaatcctgcgtctcctacaacacttctcaccaaaaatctgtttgcccaacacgagacaatccagtgtcttcaagttgcatctgagagttaaactgccttgtttccaatcccaataccagtgcttactagttttttgacctagagaaagttatgtaatgtatctatgcctcagtttcctcacctgtaaaatgagataacctgcctcacaggaaggctgtgatggttaaataatttcatcatataaatcattccaaatagtcggccagtgaataacgagtaatggggaagcaacattaaattataattctgtgaatattgacctaacttctaccatcttgacacaatttgacttcagatgatcctctcaatgtaaattttccaaaaatccacaggaataagttggcattttgtttcacaaggtctcacagaaaagacaaaggaaaagagtcttggtttgaaagtttactaaaggtctcagggaactttatcttctccttctccttcatccataagtcatctcttgttgccaagggttactatctctggtgatttgagaaactactctagcttgaaattctgacctgaggctatctccaaattcatatccgaatgacctactttttagttagtgtcctagtgagcaaagtaaatcaagatccaccagtagtaatagaaggcttcctacattccatagacactgagacaattctccacagtctatagtccaaacaagccctgaattccagtttttgtcaatttatgggagcttcctgcatctatttatggagtgctttctgctgcagtccttagataaacatgctgttggacttgagtagtgtactgtgttctctgtctgcctctgttcacttccctaacacattttccaggaataaaatatgtcaaaagaacctgaaccagttcgatgtccacaatctaggctggaaatggattgcactaaaacagccataacaactcattcaaacaaggcactcattttcatgggcaaatcactctcccacacggaggtttgactttggcttctttaaccagctggctggtgggctgagtgttcatcctggtttctcttggccaagctgaggttgacctttctgttcactttcattcacaccatatttgaccacttccttgcccactcaaacatacttaccctttaacatatctcttgacttttcctgtcatattgtaatctgtccagagcctcctctatttgggttttccaattggattcagatatttcagttggaaagggactgccttaagaaagaaacgttttcagtggaaaatatatgtatgagctctttaatagatgaactcctggagttcagagcccttaaaaggatgcccagtttcacaagacagccatacggtcatccttgattgtccattgctcattaatttcattctcaaaatcatgggaatgagctgagaataccattttagatcctccttaaattcccaacagtaccagaaacttgctacaggttggggcctgtaattggatatttcacacatactttccttacaaatatattctatactcaagaattgaactaaaagttattgtcctagtttctccacatcccatgtttacctaaaattcagaaatgggaccccgctcccagtctccccttctatatttatttatcaaatcgtgacaacattaccatcttcagatctttccacctgatgtttgtcctaagcttattccctggtatctgtctagcttacccaaaaattcggtttttatttttatcctgttccaagttgggaaagcctatctaccccaacaaggaacacaactccctagtaactttgagacacacacacacatacacacctactctttaaagcctaaacagtcgcacactctaaaagatagcagttaacaaaagtaacgatttgggagaacagttttaaggaatgtccccaaaataatcaatacatttagccagttaattaacttaacatttcttcaccaatctctagttttcatgactgtaggagcttaaccagtcactctcagaccacaataaaccaaaggtgaaagattctgtaacgaaagctagggcactctcccctgcatttaacctcctggccagctcactcgaagccagacaaacaggttcctctttttgtgcagagtccaggaaccattctcgaaaggactcatttgagcacatgcagagaagagtgtacacacatccagttcaccaagggaagccaacacacattgtgggttgtaggtagtaaaaggccttcctagaacacactccttaggatttaaacaaaattacatcggttaatggaaagaattctttcatatacgcaaacttacccagaggaacttttcttctgcccagatcttcacttccaatttgacccagttatacctctttagagctatttggctgagcttaaacagcacataggaaaaacaaattggtaactgtgtttatcacagaagaggaaaattaaatttagggttgggaaaggaaaataaccctatgatattacttttattctacctttacaatgagaatatatacctttgttacttctttaatttttacattatttacttatttttctttgctttcttgtttgattacaatgcattttaggggtaaaatttatgtgtggtaaaatgcacaaaaattaagtgaatttggagaaatgtctatgacctgtagccattccaatggtaaagatatagaacttatttttcccctagaaggatgcttcatgttcctttccagtcaatcttcataccccaggagcaatcataattctcaattctattaccctttggtttttgccagtttctgatagttcttattaatagaatactctttattcttttctgtcttctttcatttaaccagtgtttgtgagagttagccatgttgatgtccatctcatagctcatcttttcaattgctaagtagtaattccactgtatgaatataccacaaatttttaattctttctcttcttgatgaacatttgtgttttttcaagtttgagactattattttttaggttgctgttcacattcttggacaaatcagtttgtgtatatatattttcatttttctggggtataaaacctcagaatggaattgctgtgtcataaggtaagcatgtatctaagtttataagaaaccgcccaacagtttttcaaagtggttataccattctactctctttccagcgatgcatgagagatatacatcatttgcaacgtttgactttgggatagtatctcgttaggtttttaattcgcatttgtcaaataacaaatgttgagcagcttttcatatacttggtcttttgcctgtcttctttgggctagtatctgttaaaagcactgagttatttgtccttttgttattgctggatatgagttctttatacattctgtatacatttcctttgtcagatagatgtattgcatctattttctattctgaagtttgccattttattttcttactggtgcgttttaataagcaagagtttttttttattttgatggagtctaatatatcatttattttcttttatatgtagtgctttttgtatccttgctaagataactttgcctactcccaaagttgggaagatattttctcatgttttcttttaaatgttctacagttttagcctttatatttagtttttttaattattattatactttaagttctagggtacatgtgcacaacgtgtaggtttgttacatatgtatacatgtgccatgttggtgtgctgcactgattaactcgtcatttacattaggtatatctcctaatgctatccctccccgctccttccacctatgacaggccctggtgtgtgatgttccccttcctgtgtccaagtgctcttatcgttcaattcccatctatgagtgagaacatgcagtgtttgattttttgtccttgtgatagtttgctgagaatgatggtttccagcttcatccatgtccctataaaggacatgaactcatccttttttatggctgcatagtattccatggtgtatatgtgccacattttcttaatccagtctatcattgatggacatttggcttggttccaagtctttgctattgtgaatagtgctgcaataatcgtacatgtgcatgtgtctttatagcagcatgatttatactcctttgggtatatacccagtaatgggatggctgggtcaaatagtatttctagctctggatccttgaggactcgccacactgtcttccacaatggttgaactagtttacagtcccaccaacagtgtaaaagtgttcctatttctccacattccctccagcaccttttgtttcctgactttttaatgatcaccattctaactggtgtgagatggtatgtcattgtggttttgatttgcatttctctgatggccattgatggctaatatccagaatctacaatgaactcaaacaaatttacaagaaaaaaacaaacaaccccatcaaaaagtgggcaaaggatatgaacagacacttctcaaaagaagacatttatgcagccaaaagacacatgaaaaaatgctcatcatcaatggccatcagagaaacgcaaatcaaattgcgtttatttgtttctcttgtcttatgcattggctaaaacctcctgtacaccactgaatagaaatggtgaaagtggatattcctgtcgtgtcctggtcttagggaaacaattcatgttcacaatttcagcattaaatatgatattaactataggcttttgtaaatgctctttatcagattgaggaagtgtctttctatttcttatttgctgtgagtttttgacatgaatagatgcattcatgttattaaattatgctttgaatgcatcgattgattataaccaggttatttatgtcttctagtctgttaacatggcaaattatattgattaatttttgaatctttaacctgctttggtttccctgagatgtgccctactttataattatgtattaaaattagtgtgttagtattttcttgtgaaagtttgcttatacatttttgagggatatttgtctatcaacttcttttctctaatattttggccaggtttgggtaccaggattaagctagcttcaaaaaataggttgagaagggtcattcctcttccagtttctaaaataatttgtgtcagattgacactatttctttccttatacatttgatagaatttaccagaatataaccatcaggcatagagttttctttggggggaagtttattgataataagtttaatttctttgagagaaatataactattgaaatattccatttctatgtgggtcagatttactaatttgtgtttataaaaacattttcattacatctaagttattatatacattaaaatagcatttaaaatttccttattatacttttaacatctgcatgttctatagtgatatctcctcttacattccagatattagtaatttatatattttgttttcttaaccactcttgttagggttcaccagccaaaattacctatgaaaatccgttacgttacccatcaagtatatgtgatattatgtatataaccctttatactatgttatcattttctttaacactttttttaatcaatattttttacagctcttatttcttacatatattcctatggaacatcaaaaaaagcaattactttttaatctaaacaaagtatttgtttttcagtgatcaattataaaaatatagaaatttcccataattttataaatatgtcttgactatttcaggttcaattgcatctaattctaagtaaatcatcactaagtatcatagcagcagaaagccataagattttaattcattatctctcattcctgaacatgcctccactcacccacccacatacctatgaacagagttaaagtcaaacatacatcaatgtgcatatgatactattccactgcatacaggaactcctacctgaatcaagacatatcccctttttattcctacagtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactataggtaagaagttgtatataaaagtatggttgtcacttttgggctacctgaaaacactgtgtctggacattctgtaggttaaaagtagacaaatagtggaaacaactggcaatagataatagctaattccctactgtaaatttttataataaatgaaaagcttgaaatttatactttcctgcagtgaaagaattctgaggatcttcaaacccaggtgtgaaagatagtgtttgtgcaaacctacatgaagtggctaactggagctgggcttcctgtcatccatcacaggtgtcctttccttccttatctgtcctttccttccttacctgtccttctcccaaattccttgtggtcttctccccaaatccccacaacattctgagtaagtttagctaacttatcaagttattttaaaaagcatatatgccttctctattagtcagagttttctacaaaaaaaaaagggaatcaataggaggatagatagatagatgattgataggagagatttctattaagaaattgacttttgtggttgtgggaactggcaatcgcaaaaatccataaggcaagccagtaggctagaaattcaggaaagagtgcagtattgagcctaaattccgcagggcaagaaactcaagcagattttctgtattgtactcttgagacagacttgcttcttcttcagggaacctctgtctttgctctagaggccttctactgatgaggtgatgcccaccacatcacggaaggcaatctactttactcaaagtttactgatttaaatgttaaccatgtcttaaaaatacttttagcattccctattcgctcccccttcaaccctcaaaaagaaaattaaaggtaagagagcaatactcattagagataagaaagagtaagaaacctagctcagctttgtctcagttttgtttcattaagatgattaaatagagagttaaagcagaagttccatgtgtgaacaattaacttgtgaaaaggcaaatgtagtagaaaagagacattaggcagatggctgtgcatgttggccacacagaagcagcattggccatgaccagtgtgggtcctggttaggggaagagaactgggtttgacaacaacagggtatctctgaggttataaaaagttgggttctgatcatttggagatgaggtccctatggatagggcaccatatctaaaggttcaccatttacattgcaaatatacattcagttctctgagagtgagcagagaaggcagaggttctcagtcttctgacaaggtcctggagcatcaggggagagcccattcttacaaaactccacaccagcatgcaagcccttacatgcacataagcactcacaacacaccaagagcctccaggtgacatctgccacctccaaatccccatatcccacatgctcaatgcacttgcagtctccatcccccagcagactgcaaatctgacatgcctcatccgaacggcaagggggagaggtacgtatggtacacacactgctgatggcataggcccctttggaaggggtagtgtgagtctcttggggctatggcaagcacccctggacaagcaggaagagaggtggtggaggcatgtctcacggtagcatctccttctaggtcctaatgggacacttcattaatggaactaccatttaagtgagtttaaactggatgcttctgattgagccccagagccagtgctccactgccaccacctgcaccctcacttccccttgtttaagcatcttccaacccagtaaggctgaagagggaagcttcctgccttcccacttctcttagcagagtagattgatatgattattcagattgtacaagaatctattccctctgaagtattgcttgatgaatgagcccctttttctaatttgctcaaagaaatcatttgagcttgaggaaaactgtccagagggcacgaggaccagccgttgtgatatgtaacaaggtagagaaacaaaagctaaatgaagaagagtgagcctcagaatcaaagaactggatttggatccctttaaaccattttacaggggcctgaatgtaattaacttctctgaaattcagtttccttatcaatatgctggtgataagtgactattgtttgaagacagcataagcaaagcatgcagtacttaggagatgtgttcttccttcaattcctctattattaaaagatgggcacagggcaggggcttcagctcagaaggccttgttgagaatagaatggagagcaggaacaagagagaggggcaaaggcattgccagcattctctgttcggctgttctccacccactgcctttcctcctgcttccctctaagtccagggcattttcccttttgataaacttccccttttacaacccatccaagggtgaaaaacaaagtcattacttttttttcagtacctctaaggcaaagcagcagaaacaggcagtcaccactacgaataagtgactacaacaagagctaggccaaactctgccatgtgggctgcattttattgggccggcaagtaactttaaatcccagctcacactctactgagtgaaagtctgatgaacccgcatcttcttgtgaacaactgcgcctgagatcagtcatgcaagaagtagcacccccacccccagacaactaacttcccaggctgtgaccaacaagcagccaagaggccaggacagggaagtctcaggacctttctaggaaatcaatacctttctctgggtttgttctgcctgaaataataccaatctccctccaacagcttagcatgtgtggagcatttgatactaacagcaaccctgcaaggcaggaaggcagtagggagaggcccaagaggaattcagcattaaggcagtgagactgacagaggggaccccctgaggacattctggaaggtcttagccagggccaggatgcagacccttcatgtcactgtagctgagacgaggtgcaaggttcacagcatataacctaattttattacaagaatgaagactcagagtttaaatactcctgctttggggctcattagtaacaagttctccaatattcaaaaggcaaagtggatgtgttttagtgtaaaattaacactagctgctgtaacaaataagcccccaaacatatgatatctcaaacaccgtaggtttatttctcactcacatcagagtcaaaatggatgtttctaacctgcagctggggcttctcccagcagtattcggggcactttccatcttgtggctccaccgtctgtaatgcaggactccaagtggtggaagaggacggagcagaggagtcacacatgggtgtgtgtctggcccagggtggaagtggatgtgcatttcttctgcccacctcactcacaaggccacaccccactgcaagagaggctggagaatgcggactggatttaaacccaagaagaagaaatggttttctgaatagttggccatttactgacacaaaaagggtcaaagtgacttgcagaggagatgaattttaaatactataattatttccttggctgccctttagacagaatttatttctttttcttttccagttaaacctgaggctccttttgacctgagtgtcgtctatcgggaaggagccaatgactttgtggtgacatttaatacatcacacttgcaaaagaagtatgtaaaagttttaatgcacgatgtagcttaccgccaggaaaaggatgaaaacaaatggacggtatgtagttcaactacattaataaaataaaaacttatgaatgttttctattttgttggcctagtagtgcatttcccctgggagggcccaacaattttgctttcaaaatctaccttctactgaaagaatctcccaatattggccccatgaaaacctggatcttccctgatgcatactcttctagctctggttgttttcttctgctctaattttggtcttcagaatgtttctacattagtgagttggataacaatatagattgaggccaaattaatcctctgtattcaggggcctcaaaaagtgtcatgtctagtgccactttcataggcaaatcaggcaaaatgtatatctgcttatgatcaccaagtcgtagccacattctggcttatgagattcatgggaccagcatgaggtaaagaaaagaggcataatgtttgcctttgttttgtttttattttaaagcccaaggtctttgtttttgaagtaacagcttaatttttacccttcataatcaggagagttacttagatgctctcttcatgatttgttgaggttggaatgatttggcagtccctgaaatttattttggggaggaggtggcagaagagtggagtgtaccaggttatgagatttctcttaacccaccaacctaacttctgttctttctgcacctcagagatgaagaagagatgatgatttctcttcctcaagtccttcttattcttgctgtcctgttttttcaggccaagattggccttgtttgtttgcagtgtgatgcaagatgccacttgcataaatgtaacaactgccccaaaccacctgctccctccttctactcacccaccccacccttgatcctgccatctttcattatacatctgaaaattgcaccaattgaaaagcaacttagtggagaaaggaaggattatgaataaatgctgccaggacaattagttaactaaaaagaaaaatagataaattcaataaatacatgaatttttttgagatggagtcttgctcagtcatccaggttggagtgcaatggcgccatcttggctcactgcaacctccgcctcccgggttcaagcaattctcccatctcagcctcccaagtacctgtgattacaggcacccgccatcatgcccggctaatttttgtatttttgtagagctggggtttcaccatgttggccaggctggtcttgaactcctcacctcaggtgatctgcccacctcagcctcccaaagtgctgggattacaggcataagccaacacgccagccaaaaattgttttaattaaaaaaaattaaactaaatgcctagccaccttcatataacaacaacaaaataccagatgatttaaggaaattatataaaagtgaaactctaaacaaattagaaaaattatagccaaatgtttacataatcttgacatgaagaagaacattctaagcatcaaagctgtagaagaaaagaaaggattgagacatgcaactacataaaaagtggaggtttatatatgtcaacacacacaataatcaaaaatcaaaaatgcaaatttaaaagtaagcttaaattgccacataaacagctgatagatggttagtatcattaatagataaaggactcttataaatcattaaaaaaacaaatatcacaatagaaaaatgagcaaaaaaattgggaaaaatctcataaagtatggaatagataaattcaataaatatatgaaaatgaactaattatcaaataaatacagatataaatagcaatggacttctttttatctgtcaaattgatagagtggtttttttttaatcttaaagataatacgctgtgtggtggagacttttgtctctttatcactattcacaatgtaaaatggcgtctttctggagagaaatgattcctgctcactaacctaacctaacctttcatctccccttaatatgtgaaaggatagagagaaaagaagaagatattgaagtgtggaaagggagatcctgggcagtgcctaactcacctgaataagacccatcatttcactctcctccttgaccactcacaacatcctttataagctcagattctgtccctaattttgctgttgactcctttacgtatcagagctccttattctaacaaatacgagacaacttcagagaatgcttatgggactaaaggaatcccaattgaaatgatttgggagatttaggcaacacctcttttcccatcctaagaatgtaactgcactctactctctagcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggtaaggaatggtggtagagtttttgttccctcagagtgctttgcatgtcaaagtgtgggagcaagtgagaggaagattgttgaaactaacctgcaaaataggacacccttggagggcactcttacactttctttggagaatgacttgcctgctgtctttgcgccttttgtgaagaacaaggaagcagagggagtggggtccttattagctgagaattagtacaagccatctgtattcctggaagctgccatacattttgaacaaaatccccacccactacgtccagttaaccaatttagcctgggaccccaatggctgctgtctctaaggcccctttaagaagcacctttattggtgtcaggtatgcaggcaagtgcggctgtcctatgtctccttttccagaaggatgaagatgtctttgggactggaactgagaatgtgtaggaactgagacatctcctccctaaaatttgcaacaggggtgaacatccctctcatcatctcctgctctggcttcttttccttggtagaaagtcaagaagggaagagagcattggtacctttgatgctagatcacgtttacatttcaagtggcagatgctctgggcctggtcacccaagtcaatgccttttaaaccaaaatccctccataaagctgtcaaatatgtctcttaactgaaaagcaactttcaggaaataataagtgggcccacattactaagtaaatgcaaagcaccctgagaccctacccccactgcatggctactgaatgctcaccacaatctattcttgctttccaggggagatggatcctatcttactaaccatcagcattttgagttttttctctgtcgctctgttggtcatcttggcctgtgtgttatggaaaaaaaggtgaccttcttcaactaataaagagggtgattgtgtgggatcacggacagtcagagcttaagccccatttattgatgagaaaaccacaaaggggattaaggcatttcacgaatttagtgcccagtatccctatctatcctcagcgaatttccacagttaatttcataagaggcaaaaagatattaactggacattaggcaaacgctgtccccaaagtaagaattccgtaatgcaatgtttcccaagcttttcttccagtatctcctaaaggttgcagaagccatcattcatggcaaatgcacaatgtacttgaagtcttgactttaagcatataaattcatgggattttttatactaatccatgctaaggctatgtttgtttcatcataaaaatgatgttttaaacatgcacttgttaaattacttactattctaggagaatgcccttggcagaaggctacatatccccaggattacaaataccctaatttgaaaagtactgcctggaaagtactaagcaatttccctgggtaatttgaaaatattcccccacttccaccaaaattagctgccagagttgctgtcagtaaagagaggaaataaaaagacaacacttaaattgggagtaaacaacggggttaaatttacttccatagctgcaccaaaattacctccttgcaagccttggtgttccttccctctagggctttttcccagaggtatattattgtcatgtcttgttcacagaatggattgatatctgtggtctctggtccaacccctccttgaattgatagggccccgaggcccagagaaagccagtctcttgaccatggtcacccacctaattgtgttagagccaagactagaaatctgttcttctgattccaagctcagaataagtgggaagactcagtgtgcctgtgccctctgccattcacttcatctatcaatgttctctgatttcaggattaagcctatcgtatggcccagtctccccgatcataagaagactctggaacatctttgtaagaaaccaagaaaagtgagtgtttttggtgcttaaaaagtgttgtgttggcaacatcccagtggccaagaatgatattccaggacaaggaacagttgaacctcaccttttggtatttgattcatcctgtaactagggtccctcctaagaccctagctgcagtagggaactgaaataagatacacatctcagaacttctgggctccctggggctggagggcacagccagtggtcacttcaagtcttgaagtgtctcagaagctccagaagcaaagagtccattgaggaacatgctggcaattctgtgacattccctgtcagaaaactctatagacctactcctgaactgaacatttgatggtgtgtctctctggtgccatcttaataccctttctcctttttctgtgcagaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcatcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctatttaaaaaaaaaagaggaaagaatgaaagagtaaaggaaatgattgaggagtgaggaaggcaggaagagagcatgagaggaaagaaagaaaggaaaataaaaaatgatagttgccattattaggatttaatatatatccagtgctttgcaagtgctctgcgcaccttgtctcactccatcctgacaataatcctgggaggtgtgtgcaattactacgactactctcttttttatagatcattaaattcagaactaaggagttaagtaacttgtccaagttgttcacacagtgaagggaggggccaagatatgatggctgggagtctaattgcagttccctgagccatgtgcctttctcttcactgaggactgccccattcttgagtgccaaacgtcactagtaacagggtgtgcctagataatttatgatccaaactgagtcagtttggaaagtgaaagggaaacttacatataatccctccgggacaatgagcaaaaactaggactgtccccagacaaatgtgaacatacatatcatcacttaaattaaaatggctatgagaaagaaagagggggagaaacagtcttgcgggtgtgaagtcccatgaccagccatgtcaaaagaaggtaaagaagtcaagaaaaagccatgaagcccatttggtttcatttttctgaaaataggctcaagagggaataaattagaaactcacaatttctcttgtttgttaccaagacagtgattctcttgctgctaccacccaactgcatccgtccatgatctcagaggaaactgtcgctgaccctggacatgggtacgtttgacgagtgagaggaggcatgacccctcccatgtgtatagacactaccccaacctaaattcatccctaaattgtcccaagttctccagcaatagaggctgccacaaacttcagggagaaagagttacaagtacatgcaatgagtgaactgactgtggctacaatcttgaagatatacggaagagacgtattattaatgcttgacatatatcatcttgcctttcttggtctagactgacttctaatgactaactcaaagtcaaggcaactgagtaatgtcagctcagcaaagtgcagcaaacccatctcccacaggcctccaaaccctggctgttcacagaaccacaaagggcagatgctgcacagaaaactagagaaggggtcataggttcatggttttgtttgagatttgttgctactgtttttctgttttgaattttcttctttgttctgtttttactttatttagggggactaggtgtttctgatattttagttttcttgtttgttttgttttgtgttgtctgtgaatggggttttaactgtggatgaatggaccttatctgttggcttaaaggactggtaaaatcagaccatcttattcttcaggtgaatgttttactttccaaagtgctctcctctgcaccagcagtaataaatacaatgccataatcccttaggtttgcctagtgcttttgcaattttcaaagcacttccataagcattccttccacctccttgataggcatttatggaaagcctgctacatgtcaatcatactgttaggcacaggggacctaaagacacataaaaggatggcattctgcctcataaattgcaaaacctaatgaaagtgactgcttggtaaacaaattattattatattataaaatgctataaaagagccatattgaaagtgccctgttggagacagggcaaatgccacaaaaatgatgtaaatttacatggaggaaaagtagaatctgcctggtttgtaggcagcagaagacatttttcatcagtgggcaggtgttctttaccttttgtagaaatgggagtcaagtctcaaataggaggctccacaaaatctcatgccaggtctctgataccttattcacagaagttctttgaagtatttattgttattttctttgacttatgggaaaactgggacacaggaag

SEQ ID NO: 621 - DNA, 29201 bp, Human
taatgaaatagagttctttaagcataccaaatttacaattttattttcaaattttaaaatttacttttggtcagaatgcagtaaaatgggtactttaacacaatcaatgctagttagaaggtatattgatacaagacttttggaaagcaagatagaaatatttgtttaaaagagaaaaagcctttaaaaatattccctaccagttgactcaatagttccactgtaggaaatctattctaagcgatcttaaattcacaagattttgtagaaagacatttatgacaatgttatctttaatattaaaataatagaggggatgttaaactatgataatttgcagccattaaaaacttttacaaagagtctgtaataatggagaaatctctacttcataaatgtccatagaataaaaaatgctctattgtatacatgctatgcttagcctgcattcaataaaccctcaatatatttgacaatattaaggaatattgttaatttttaaatttgatcttatcatcttgagatttattattaagtattgagagaaattgaataatgtgggatttccccagttggagtaagggtggctattcctgcttagaaaaaaagaatggaccttgtgtggtcactgccggatggtaggttcattattctttctactttttttttttaaatttaagagacaggaactggctgtgttgcccaggctggagtgcagtggtgcgatctcagctcactgcaacctcagcctcctgggttcaagtgattctcctgcctcagcctcctgagtagctgggattacaggcgcccgccaccatgcccagctaattttggtatttttagtagagatggggtttcaccatgttggccaggctagtctcgaattcctgacttcaggcgatccacctgccttggcctccgaaagtgcttggatttcaggagtggccaccgcgctcggccctaaattcttttatttaacttttaagttcagggttataagtgcaggtttgttataaaggtaaacctgtgtcttgggggattattgtacagattatttcgttttcaaagagaatttgcaagtatgtcacaaaagcctcataaacacgttgtgagattttaagaggcaatgaccgaggcttggagatgtctcgtcctgtccaatgtcaccgctagacctgagaatctgcacttgggagcttacagacccggttctcaggcttcacttgagaccccaagaaagaaaaaaacccaccagccaaagaggaggatggcagcctggaagaacctaaggaagcgaggctcagaggtgaagcactgtggctcctctcccccttctcccccctccgccccctctccttctaagatgaggcattttctaggggagcaaagctgcagcaggaattcggcgaagtggcggagctggggccccagcgggcgccgggggccgcgggagccagcaggtggcgggggctgcgctccgcccgggccagagcgcaccaggcaggtgcccgcgcctccgcaccgcggcgacacctccgcgggcactcacccaggccggccgctcacaaccgagcgcagggccgcggagggagaccaggaaagccgaaggcggagcagctggaggcgaccagcgccgggcgaggtcaagtggatccgagccgcagagagggctggagagagtctgctctccgatgactttgcccactctcttcgcagtggggacaccggaccgagtgcacactggaggtcccagagcacgacgagcgcggaggaccgggaggctcccgggcttgcgtgggtaaggtcctgggtccccaccgggcacggcccatgcgtcccggggacaggggtggctgtgcggtgccgcggcggccggcggggctccttccccagcaggggtggggacgctgagtcacggatctgtcaccgctttgcacctctccgagccctcgggggccaaagcaaaagcgaaagcgaatgcgactggcggggcggcaggtcccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggtagggagctgggagcaggggcgcccgggcgggacttggaagggggccgggacgtggagctggagggaaccgggcgccccatctccccgggccgtgcgggggcgtcggtgccctcgggagcgcggtgcgcgcaggcccaggccggggaggggacgcggcgccgggcaggagggacacgtgccgggagccggggtcgcagggagagcgccgccgctgcgcccgggtcacccacgtaagggagcgggcggcctggctggggtctccgaggccgaggtcaggagcagttctgagaagcccgttttggccacgggagcgcggagccggcggcgtccagcagtttggagacacgggcgagtgcgcttctcccaggcgcctggactgcagggcgggtgttgcatagcacgcggtcctcggaggggtccgggagaaactactcctcccgactcccaggcaaaagtaaattatgtcagtgggagctgggagggtggggaggagctgtgtcccagggggaaacgcgtcgggcaagttgcacacctggggacctggaaacaacttccaattcttaagcgatcaggaaaccagcagaggcggtcgggaccggatgggggtggggagtgggggccagcctggagtctacactcgcagaaaaagggggaagagatctgtgatcgcttggtgtattcgagaagaaagcgggtcgcggagctctgatctcggcagggaggacggaatgagcgattcctaggggttttgtcccggcagccagaggaaggaggaaaacagtagcagggtctagctctatccttgtcagcgcttctttatctttttatagtcagggagctcttggagggtctgatgaaagctatgaacccccggcccccagaaaaatgcatgaatgaacatagttacaaaatgtgcatatgattttggggtcaaagccccactgaaggccatccatggactctctataggaattagtaacgccatgatctgtgtgtgtttttaagcgagaccctgaataatttacatccagtcgggccagtctgcccaggccctggccaaagccattccacgcacagttgctgctgcctggtgtggcctgaacgcccccccaccctctgccacccccaccccagctctgcgaggcttcttgaagtttcgttttcatgagactctgatgcttggatttccccccacatctgagaagcagagttagttggtgaccggttggttcctcccagttggctagcagtgtcacaggaccccatagctggcaactggggcagctggattacacaatatgaaagtgaaatgcagccttagtcaaagcccagcagagaggaggtgtcttccttgaagactgagtggataggggagcaccactgtgagatctctgatctcatcagctgcacagccttgccctttgaccttagaaagatgttgctaccttcccttcccaaagctctcaatgttttttctttttctttttctttctttcttgttttcttttttgagacggagtctcactccgtcaccccggctggggtgcagtagcgcgatctcagctcactgcaacctccgcctcctgggttcaagcgattctgctgcctcagcctcctgagtagctgggattacaggcgatcgccaccacgcccagtaacttttgtgtttttaatagagacggggtttcaccatgttggtcaggctgatccaacatggtgatcactcctgaccttgtgatctgcccgcctcggccttccaaagtgctgggattacaggcgtgagccagcttgcccagccgttgttttttttccctttaacagccttattgaggtataattgaccgacaataaactgcatatattgaagttgcacactttgataagtttggaggtaaatgcatacatactcatgaaaccactgccaccaccaagagtgaacacaactatcactcccaaagacttcctcatgccctgcacagtcctcatctcccacctcgcccatctcccaggcaatttgatgcactttctaaaattttttataaatagaattacacagtaggaactctttcttgtttggcttttttcacagacagtaattatcctgagaatttatccatgttgtaatttgtataagtagttcattagtttctaccattgagtagtagtattctacccatggctagcccatcatttgtttagccattcacttgttaagggacatttgggttgtttccagtttgggactattacaaagaaagctgctatgaacactgacatacaggtttctgtatggacacatgttttcatttctcatgggtagagaatggttgggagtagagtggctgtgttatatggcaggtgtatgtttaatttttttttttttgaaacaatgtcacaccattgtttcccaagctggagtgcagtagcatgattatagctcactgcagccttgacctctcaggtgtttaatttttaatttttatttatttatttttaatttttatttatttttaatttacttattttgagacagaatctcactctgttgcccagactgaagtgcagtggctccatctctgctcactgaaacctctgcctcctgggttcaagcgattctcctgcctcagcctcctgagtagctgggactacaggcttgcaccactacgcccggctaatttttgtatttttagtagagatggggtttcaccatgttggccaggctggtctcgaactcctgacctcaggggatctgcctgctttggcctcccaaagtgctgggattacaggtgtgagccattgcacctggcctcagaagtttaatttttaaagaaactgctaaaccatttcccaaagttgttatacgattttacattcccacagcagtgtagggaagttccagttccttcacacccttgtcagctcttggtatgatgaatctttttaattttacccattctactaggtatgtagggggtctccccttgtagttttaatttgcatttttctacagctggtgatgttatgtgcttatttgccatgtatatatcttctctggtagtatctgtttatattttttttgctctcttaaaaattgaattgtatcagctgggtgtggtggctcacacctgtaatcccagcactttgggaggccaacgcgggcagatcacttgaggccaggagttcgagaccagccaggtcaacatggtaaaaccccttctctactaaaaatacaaaaattagccagctgtggtagcccatgcctgtaatgtcagctactcaggaggctgaggcaggagaatcgcttgaaccctggaggcagaggttgcggtgagcagagatcgcgccactgcactccagcctgggacacagagcgagactgtctttttttttttttctgactctgtcttatgtataaaaaattgaattgtatcattactgaattttgagagttctttatatattctggatacgaggccctaatcaggtatatgatttgcaaatattttctcagattctgtggcttatcctttctcttagcagtgtcttttgaaaagcagaagtttttaatttttatgaagtctaatttattaatttgttatgttgtgttttgggcttttggtgtcatatctaagaaatatttgcctagcctaaggttacaaaggtttacttctatgtgttcctctagaagttttatagctttagggtttacatttatggctgtgatccattttgaattaatttttgtttataatgtgaggcatgaattaaaggttgttttgggattttgtttgtttctatatatgcatatccaattattccagcaccctttattgaaaagattatcttcactgaccttctcttataccttttgaacatcagtcagccatatgtgtctaagttggttgcagtatacaaaacaccactacacaaaaatcagttctatttctatacattcacaatgaacaattagaaattaaaaaactttaaaaagtcatttgaaataacattaaaaagcattagatacttacggataaatctaacaaaagatgtgaaagacatctttcatatatggaaaactacaaagcattgcttagagaaattaaggaacaaaatcaatggagagatataccatgttcatgggttggacaaatcaatatcactaaggtgcaaagtctccttcttgtgctactatgcacaacaagttgttgccagtctgttcttatttaaaaggcctgatgtgcaggggcgtccattatgttgggtagaaggtcactgacttcttagagagcatttcagtctgaaagattgcgggcgatggccagaagcaactgagaagactgctttgtttgaagacaaatatccctagccaccaatttcagttcgctttttttatgtaaggtgtaagtgcacttggggttgttttcacaacttttcatgtgtctttaagtatttttaagccatttttcagaactttaggggtcttttcccaaaccttttattttttatttcctatccattttatctagttgttactgcttctttgcctctactgatagcaaaaaagtggtgaaaacgtgagtgtataaaacatgagatttgtcaaaatcaacataaattttaaacagcggaggactgagtaaataaaatggagttgttttcaagtagtagacatcatatgattcatttttttactagaagaagatcaagaagtagttgtcattgaatggggaagatgtcatgtgttggtcatatgtgggcatgtatgcagttgtctgccctttcttatttttctgccataatttgaattgttttgtaataagaaaagtaaataaataaaattacaaaagaaatagcacaattaagatccagaattttggagttttttctaattcatctttaattatagctgatcttgtctggcaatgttttcatgactttacgaaagcttgtccaactcacaaacacttgtccactgcattccagcctgggcgacaaagcgagactctgtctcaaaaataacaataaaaataataacagtaataataatatgtatctaaatgaataaatatatatgaaactcctcagtatatatcgtgggagtcatatcagtgttgctcattggacatagttgatgtgatttgaatgcttcttcttggaaaggcatgattcccttctgtgcagtggggagtccctgagggtttctgtgcaggggagcattactggagctgcatggtggaaaggttgctcttgttcagagtgtgaagaatgaactgtagtcaggagactccagagaataggagctgcattgaggtttttgaaatcgttctggtgggtggtgatgaaatcctgaacacaggcggtgtcaatgcaggagacagaagaggccagatgtcttctcgagtcctaaaactatagaatgtatttcattactttcctttcatttgctcttcaacctgtagccctcaactcttgcaagactccaataatcattatttaaggattcgagttatggagaaattcacctggcacacaagaggtgggtcaggaagctcagttaatgagtctgagagagaaagaaaagaattgccaagtttcaggcagtgagctggagacagtctgtactttttgggaactccaaaaggaagtgtgttgacttggctgacatttcagcggggaaaataaggaaggaaggtgatgggtgactgtgaggccagaggcctttgccttttccgtacaccagctccacagtgagcatcctgagggcaggaaccatatctgacacatctctgaatcctaccacccttagctcgtgcaggcatttgaaaggtgctgtaagcgaggggaatgttggagtccattctgactctgctcacaggattgggagccacgctaacccgacaacctctgaactctggatatggaaccaggccgaggctgccagctcttattagactctgtaaaccaacctgatagataaggaagtgtgattcacaggttctgggaaacagaaagaggtgtggcctcatacactattttggtgacttcatttaaatgatcgttaggacttgttgtatatgttttttggctacttcagagttttgaaagtcctagagccataagtttactccaatttccattacttcataattccattatatgtattcagaaaatatctatcgtataccagccgtaggaaagtgagagtaccacagaactgtgaaatatacataccatctgcaaggagcttataatattgtaaacaaggtgagacttgtttacattgaataactagggaacaatgttatgagagaatatatagaaagtataattcaagtatctaaagatgtgattaaggcatgtggaaatgaagttattgcttcaattaaatgtattatctctggaggacggcttgagttcaggagtttgagaccaggctgggcaacatggtgagaccccatctctaggaaaaaaaaaattagccaggtatggtggcatgtgcctctagtcccagctactcgggaggctgaggcaggaggattgcttgaggccaggagtttgaggctgcagcggggcataatcatgccattgtgctctagcctgggtgacagagctagaccctgtctcaaaataaaataaaataaaataaaataaaataaaataaaataataatgaaataaaataaaatcattttaaaaataaaataataaaatgaaacagtgttagtaatatcaccaatatagttatgagacagtccaactttataaagtaagtaactggccaccatttgcctggttggattggctgtagtacattgatatccttgtacattcaaacattaactattcacagatttatcttggtttgaggaccgttcagaatggaagaaccactgatagacttcctttctcagcaaaatgacagagtagataccaaaaaaccctcctgctacaaaaacacccagaaatgataaataatatagtgcaaatgccttttaaaatcctgagctgataaacaataatcaactgtttaaagcaaaataataacaatgtgtcatggggtataacgtatgtcaaagcaaaacatagaacaatagcacaagggcttgggggagagactggaagtctgctgtttcagatctttacaggatatgtatgtggtggtataacatcaccggaaggaaaactgtgataaggtaaagatatatagtggacaccctaaaacaaccactaaactagtacaacgagttatagttaataaccaacaaaggagataaaatggaatcataaaacatactcagagaatctatgatgtgatcatctccataggaaatcatatggaatctacaaagctgctattagaataagtgagtttacaagggtgcagaatacagagtcaagacaccaaaaaatcaatatgcaaaatactagcaacaaacaataagaaatcgaaataaatatcataccatttgcagtgacataaaaaatatgaaatacttagggatatgtctgacaaaagatgtacaaggctggcacgctgaaaattataaaacatttctggagaaattgcagaattcttaaataaatcaagagagataccgtgttgatgggtttttaagaagactcaatattattaagatatcaattcttccccaaactgatctttaaatttaatgaattccaatcaaaattttagcaggcttttgttggtagacattgatacactgtttgttaaattcagtaggccaggcggggtggctcacgcctgtaatcccagcactttgggaggatcccttgaacccaggagtttgagaccagcctgagcaacatagcaagacctcatctctacaaattaaaaaaataataactagctgggcatggtggtgcacatctgtggtctcaggtactcaggaggctgaggtggaaagatcacttgagcttaggcagctgaggctgcagtgagctatgatcatgccactgcactccccgctgggagacagagtgagactctatcttggaaaaatttaatttaatttaatttaatttaaaaaatttaatttaaaaattttaattttaaaaatttaattaaattaaaaaatttaatttaaaaattttaattataaaattttaattaaatttaaaaatttaatttaaaaaattaatttaatttaatttaaaaacaaaaaaacagtaaaggatctagaaaagcaaactcagctttgaaaatgattagcacagtaggaggacttatactacctgactttaagacctatgacaaagcaacaataatcaaggcagcacggtattggtgtcaaaacaaacagacacatagatcgatggaatcgattggtgagtcagccagaaacacacacaatacacttagtccttgctcaggatcctacacaaacagccctggaggtccacggctgctggaaatgggcagggaacacttcctgtacaaaacctgttacagatgcaagagacaggctggctgtcctggcgggaaggagcagaatatctgaaagcttcaaccatgaggtccagacacacgaggcctgcgtgagactcaggacaatggaaaactgcccccagtgccaccaccatcggacaagcaggcagcaagcaggtagcacagccatctatcatggagggcaggatggggtgggcaagtgtggagaaataacactctgtggtttaggcaggtagagaaggacagaagatcagtgtggagcagaacatggagaaaaagcctctgacactccagcaccagatagcaccagaggcctcaaagccagtggggctctgcaggtaaccatagcaacagcagcatccaaatccacctcaacaacttgtgagatcgactccatctctcacgccatcagcttagcagaagatgtgtcctcattggaatggggagtagtggcggccactggacaatagatgcctgagacaggaagtgagcagagcgctgcccctgtgacagaggagaaggctttgggatgggagttgaatggaaagaacaatcttgaatttgagatttctcccctcccaccctgcccccagcctgcctggtacaggatccttcagaagcaagagcagaggtcatggaattctaacagggatgtgttagtgaggtttgggatgtttttgtgtggacttaggtgatggctctcttgtgactcacccactgtgtcctttgcccagttaggccattagggtatttgtcttgtgttgatttttataagaattctctccgtgctaaggttcttaacactttggcatttgttgctaatgttttttgtttggttggtttgttggtttttggggggttttctgtttgtttgagacagattcttgctctgtcacccaggctcgagtgcagtggcacaatcttggctcactgcaacctccgcctctcaggttcctgtgattctcctgcctcagcctcctgagtagctgggattacaggcgcccaccaccacatccagctaattttttgtattttagtagagacgggctttcaccatgttagccaggctggtcctgaactcctgacctcaggtgattcgcctgcctcagcctcccaaagtcctcggattacaggcgtgagctaccgcacccagcctattctttatcgaatttacttccggccacacttgcacttttccaggggcatgtaccaacaactgtaactaaacaacacctgtcacttccaacagagctgagctgtgtccattggttcatccactctctctccaatgcactatatcctgggaatggaaagcattccaaaatgtatgaatgaccaaccagagctgaaagcaacagcagcctttgggaaaatgatgcttcatggggaataaggtgtctttgcagttgcaaaggaatgatctgatcttggccgggtgcggtggctcacacctgtaatcccaacactttgggaggccaaagcgggatgatcacaaggtcaagagatcaaggccatcctggccaaaatggtgaaaccctgtctctactaaaaatacaaaaattagctgggtgtggtggtgtgcacctgtagtcacagctattcaggaggctgaggcaggagaatcgcttgaacccaggaggtggaggttgcagtgagccaagatcgtgccactgcactccagcctggtgacagagtgaaactccgtctcaaaaaagaaaggcaaggcaaggtaaggcaaggtaaggcaaggcaaggcaaggcaaggcccgatcttgcaagtactgccaagctaacacacacatgtgcacacacaagggagtggatttttgagatggaggtgggagaatttgatccagttaaaaactattagaatagaaattcagggcctggcatggtggctcacacctgtaatcccagcactttgggaggccgaggcgggcagatcatttgaggttaggagttcaagaccagcctggccaactcccaggctagagtgcagtggtgtgatcgtggctcactgcaacctctgcctcccaggttcaagcaattctcctgcctcagcctccccagtagctgggattacaggcgcctgccaccacgcccggctaattttttgtatttttaataaagatggggtgtcaccatgttggccaggctcaaagatgcatttctaaaggtgatgctggccgcagagacctgtgggagagcctgcagggggcctatctggaggcacttgctgtcgttcagtgagaattggaggctgggtccacggtggagaggggtgaagactttaagagagactgagggcttggagaggggtgggaaatgaagggagagggtgtttcatcgatgaccctctccccacgccctcatctgtagttttgctggctgactggcacttcaggcgaggctccaggaaggcttctgggtgaggatgctcttcctgtacatcctccacgtgcctggcacctggggcttgtcctgaggcacccctaggataagctggacactgactaccgctgcgtgtgcctggagaacgcctcttacaagtggaaacctcttcaccgtcccctgtcctctgcactttcgcaggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagtgagtagcccttgccaccccaccttcctccctcccccaccctgccaaggctgcacagagagaagaccccatctcaggggtcaagggatctgtgctgaggtctgaggctaaacacaccagtgggggccgggcacggtggctcacacctgtaatcccagcactttgggaggccgaggcgggaggatcacttgaagtcaggagttccagatcagcccggccaacatggtgaaaccccgtttctactaaaaatacaaaaagtagccgggcgtggtggcaggcgcctgtaatcccagctacttgggagggttgaggcaggagaattgcttgaacccgggaggtagaggtcacagtgagccgcgatcacaccactgcactccagcctgggtgacacagcaagactccatctcaaaaaagaaagaaaaaaagaaagacaccagtgtgatcctcagcaacagctcctggcgttggaaacacacaggtgctggggtcacaggattctgggtttaaatcctggctttgccgcctaccacccaggaggccttgggcagctcttgtgatattctggcactctggctggtcatctggaaaacggacttgatatccacactgcgggctgtgggagggtggcgtgaaccctggtaaatattaactcttattacatgtagtgctttgatttgagacgatgctggcaagagaatttggctgcagagctgggcgggcactcatgagcacgctagtgtgagaaatgtttggatttcccatgagaaggtggatgttggaagccatcactgctcctctctcagtacccagccccggggatgggcacaggccctggagcagggctgccctttgctcagtcacctgtgcatggtgtccagcaggggtgagggaaggtggcaagaatcaactttttttttttaactgtctgcacctggataaacgtcccagaagcagccaaaccatctcgggtgggaaccacttggagctgtttctggaacactcaggcccacctctgcaggcttctctccttccccagttcatctctggggcagggatgagcgcgcccctgcatggagcggccccatagctcacgccctctgcagcaggggacagaggggagctccttgaggcgctggacattgccactggcttggtagtggtagctcagcctcctcccccagaacagagcgagtcacacaggcagcagagggaaggcagggaggaagcctccgacttgttccaagaaatcactcgctggggacacagcaccccgtggcatcagtgagtgaatgggaaagctgagcgtggcggggtgagcaggatctgtgggaaccacggtgggtcttactctgccagtcctgggactccctggaacctgtctgcccgaggtaaaatgagggctttctcactgcagggcaagtcaggtctcctcgacactccatgtcctttgggcaaatgaatccgggatggagaagagctatgggctccagggtcaggatgggagaggaaagaagagaacccggaatcaggattttagagtccaaagactggaggcctctttaggtttcacctagcccaaaggatccttccacgttctgatcactcacaactccctctgttatgcttcccaaactcttgtgctttgaatgacttttttcctgctcaacaagtgaaatgtaagccaggtatggtggcttacacctgtaatcccagcactttgggaggccgagatgggagggatttcttgagaccaggagttcgagaccagcctcagcaacatagcaagaccctgtctctaccaaaaaaattaaaagataaaaattacctgggcattgaggcacgtacatgtagtcccagctactcaggagactgaggcaggaggatctcttgagcccgggaggtcaaggctgcagtgagttgtgatcacactactgcactccaacctgggcaacggagcaagaccctgtctcaaacaaacaaaatagaatctattgagtgatcatttattctcccaagaataaccagcattataaaattgaattgatatcattaatataatctcagccaaaataaatttgatatttaacttgtgcagtctttttggaaatgcaagaaaaatagtttgcagtctatctttgcattcgggtggggaaacattgtttcttatgcttttaacctgtctgaggaagccagaggcctccactgtaagttcatgtgttgatatattttatttgtatcccgttctgaagccagcccaggttccaggctcaggatcataagtgccatgtggttatcctctctctaggagaccctgccctggttcaccaaaggccagcgccaccctccacagtaacgacggcaggggtgaccccacagccagagagcctctccccttctggaaaaggtaggaaggtcagaaacttctcgaggacattcattccctcccaacacccagaggcccgctcaccaatcctgcagactcacggacctctgtggtgtgccactgcagacttaggcaatagcgcaaacgtcttattcaatcaagaataagaacgtccaacttaattttctttttcaaatcaaagttgcttgatatccaggtgttatatgtgcagaattaatagtggtttaaaactcactaatatgtcatatcaaatttagttgtagacacttatctttgtcaagaactgaaagcagactgaggtttgaggttgcatgtgtgttagccctcaacattttcatgggtgctggcagaaaagagggcactccaggatgggaggccagcaggcagcgggagcttcagcatgtttacatcaattccctcgtcccctagccagcaggggcagcacagttgggcctgaacagatgcctgtccactcagcgggctgcactgtgggagaggaagcctgggcttccgagacccaagcgttttgtcatgggcagtaatcacacctgctctctgctccaggggagaccatgtccccgtcttccaaggcgcttgctgtagaagcacccttgagaggatggtccagagaaagggccatcagctcctctgtctgcaagatgtgcaaaaatgtgagagacctgtggagagctgcccccaccagacctaaacaccagcacatcccagtgactgctctattatagaggcgctgcctgaagctgccagtgtcctgtgtttcaacagagtctttggtgcttgtcaggcccaatttcctcagcgctttctcagtgttcagaaaatttgaaatcttggatgctttcttgggatcctccgccctgcatgctatgatacctttgtgctacagttcactcttggctttagtgttgcatcgtccagcctgtggctttccctggtcctgtctactcctttgcccccggggggatgggcctgtctgttgtcattcatactacaggactcagccatcctttgcggagtgtcagttgtcagccgtgggtacacactgacatcacctgggcactccagttggcctgggtgcaatctgggactcacgcctctccagccccaggtggatcttttttttttttttttttgagatggggtcttgctctattgcccagtctggagggcagaggtgaaatcttggctcactgcaacctctgcctcccaggttcaagtgattttcctgcctcagcctcccaagtagctgggatcacaggcgtgcaccaccacgcctggctaatttctgtatttttagtagagacagggtttcaccatgttggtcagtctggtctcaaactcctgacctcaggtgatccgcaagccttagtctcccaaagtgctgggattacaggtgtgagccactgcacccagcccacaggtggttcttaagtggccaaggctgaggcctgcatcttaagggaggaagaagcagctaaacaaggttccctcctagtgagtcacctgcacagggaggaaggggttgaggggctggctccatttaaacttgaagtaattctacaacccctttgatctgagtcacacctggttcacccaaggaggagaatgatcaagtaggctctcccagccccaccttcgcatccccaatacctggtccgatggccattgtcgagacacaatggtgcagtcagaagccccgatgtgacagcagcctttgacccgagctggcacgaccgtgggcacttggctgaggatgccttggtgcgtcctgtgcagggagccctggagcattggcagtgagcgtagggcaagttatatgaaaggtggtgacacaggattaaggggcgtgaggccttctcatgacctgtgtggctgggagaccatgggaacgcggcaacaacagtgcgtccagagagccacagcgcttggcctcacgtttcctagattccgtggctgtcacaatggaagacacatttttcatggagagggaacagcacagttacgccacacccttacagtgcaggggcagccaccttccagggaaggacaaggaagacagggaagacgctgaacacaaggcagcctctgttcctgagagcaagctcatcaggacgctttcctcccacacagcccggagagttcaggccagagcccaggcttcccgtgtttcacacgcagccgctccgagcgtcctcggccagcgcagcttcacctgctctcagctgagcctccagcgttgggcctgccttctctagtaaacaagctgaacgactcagatctttgacaccttttcttttcttccccccacctttttttttaagagacaggggtctcactctgtcccccaggctagagtgcaatggctcaattataggtcactgcagcctcaaactcctaggctaaggtgattctcttgcctcagcctctcagatagctggaactataggcacatgcccaccacacctggataatttatcgttattcttatttttgtagaaacagggtcttgcggcagggcacagtggctctcgcccgtaatcccagcactttgggaggccaaggtgggtggatcacctaaggtcaggagtttgagaccggcctggccaacgtggtgaaaccccatctctattaaaaatacaaaaattagctgggcgtggtggtggacacctgtaattccagctacttgggaggctgaggcagggagaattgcctgaacccggaaggcagaggttgcagtgagctgagatcgcgccactgcactccaaccttggcaacagagcaagattccatctcaaaaaaagaaggaaaagaaacagggtcttgctgtgttgcccaggctggtcttaaactcctgggctcaagtgatcctcacacctcagcctcccaaagtgttgggattataggcatgacccactgtgtctggctgatcttttctttatacgtgccgtgatagtagccatgttctttagtgttttcacaggtcctatggcccttccagaggaacggctatgtcaccctctcaaggagcagttggctgtgagagagggagggctggtcagggtgactcactatggcagctcccacatcaccccgtgctgcagctgagaggaggggagtctgcacactgatgttgtccctgccttggactctcctacagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggttagcactcgctttgccccaggagaggtcagttccccattgctgcttctgagatcggggctgagatccggcacaaggcagctttataccatcaatccaaagtcaggattcactgggcagcctgctggccccggccaccagccacggcgtcctggcctgacctctttctccgtggctttctctgtggctggggcagctgcaaaagcaagcccacacccccccaagatgtgacagggccagccttatcacccgcatggcagagcctgtgcagctgggagtggcatctgtgccctcctgcagtaggaggtggtgaagctgcctacagtccggggccaggatctgtggaatggaggagctgagggtaatggggaccttctgtaaggcttatctgattcttaagtgtggccagcacctcagtgagctaccctgcttgttctttgctaaaatgagtctggttacgccagccacgagtctcccagggtgctaagatgggagccaagccatgcagattttctcctgcttcatgaggaactaggacctctaggactcgagccgtgatgctgtcctctcttttccgcaggtgtgtatccacagggccacagcgacaccactggtaagtgtgtccctttgtccggtatgtttatgatcagggtgaccgcagtcccagggtgctgggtggtcctggcccaggcccgctgccccagcacagccctgacagcagccccttccacactcagaaggcctccatcagataataagttaagtaatagctgatttatggaattctctgtttgatgtgcccatttttctaaatattggtagcttctagctgtcaggctactggggttgaacccagagagctggcaccccaaataagggctcaaggtcagctcttcacagcagggtgcacctcttttgcatggagcatccaaaactacaggtgctgatgccagcactgacgttacagcatctctgccagaagctgccaattcctctccagggcgtggcaccgtgcacttaacagagaagctgtccacattttcggtataaaatgctactcttggccaggcatggtggctcacacctgtaatcccagcagtttgggaggccgaaatgggaggattgcttgaggccagaatttgaggccagcctggtcaacatagcaagaccccatctctattaaaaaaaaaaaaaaagaaaaagaaaaagaaaaaaagttaacaaaacaaaataaaaccaaaaatctgctcctctttacagaagtcacacgcaatgctaaggctaggagaatagaaaagagaacgtgcaagtgatgataaggaggaaaaggggaaagcgtttacaagactaaaagaaaaagctgaagggaggggaggagagctgagagaggaggggagaacaggaggaagaagggaagcaggcagggaggaagaacgcaggtaatgagaagaatgcaagtcatgctccaggctgacaagcttccaaagtaacaaaaaacccaactgtaatttgatatggacaaaaattattttaatcttctgttcataaatttttctgctagagaatgactcatatttttgtggtgtcatttttacctgcatcaaacgtcatctgggaaaacatcaagtgactttggacattttagcagttaattgattagaatcgtttaaaaaacaatcaggctgggcgaggtagctcacacctataatcccagcagtttgggaggccgaggggggctgatcactggaggccaggagtcccagaccagcctggacaacatgacaaaaccccatctttactaaaaatacaaaaaattagccagacatggtggcacatgcctgtagtcccacctactcgggatgctgaggtgggagaattgctggaacccaggaggcagaggttgcagtgagctgtgatcacaccactgcactctggcctgggcaacaggacaggaccctgtctcaaaaaaaagacgaaaagcaaatcccatttctaactcaaaaatccccttgcaggaaggaagcaacacttgctaccagatttccaggcatccttccagagagactgtataaataaacatatagaggataaggaatgctggacagttgcttcttttctccttttctgtaccatgtttgtttccacttgctggtataccttgtagatcctcccatatcaggacacaaaaaccatctcatcgtttttaacagctacagaatattccactgtatggaattcctaccattaatttagccaaccccctatctggacatgtgattgctacattctgttgttatcttacaaacagccattaattgaaaatccataggtgcaagaatatctgtaggataaaatcctacatataaagttcaggggtcattttttctatatacattttccaacaactatttgatgatgggctataatctataatctgcttttgctagttcatgacttttattagattaaaaaatcagccgggcgctgtggctcatgcctgtaattccaacactttgggaggccaaggtgggcagatcacttgaggccaggagttcgagaccagcctggccaacatagcaaaacaccatctctaccaaaaatacaaaaattagccaggtgtggtggcaggcgcctgaaatcccagctactcaggaggctgaggtaggagaatcgtttgaacctgggagggggaggttgcagtgagcaaactcgagccgctgcactccagcctgggcaacacagtgagattccgtcgcagaaaaaaaaaaaaaaagaagaagaaaagaaaaagttggccaggcgtggtggttcacgcctgtaatcccagcacttcgggaggctaaggcaggcggatcacgaggtcaggagttcaagaccagcctgcctaacatagtgaaaccctgtctctactaaaaatacaaaaattagccgggcatggtggcacctgcctgtagtcccagctactcgggaggctgaggcaggagaattgcttgaacactggagctggaggttgtagtgagctgagatcacgccactgcactccagtttgggcaacaaaatgacacttcatctcaaaaagaaagaaagaaagaaaaagttgtaggtagactggacgcagtggctcatgcctgtaaacccagcactttgggaggctgaggcaggtggatcacttgaggtcaggagtttgagactagcctggccaacatggtgaaaccccgtctctactgaaaatacaaaaaattagccaggcgtggtggtgtgtgcctgtaatcccagctactcagaaggctgaggcaggagaatcacttgagttcaggaggcagaggttgcaatgagccgagatagtgcctctgcactccagtctaggtgacagagggagaccctgtctcaaaaaaaaaaaaaaaaaaaattgcaagtgaaaaaaaaatgaaattggaaggaaaatggcactgtgtgctattgtttctaaatctgtgaagttgaagcaaagtgggcgttgtactggggacagcagaggaggggtgtgtccctgtctgctttttcaaccctggctttagcagcaggaatgctctctcctcatcgcactcttggctttgcccttgaggctcttactgctccctcctgacttgctccgtccctgccccgtcaccccaggcactctgcctgagaaggacaaggatgaggagcagaggtgtgggacgactgggagctggcaccctcagcaggaaagagaatgtgtttttgcctagacatagaatcgggggaattgcatggaccttaagaaatgtccttagcaggaggctggttgggaggcacttggatccctctgtaagaacatccatggtaaagaatttgtggttcgtagcaatgaatgtgcttctgggtatctcagcgtggtctcctccctttcagtggctatctccacgtccactgtcctgctgtgtgggctgagcgctgtgtctctcctggcatgctacctcaagtcaaggtgagttgcactggatactccctctgcaagagttagacttccccatgagaaaagagctgcacctggccgggcgcggtagctcacgcctggaattccagcactttgggaggccaaggcgggcagatcacttgaggtcaggagtttgagaccagcctggccaacgtggtggaacctcgtctctactaaaaatatgaaaattagctaagcttggtggtgcacacctgtaatcccagctattcgggaggctgaggcaggagaatcgcttgaacccgggaggcggaggttgcagtgagccaagattgcgccactgcactcctacctgggcaacagagcaagactctgtctcaaaaaaaagaaaaagaaaagagccccaccatagtgattccagaatgccccctcccaagaaggacgcctttcctggccatcggctctcacacaccccttctctaggagccaatgagtgccagagccgaggagcagtgagctaggcccaagcccaagtgccccctacccctgctcatggtagaaatggggcggccagagaaagtgcaccaggtggccaacgcgtgcagtcctacccattcttcttgtgataccctcatgaatatattcttgaaagtcctcattgaataggggtatgccttcttataaatatactgattcatgttagccttaattttgtatttctaatcattgaaattctgcatctcagcatttctggcaaaaatatttctgccacttgctaacttttttaatttttctcatttttttaatctttaggcagtattattattctttgattaaagcctcaaatggcattctagccttcattttgtacttctatcaattagtaaccagtattccagcattccatactgatacggatatcagatttgtccaaactaaacttttagttactattaatagttataaaacattcttttctaaatgtgatatcaatataaaaattatgtgaccctggctgggcacggtagctcatgcctgtaatcccagcacttcgggaggccaaggcaggcagatcgcgtgaggtcaggagttcgagaccagcctgaccaacatggagaaaccctgtctctactaaaaatacaaaataagcaggccatggtggtgcatgcctgtaatgccagctactagggaggctgagacaggagaattgcttgaaccagggaggcggaggttgcagtgagccaagatcacaccattgcactccagcctgggcaacaagagcaaaactccatctcaaaaaaaaaaaaaaattatgtgaccctttgagcctaattttgacaaaatgcacattccatgaaatgctactataaagtcaaaatgaaaaccagtatctaaaacttcacataaatcttcaaaagctgtgaataccatcccgaccaataaaaaagccataaaccttataaacagttgagaaattaacaaacattgatatgttactcaaaaatttgtccaaagaattcaaaaaatgaaaaatgttgacaaaacagaaaatgacttttaagacaattttcaaaatatcactattaataactacagaatttccaatataaaatgctgaatttggagttatattcttaaccagttataatgaataaatatattcactgaatatattttttaaatgtacataccatctctttatgaataatacattaaaatatattcttaaaaaggatttgtaaatttggtatatacggccaataaatatgttcataagaggaaaatagcaatatttactggctatatgaaagatatctcagttgggtatggtggcttatgcctgtaatcccagcactttgggaggctgaggtggaaggattacttgagcctagcagtttgagaccagcctggacaacatagtgagaccccatccccccacacacaaaaaatctaatttttaaaaagctcaaaaagtaaaataaatatatctttaggaagaattggcatggtcgggcatagtggctcacacctgtaatcccagcactttgggaggctgaagtgcatgcatcgctttttttgtgaccagcctggccaacatggtgaaacctgatctctacaaaaaatacaaaaagttagctgggcgtggttgtctgcagaggctgcagcaagccagcatcacaccactgcactccagcctgggagacagagcaagaacctgtctcagaaaaaaaaaaaaaaaaaaagaagaattggtaaatttgatgagtgtaattacttggtcatttggtgaattgattctttccataaacttgttttttgcaaatgggttattagttagatttgccatttgacaaattggctgttagcaaattattgtcagtgaattgacccccatcctgccttattttagctctcactccagggagctcacactgcttaccttaaaatggcctaaagagctgctgctcctccggagggacatttcaccagccctggtagaaggtgccggccagatgcccagggcatcagcacccaggcagctccagacaggccagccacgtatgaccagtgtcctgcctcgcctgtgcttgtcattcgggagctgattgatttgtgtatttctttatttatttcacacatactaagtgctaagaactgtttttaaaagcttcatgaatattaaatcacttttttcaagatgatcaactctggtttggctaggctcccagtcactctctccttctcttgttcctgccatttgaatggctttttggcagaggactggcaaagcgtggggtgatggcagggtggcgtaagttgctccaacagcacttggtgagtctttggtggatggggaggttggaaatacctggagaggatttattctcatcatattgtcctggttggtcttgaacttctgggctcaagcgatcctcccacgacagcctcctaaagtgctaggattacaggcatgcgccaccacacctggcccctagataggatttaatacactcggtagaggtaggcattctaggttctctccatctctgaggactaagtgctctctgtctgactcccgtggcagggcctctgtctgctcctgccatccccgcagtgctggacatacatgctcagtgggaagcgtctgttgatttgagggcaaccccctcctcttttcaaaacctatgaaccacctgctttgcaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaactttcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgcattaagagaatcaccaaggagaaatgttccacataaaggaggagaaagagtaggaaggcagagtccaaggtgactgagttcaggtgttctttccagaaggagaaaaagccttgcctaaagctggctccggtcacagttttggggaatttcccacaattccatgtgaggagaagcagcattatctaatccacacagtggcaagtctgggctcagctccccagtggtatacacatcgtctcttcccttcttcttctcttactttctttgctgtttttgacatttatttctaaaatcatgggcctaaccccacctcctcattttatagatgagaaattgaggactggagaaattgttctgcctgcagccatgaagcttggttaatgccagagctggatcagagcaggagctgggacactgggcgcagtgactcacacctgtgatcccagcacttcaggaggccgaggcaggaggattgatcgagcccaggagttcaagaacaccctgggcaacatagtgagaccccatctctataaaaaaaatttttttcttgaagcagtcttgctctgtcacccaggctggagtgcaatggcgagatctcagctcactgcagcctctgccttccaggttcaagcaattctacctcagcctcccaagtagctggaactacaggcatgtgccgccacaccctgctaatatttatattttcttagtagagatagggttttgctatgttggccagactggtctcaaactcctaatctcaagtgattcactcacctcggcctcctaaagtactgggattacaggcgtgagccacggcgcccagccaaaatttttttaaaaaacaaaagtaataagaagtgtaggtggggcgggaggggagcagtcctggctgaaaaccagccaccaactgccccttgtacagccagggggaagagggagccactgtgagcatttgggagatggggcatgggcatagtgcccaatccacatgtcatcagacattctcaaagtgccatttttcactgacttctttttttgtgggggaggggacagagtctcactgtgtcacccaggctggagtgcagtgatgcaatcttggctcactgcaacctccgcctcaagcaattctcatgcctcagcctctggagtagctgggactacaggcacaggcacacaccacaacacctggctaatattttttttttttttttttttttttttttttttgagactgagtcttgctctgtcgcccaggctggagtgcagtggcacaatctcggctcactgcaagctccgcctcctgggtccatgccattctcctgcctcagccttcccgagtagctgggactacaggtgcccaccaccatgcccgcctaattttttgtatttttagtagagccagggttttgccatgatggccaggatggtctcttgaacttgtgagcccaagcagtctgcctgcctcggcctcccaaagtgctgggattacaggcatgagccaccacacctgaccatttttttcaccgatatctgcctgccttcagcttagatgccttcatcaaaatcagaggaggcttctccacgtggctgcttgggcttcctcacagcacggtgggctcaggctagtcacactggctgaaagaacatagaaactgccaggcccctgacaggctggtccagacactggcacgcatcacttttgtggcattctatccgtcgaagcgagtcacaaggctggcccaggttcaagcggccaggaatgatgaaagggaaggaaggaatcaacacaggtcctttggcacccatccactgtacctttcagggccatcaggaagtgcaattgcctttcagtcctcagcactcagtaaatgccagcaaatatttgggtgaatgaatgggcagaatgaccaggaggtcagcatctgccaggtgctgggaagagtccgtccttttttatttttatgttgaaatggaaagagtacacagaactctgaaggg

SEQ ID NO: 622 - DNA, 27271 bp, Human
aaatatttggagagaggaggtcagaagcagattcttggcatctgatttcagccctggatcacagaagccagtggagtgggaatggagacaggcagaagctgcaggtgcagataggaggcagcttgggctctaaaggcattttgagctgggtcgggggcggggggacctgggcagggagtcagtagtcccagttctgtcctaattttgcaattctgcattcccatgtcagctcttctctactgtctggggctctgagatattaaaaaggatggggagggcatggtgaaagtagaatcctggtgccagccctgctgacagcatatgtatttccttatagtacctgtttagagatgtgttagtgctctggaggggatagccacaggtgtagtattggaaaacagagggccagacttccaaatgtctgttaacttatccaaggcaaagactgtcccagggcagcagagtaagaacccactttttttttgttttcaaagaagtataatcctgaacaatgaagtaggaaagacagaacacaggaagaggaaggaggtaggacacttattggaacttttaagaaagggaaagagaagaaagaatcgtaagaatatgatagtgtttgaagggcagagacaacactagaaacattgagaaatactctgagaaagattccaagtgtggcagagacaagaatgatgacaaaatagaatttgggatgagacaaaatcagatagtgagagagagaagggaagatggacagatgtatattcacaagaccaacaccagtaagcaaggggagtaggaaggggaagtgggagcattcgaggttcccattatgccaaattatttcctgtctctccttctggccccatttctgtatcggagttataaatagcagagagttggaaagtgtccccccacccccttgcctctgtcccagcctgagggaaagggagaggaagagggacaggccaatgggtccctgtggagatcccatctcagccccacccaggtcctgctgagccagtccaggactctgccccctcccatcccctttcatggataggaaatgtgcagtcctgggacgggtctggtagctggggacaccctttacatccctctgcctcttgggtccagtctctttcatctttgccttctttgacacccactcccctccccactgcttaatttcctcttcctgtaatcatccccagtcgttttcttttctcccttcattccatcccttgtcaattaatctcttgcccttctttcttcctctctattcctttcctttttccatttctccatttgctccccgtatctcccgagtttctctctctcttcttgcctctttttctctgttcccttgaatcctgacgatgtggctagcactgctgtggtcattgccgggctgggggcgggggatgggataggatgggggagggcagcggtctgatcccaacagcagaaagagtgctctatgtgaccatgggggaacagggagcactaagatgccacgctgcacccaggcccaggacggctcccctttcatttcctctctatctgcacatctctcttcccaggttgtcttttagcgtcttcccaacttctcatctcttaccctccttcctctgtttcagcccctctctttctatctgtacttctctccctccgcattccaaggcgccgcctccaccactcccggggtggggatggggttgggggagaaggggaggagagcgccgcgcaggggcggagccggagacggtgctgggcttggggggcgtggtggtggggggtcagcaaggctagtttccaccccagccaccagcctgggcatccccttggagacgggcttgggtctccacctgccgcgggagcgaggggcggggccggaggcggggcctgagtggcgtccccgggagaggaggcgggagccggagtgggcgccggagctgcggctgctgtagttgtcctagccggtgctggggcggcggggtggcggagcggcgggcgggcgggagggctggcggggcgaacgtctgggagacgtctgaaagaccaacgagactttggagaccagagacgcgcctggggggacctggggcttggggcgtgcgagatttcccttgcattcgctgggagctcgcgcagggatcgtcccatggccggggctcggagccgcgacccttggggggcctccgggatttgctacctttttggctccctgctcgtcgaactgctcttctcacgggctgtcgccttcaatctggacgtgatgggtgccttgcgcaaggagggcgagccaggcagcctcttcggcttctctgtggccctgcaccggcagttgcagccccgaccccagagctggtgagtcaccgcacccgcccagagtcgccatgcccgagccacagatcgtccccctccccactctgtgggcctcctcatttctctgttttctagccccaccaagacctagactgcccacagacatcccacatcccaacctggagccttgcctcatctggcttgcgtctgaagctgcacttcccggccctgagaccagtattttgctttagggatgagttggaaagcaaggttcttgtcttggcagcgaaccatctccttcttctgggcctttcccccaacttgcatccttgatccagccccagggcctctggctcccctgcttcttccaagggctgaattccccaagggagggagactgtctgtctctgcttagaatgggaggagatggaaaggacatagaagttgagggtgccatgagagggatgcatgcagggcagactccagaaataacttcctgctagagcattgccatggatggaatgagggcagcagggcactggaaggccaggagagagcttccacttctgtggcttaagaccacgggaagattgggagaggatctgcaggtctgccaacctgcagtaggtggcttggtgatagagagtggcagcaaactgaaccctcaaagtactagtagcagtagtagtagccgcagcagctgtagcagtgagagagatccaggaaggatgctggccaggctgctccccttcctcctccttagcaaatttccaactccaggaatctcagcagctgggaagggccaggaggagtaaggggtggaggacaattctaattttttctaatcagttcaggacccatgggagatggatatacttttgtgaggggcctgtgactggtcatgttgcctgtatccttggctcttgctacatgtctgattgtaaaaagggaggccagaggtgaagaaagcttctcacctgctcctgctagggggcttttctctcttcaaccagtgcctaagccacattaagtatccattactgggatcaatgctgtccactgggactgtcttctgcctctactgtcggtctgggggcagggggcagggacaagagctcatttctcctcacttgcttggggagtgggggcctagctctaatctttcttcttccattatccctatcatctggtagcagggtcggtggtccccaaaactttgggagagatagaaagcaacggacttcatctcctcttctgtttaccatctgcttcctcattcacctttgctccctccctcccttcctccctccttctccatctgtcagagttcgaggactggaggcctttttaggacatgctgaactctctaagctatttccaggcaaattctaggttatttttaatagcttggtctcttgtcatttccccctcctctctgaaggtggcccctggttccgtctcccagagccaagctggggcctttcccagagggcctgactgcctcaccctgcttttgctccagcagggggtgctctgctgctggggggcggggggtatgtgagaggccaggcacctgctcagtccctagcttttgagttgcaggtggcctgccttagcactcactgatgaaaaaaacttcttgcctgttttgatgtcttttagtctagctctgggatgagactttaaggtctaacctttgctgtgtggttccagcctcatttacttccctcaactgtaaaaaggatataaacatagtattactacatagggttgttgtgcagattaagagttcttaatatatataaaatgcttagaatagtgcatagcccgcagtgagtgctgtgaagtgttagtagtattgctattcttgtattgtgattcacagagcgccttacagagattctggatccaaaggcttggctagagggcctccctggctgagccagccttccaggccaagcatcctccccagagggccacccagattgagaggggccaaagaggggctggacttgggctggggccctggagtgtgtggagaatcgagaagtgcagtggtcgtgggctactcctttgtcttcacttagctgagctcccagggggtccctctgccccccagctgccaacacttttttttttttttttttgcttttctctctgcagtggctacactgtggctgtccagaagactggggtggttagggcgtatggcatgaagccaggaaggagtgtgtgtggctggaccagaggtggagggactagagaggatgctgctgggtgctcttgttccactaaggatcgattggtctcttctccaccaagagcggactgggcatatctatgcactcagcttctttcttccacatgggcccctcccctcctccctacttttggcctccagaggagatgtgaacatagaacaaggataacttatctgggtgcttagctatgcactgaccagctgtgacactgggtatctctatgagtccacaaaatgtgtgtgttcagtaaacacattctgacactccctatggggcaagcacaaagatgaaaagacagccccgacactcagagagatggccacttctatgtttggaggctgggggtactgctgacttgcctgaaggttgccatttatttatgcagggctgtatcaccccgtttccttttctgcccagggtaccctcatctccccactctctccttccctttctggggtggtctcagtgttctagagacaggtcagtcactgggtggagtgacaaagtgttggagttaggcccatgtggatttgaattccagcatcactgcttaatgtctttgagtgagttttctcatctgaaagacaagaaaagaatccttatctcataggattgttctgatgattaaatgacataatgcatgtgacttgcctatcctggtgcttggcacatatgtggacagtgatgaatgttagtttcttatatccctggtgtctagcctcggatctgacgtcatagtaggtgctgaataaatatgatttccttgtctcaccagcgcctgacacagggcttggcatacaatagactctcaataagtagttgaatgccaaatgtgtcttctcttctctactactccctataccccttctctgtcttgacactggctctgacaagggatggcagctgctaagagatgaggaggagttgtgggaaggaagaatggctctctgccctccccctccaccccatcagagctggcacagtgccccacagatgcctgtctgtaatactgcctaacatggttttgggccttgccccccaggaagggagatggaggagaagagtgtgggagagaggcgttgaggtttgtcccactgccacttctgagtctctccttctgcaaagagaggacccatggagccagctgggtgtcagtcatcttacctcacccccgccttcactctggcttgggggttcagccccaggggacccaggcagcctccattcccagcactgtgctcccctggggaagacggcttggctgtgatcatggaaaattgtcctgccaagaaagttgtagctgggaaagaggctgagggggaggcaggagagaagactgggtgggggtggaagggaaggagaaatcatggacatggggagaaggaaggatggggaaggggattcaggatgtcgggaagagaatggggtagcattggaggcagaaggagaaacttgtccctacctccatgccagccagagtgactgatggaatcctgggctggcacagcttctgggaggtggggtctttgctgggtccctgatgagggggcagtgggtccgtatctagcctcttgcctggcctctgaagctggtccctgagccacactctgatgccagtctggggccctgttacttttgctcccagcattcttggcatttctggctgggtttcaactggactgggttggggagcagggcagagcttggggatggggccaaggaggggatagggaaggcctactcaggaacaggtgctgggaacaggcagttctttcaaaccagcactgttggcctggctgcttgggttggcgtgtatgtgtgtgtgtgtgtgtgtgtgtgtatctactgtgtatgttgatcccttatccagatagtatgtacatgcaacgtgatgactgcatgaccaagcatattaatttgtccttgccagggtttgagaaaactgacatttgccccttctctttagtccttgaacactctctttagtactgaggggttgggcctgggcagctctaatgagattgggtcattctgacctctaactcctgtccctgtccctgcccctgccccatcttgcaggctgctggtgggtgctccccaggccctggctcttcctgggcagcaggcgaatcgcactggaggcctcttcgcttgcccgttgagcctggaggagactgactgctacagagtggacatcgaccagggaggtgtggccctgcatgaacagagtgggggaagcgtgtgagcggggaggagaggacttgggctcctcttccctcccctaattcccagtgtcctgcctctagctgatatgcaaaaggaaagcaaggagaaccagtggttgggagtcagtgttcggagccaggggcctgggggcaagattgttgtgagtattgcttctcatgactgaatgcacggatggggtgtgtgtgtgtgtgtgtttatggtgtgtgcatacgcataggtgtgcttagagaacacaagttaggaatatggtatgattccaagtacatcagggagatataaaaaggtgtgagacatggtccttgtccttataaatgtaaaaatgtctgtccattcattcatccatccatttgtcaaactcttactgagaaccttttaagcatcaggcattgtgctagttactacaggggaaggctcatgcctgtaatcccagcactttcggaggccgaggcaggtggatcacctgaggtcaggagttcgagaccagccggaccaacatggcgaaaccctgtctctcctaaaaatacaaaaaaattagccgggcgtggccgggtgcggtggctcacgcttgtaatcccagcactttgggaggccgaggtgggtggatcacgaggtaaggagatcgagaccatggtgaaaccccgtctctactaaaaacacaaaaaattagccgggcgtggtggcgggcgcctgtagtcccagctactcagagaggctgaggcaggagaatggcgtgaaccggagaggcggagcttgcagtgagctgagatcgcgccactgcgctccagcctgggtgacagagcgagactccgtctcaaaaaaaaaaaaaaattagctaggtgtggtggcaggcgcctgtaatcccaggtactcgggaggctgaggtaggagaatcacttgaacctgggtggaggaggttgcagtgagctgagatcgcaccattgtaccctagcctgggagacaagagcaaagttccgtctcaaaaccaaccaaacaaacaaacgaaaaaaccagggctctctgtttctctctctctctctatctttcagtaacacgcatagatacacaattaccaatacagatcactgtggggcagaatctggttcatgttaagtgagtggtctagtctccagtctataaaagtccaaaggaggagtagagagaagacttctgcagaggggatgatttgagccaggctttaataataggtaatacctagcctgtgcaacatagtgggacctcatctttataaaaaataaaaacaaattagccagtcatggtggtgcatgcctgtagtcccagctacacaggaggctgaggtgggaggatcacttgagccctggaggtcgaggctgcagtgagccatgattgtgccactgcactccagcctgggtgacagagtgagaccttgcttcaaaaaaaaaaaaaagtaatacttggagagtgaagcggacaggaagttctttgcagatgagatggtgacacttacaaaggtccagggacagggccaagcttggcattttggaggactgtgacatgatcagggagacacacatcctatgtggtggcttaattgtgtcttttggctccaggcagaatgtggaacaaggagatctccatttgagggcaaggaagtgggtgcagacaggttgctgggttatgcatggacctgtgtaacactggcagggtaatggtgcttgagtggtgccggcataggggtgtgtgtgtatgtgtgcatgtgcatgtgcatgtgagcacacatgtatcagtatctgccaaatctctgcatatgggcagcatgcctcaagcaggtccctggcccacagagtgaaatgatccccatcccttcctcccccagacctgtgcacaccgatatgaggcaaggcagcgagtggaccagatcctggagacgcgggatatgattggtcgctgctttgtgctcagccaggacctggccatccgggatgagttggatggtggggaatggaagttctgtgagggacgcccccaaggccatgaacaatttgggttctgccagcagggcacagctgccgccttctcccctgatagccactacctcctctttggggccccaggaacctataattggaagggtgagtcactcctcgggaaggggagaaggggaccaaaacctcctcttacctcagagacagggttggggatggcacatggccaagcatgaccacatgtgcactgctgtatggccccagggcactgccatgccttccaccccattgagctagtgcacacatgaatggggggtgcctcctttccctcgcacggccaagtgttcctcaacatgctggcatgggccccaagtgcacgctgggcctgcagctggggcctgcatgctccaacacactagcccacacctcatcactgccattcccgtctccgcacgctgctgctggctgagctgacactcggtgagtgtgatgccacatctgggggaccccaggaagcctgggttggggacagggtggggagagggctagaaagaagaggcagggcttccccgtgtgcctgtctaactcagtgtccggcctgaggggtgttccttgcgccctgccctgggcactaacaggtctgtccttgcaggcacggccagggtggagctctgtgcacagggctcagcggacctggcacacctggacgacggtccctacgaggcggggggagagaaggagcaggacccccgcctcatcccggtccctgccaacagctactttggtagggacctctccccggcccagaactgctctaaccctctgctcctctctcttgtcctctctctccatgctcccatccttctgtctctgtttctgtctctcaccttgtctctctctgtctttctgtctctggctgtgatctctctggtctctttttctctctccacctcttcttcttccaccattttctggcctttctgtggctctgtctccctactctgtggcccctactctggatgtcccctccctggtgtctcaccccaccccccacagggttgctttttgtgaccaacattgatagctcagaccccgaccagctggtgtataaaactttggaccctgctgaccggctcccaggaccagccggagacttggccctcaatagctacttaggtttgtaagctcccacctcctggactctaggggcatggcccagcctcccctccttccccagggaactcgacctttggtgccttataatctcctcctcccccaacacacacccagggagacatacattgggcccaaattgcagagaagagctgggtccaatgatcaggcctaagaggaggaggcccccagggtggtggcctctggggctgtgagccaggggtctccatggaggaagattcaggtggaatgagagggccagggctgaggatattttgggaaggacagtcctgtcttctagggggactttccctgaggggatggatggtgggcacatattgaagaaagggctaatgttgttggtaagtccctctcgttgtctcatctgcattcctctgcagaggaggaggaaaccaggcctgggagatgtttgggtgaagcaggcgctctctcactcccccttgtctccccctcatccatgtgaagacttcccctccctgccaggatgagggagttgggggaaagaggtgcactgggtgggattcgggcctgagagggacctctagctcttctagctccctgggtgtgggcagggtgaggccactgtgctcagcctcctacctgggctcctggccttctcagccatcacctttctctctcttgcccagtccctgaggctgacctcactgcactttttgtgccaagcttgtccctgggcctggtgggtgtgggaggctgccaggccctgtggggaggaagagctatccagctgtggtgctgatgacttggggggacctatcttttggctcttaacctaggggagggggcagggtgcaggggagctgtgacttggctcttaacctgtagggagggggcaggggctgggggagctgtgacacaccccagcttctgagtcttggggtgaagacttaggggtaagtcacccttcccccaggcttctctattgactcggggaaaggtctggtgcgtgcagaagagctgagctttgtggctggagccccccgcgccaaccacaagggtgctgtggtcatcctgcgcaaggacagcgccagtcgcctggtgcccgaggttatgctgtctggggagcgcctgacctccggctttggctactcactggctgtggctgacctcaacagtgatgggtgagtgggtagagggccgtgccacctgagggaggctgggtctagtagccccagtctggctgaggccacttagcctcctgctggctcctctggccagggaggacccacactgaatgtttccctctctccatagctggccagacctgatagtgggtgccccctacttctttgagcgccaagaagagctggggggtgctgtgtatgtgtacttgaaccaggggggtcactgggctgggatctcccctctccggctctgcggctcccctgactccatgttcgggatcagcctggctgtcctgggggacctcaaccaagatggctttccaggtgtgacggggaactggaaaggctcagggagggaggggccacaggagggatggggaagcccctcagaggtcagggtgtggtcttctgaggactcagggagagagggtccctgagcttatgtctgagctgtaccatttaccagctttctgaccttggcaagttcctaacctttttgcgttagtaatatctgcagggagtggccaagaggattaaagatgatgtatgtagagtgcctgggattttgtagcctctcaataaaatagaaaacatacctgagtgactggggggagttgaggcctggatcttgtctgcaaggcccccagccagcgtgactgccttttccctgtgccctgcagatattgcagtgggtgccccctttgatggtgatgggaaagtcttcatctaccatgggagcagcctgggggttgtcgccaaaccttcacaggtgaggggagtcgctgggatgagggaatgggtgtgggtggaatcagcagaggcatcaggggaggcagaggcctgcgggaggtgggattgagggaggctgacagctggttctctaggtgctggagggcgaggctgtgggcatcaagagcttcggctactccctgtcaggcagcttggatatggatgggaaccaataccctgacctgctggtgggctccctggctgacaccgcagtgctcttcaggtgagcccctctcaaccttttccctccctgaggccgtcagcccctccctgtgactctgaccccgacctcagtgccaaatctaatgctgaagagtgtttcccagcctcatgttctcatgtttcttgtgctcttgactccccaatcccagggccagacccatcctccatgtctcccatgaggtctctattgctccacgaagcatcgacctggagcagcccaactgtgctggcggccactcggtctggtgaggtgggatcgggtggcacctggaccctggcagcttcccctgccctccctttgatcctttatctccccagtttggggctggggctgtgacaggatgtgacagatggggtgggggtaggggccttggcccatcagcctcgtttggctcaggagccacctttgcccccgcagtgtggacctaagggtctgtttcagctacattgcagtccccagcagctatagccctactgtgggtgagtgcggtcccccctctgtggctcgcccttttgggtttcccagggaggggggtcacttcgaggtggtagaagagcacccttggaatggggtgagctggagcagctctgcagctcagcagctcctcctttcccaacatgccacagccctggactatgtgttagatgcggacacagaccggaggctccggggccaggttccccgtgtgacgttcctgagccgtaacctggaagaacccaagcaccaggcctcgggcaccgtgtggctgaagcaccagcatgaccgagtctgtggagacgccatgttccagctccaggtggacactgaccccttggcttctgagggtcattttcatggctccatctcttttccctgattcctcttagctgctttttcccgagcacactcgtgcctccttctaagacctagacacgtgggaaacctgtcttctgagctcacttcctcctcatctgctgccctctcctgtcatttctgcactccctggaggaggaggaggtgcaaggggcttcatgtcccctcttccagctgaatggaggaggtggcagcttttatcatcacatctggtcctcaaagccctaaaggtttcccctgtcccctaccccagtctttctccctcctccttgctcagttctccacctctctcattcatctccctaatattctttccaagttttagaattggtcctaggtctggctggggcactgagcagggctgaggcctggggattgttccagtgaggaatagaccttcctcttcctaggaaaatgtcaaagacaagcttcgggccattgtagtgaccttgtcctacagtctccagacccctcggctccggcgacaggctcctggccaggggctgcctccagtggcccccatcctcaatgcccaccagcccagcacccagcgggcagaggtgagcatgggttctggtttagcccagggggaggagctgggagggcaaagatcatggtccctccccagtgacaccaattcacagctcacagagccctttcacgtatgctactccagtaattcctcatatctctaggtgcctaaatgaccatgttcctagtcaaggggacagagctcctctactccatgtagtcattcagggggctcaggttgatgggattctgtaatcttcaaatgcggccttcaagctcttgaagtcacattcatcccattcagctggaagggagaacatgaggccccttgcttgcatggtttttatggctggcccagaagtggtgcccttgacatcttttcccgttctaaatccggaactcagttacatgcatgtgagctggggcagtgtggcccagctcttgacttgctgctagtctctaccatggcatggtagtgctcccatcactaccatgatgagaggacccagaggagaggacccagttcaggatcacatggctaataagcagcagatctgagagttgaggacaggttgtttaatcctgtgatactctaacccaccatatgccatggtgacaggtttgccccctgccttgccccctaggaatgccccttatctcatgtctctccccagatccacttcctgaagcaaggctgtggtgaagacaagatctgccagagcaatctgcagctggtccgcgcccgcttctgtacccgggtcagcgacacggaattccaacctctgcccatgtgaggggggcagagagcagggtgggggtgggagggcaagagttcaaggattgagagaaagccctctcaggaggaccagtcagagggaagggctgagcctgcagaaaaggcagaaggtggaagaggacctgccgatggacttggagactgagatgagggtcagtgatggggccacgggggctcccatggcaaggaatagcaatccttcacagtacactaataatatgcagtctacatacatctcattggttagtcttcaaacctctgtgaggtaggaattatattagtctcattttatagatggagaactgaagcctagagaggttaagttacttggccaaggtaagtaatggtggagctgagatgagaacggaggtcccctgactcccagtcgtgtgtacagaggcctgaggcttggacgggtgtgatggggacctggggtgggaagagaggctcagggagtgaaggcaggtactgggggagcagactgggcgggggaatggtagggggaggtgttcagaacttagcaggagtggggtctgactctccagggatgtggatggaacaacagccctgtttgcactgagtgggcagccagtcattggcctggagctgatggtcaccaacctgccatcggacccagcccagccccaggctgatggggatgatgcccatgaagcccagctcctggtcatgcttcctgactcactgcactactcaggggtccgggccctggaccctgcggtgaggacctgggggcaggatggggtggggtcttgaggggctccagtaacccagactgaccttgccttctctcccattccaggagaagccactctgcctgtccaatgagaatgcctcccatgttgagtgtgagctggggaaccccatgaagagaggtgcccaggttggcacatctgcccttatccctacgtgagtagcctctccataagcccgtagaccacccctgactctaatctctttccacccttggcctaggtcaccttctacctcatccttagcacctccgggatcagcattgagaccacggaactggaggtagagctgctgttggccacgtaagccaggcggggccggaagggtgaggtgggggtagtcatattgacctcatctgaccccttgggaggtgcctgtgcctgatgcccatacttgcccctgcccactcaccaggatcagtgagcaggagctgcatccagtctctgcacgagcccgtgtcttcattgagctgccactgtccattgcagggtgagcctggcccaagggggcacctccattggagggagggggcattgacatttccaaaccttggccagggccctgccttcattgagccaggccccagaccttctcacccctgttctgacctctccacgccagaatggccattccccagcaactcttcttctctggtgtggtgaggggcgagagagccatgcagtctgagcgggatgtgggcagcaaggtcaagtatgaggtcacggtaagtgtcagggatgaggcccctccatggtcaccctccctccttggcacagaggagaggctgagctgtgtccccagggctggggctcttctaccatgtggcagcatgcagtttgaggcctctgtcctgcatatggaccttggctgtgggaaggtgttcctgctggggcctcatttgaccatttcctggtcattctgtctggctgtctcacctgctggtgtggtaggccatgagagtccagggaagcttctctgctgtgggcctcagctgggggatgggaacatggggcggggggttaatgtctctccctagaactctgcctttgcttggctggggcctctcctcacaccttccagggacacttccagggtttcccggatttggtgggtggagagaatggtgcctggtggggtctaggatcctgagtatttgttgaaattgtgtttcctgagggccttctcttcagcccttgttccttccatctctgtggatttaggatccacttgaaagctgagttccttggctgggcacggtggctcatgcctgtaatcacagcactacaggaggccaaggtggcaggatcacttgagcccaggagttagagacaagcctgggcaacatagatcctgtctctacaaaaaattaaaaaaaaaaaaaaaagaaaaactgaggtctctcccctcatactctctttttcccacaggtttccaaccaaggccagtcgctcagaaccctgggctctgccttcctcaacatcatgtggcctcatgagattgccaatgggaagtggttgctgtacccaatgcaggttgagctggagggcgggcaggggcctgggcagaaagggctttgctctcccaggcccaacatcctccacctggtgaggcttaggtgggggtgggggttagatgtggggacagatgttatggggagtaagggtagtgagtgcagtgatggggcaggaggaaggcggtggggaggagattcgatcttagcactgctgtgattggagggacactcactaagaccccccttccgtgtccaggatgtggacagtagggataggaggcggcgggagctggagccacctgagcagcaggagcctggtgagcggcaggagcccagcatgtcctggtggccagtgtcctctgctgagaagaagaaaaacatcaccctggtgagggcaggccagactcggtgcagccagagctccggggtgctgcgtgtccaggaagggtacctgttgagacacatgatggtctgggtgcaagttgaccagatgttcccatcacaattcataggagggggtgcccgggaggcagctactgacactgcagacccccttcctgctcagcccctgcaattgctcactctagaacaggtcactccacctgaagccagttagttagccaagcaattgattcacattacgtttatataaagcattacattttatacgtgatgggatggggttagcccatcctcacactttgaggtctgtttgtcgttcttttgaactcttataagataaaaaagtcaatttgtgtaaggacacttgcttgatttttacagtattaaaaatgttaagttcttttttgttgttgttgagacggagtcttgctctgtcaccaaggctagagtgcagtggcacgatctcagctcactgcaacctctgcctctggttcaagcgattctccttcctcagcctcctaagtagctgggactacaggtgcatgccaccacacccggctgatttttgtatttttagtagagacggggtttcaccatgttggccaggctggctggtctcgaactcctaacctcgagcgatctgtctgcctcggcctcccaaagtgctgggattataggcctgagccacgcgctcagcaaaaacactaaattctaaaagttctaataattaagacaaccgtatattatatgtgatttattaagtttaccccttttgagcagttttgctttccccttttctgcttgttttgcagagttgtgttgtttaggtgaaggtattgagcagatccgcacatgctctgtgcccctccctgctaggatggggctcgcagtgagaatgtggtggggacttagattaggaggtctttggcttgattgtaaggaggtggaggtaaaccccaggtagagccaaggagaccctttgcaggggaatgtcagcagctgctgcagtccctgctttgggccctcagctcccctgggagcatggcatgaggcaaactgaagaacgtcaggggatgtaggaacccatgtcgtggctgttgctctattacatggataatcctcccttctccacgtgaccgatttcctctgagaggcctcccttttaaatgggaactttgaaatagattctttttgttttcatgttaaaatgtatttatttatttaaatgacaaaaattatatttatcatgtataatacaatgttttgaaatatgtatatactgtggaatggctatattgagctaattaacatatgcatcacctcacatacttatttttgtggtaagaacacttaaaatctattctcttagtgattctcaggaatacaatatgttgttattaactacagtccccatgttgtgcattagatctcttaaatagatatctcttccttctgtctaactgaaactttgtatcttttgaccaccatctcctccatctccccagccacaccccgcctccactccagccctaggtaacaactattctactctctacttctatgagttcaactttcagattccacatataagtgagataatgcagtatttatctttctgaatctggcttactttgcttaacataatgtctaaagtagattcttttttattttattttatttttttattttttattttttaattttattattattatactttaagttttagggtacatgtgcacaatgtgcaggttagttacatatgtatacatgtgccatgctggtgtgctgcacccattaactcgtcatttagcattaggtatatctcctaaagctatccctccccactgcccccaccccacaacagtccccagagtgtgatgttccccttcctgtgtccatgtgttctcattgttcaattcccacctatgagtgagaatatgcggtgtttggttttttgttcttgtgatagtttagtgagaatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaaggtttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgttttttggctgcataaatgtcttcttttgagaagtatctgttcatgtcctttgcccactttttgatggggttgtttgttttgttcttgtaaatttgtttgagttcattgtagattctggatattagccctttgtcagatgagtaggttgcgaaaattttctcccattttgtaggttgcctgttcactccgatgatagtttcttttgctgtgcagaagctctttagtttaattagatcccatttgtcaattttggcttttgttgccattgcttttggtgttttagacatgaagtccttgcccatgcctatgtcctgaatggtaattcctaggttttcttctagggtttttatggtttatgtctaacatttaagtctttaatctatcttgaattaatttttgtataaggtgttaggaagggatccagtttcagctttctacatatggctagccagttttcccagcaccatttattaaatagggaatcctttccccactggttgtttttctcaggtttgtcaaagatcagatagttgtagatatgtggcgttatttctgagggctctgttctgttccattgatctatatctctgttttggtactagtactaaagtagattcttttactaaaaaggcagaaggccttgcttttagacagcttggctaaggattcttgaatggctcaaaagtggcaaaataaaagataactcaaataattcagacactcttaaagccattcttctgtgtctggatcgtggtgtgatgaatataacataactttcaggcaaatgggtcgtgaggtggtgattgggccaaatggatttaggtcagtcctggaaagaacagagcctgagtcccctgtctacccaggagctcctgaggctacctcctcctccttcagcgagtttgggtttagggcaggggtgtggctttgccgaatatggacctgagttcaaatatttgctccaccactcattagctttgctagtgctgtgacctgaggcaggtcgcttggcctccttgggcctcctcagtttcttcctttgaaaaatgaggatgataatgtgcaccttgtaggactattgcgaagcttaagtgagataagtgcctgacaagtagtaggtgctcaataaatgggactgtcattaggtaacataagcatcacttggggaagctactctgcctgtgctgtcaagtaagagattcccttccatgctgccccctccacgcatttcaaagctgaatagctcagatttggggcaggcagctattttggatataagattagtttgagaagacttcctggaggaggggagtttgaggtcaagtaaggaaaatgggagagatggcagtctcagcagggttgagctgagtggcttagacccctgtctgtccttatccctaggactgcgcccggggcacggccaactgtgtggtgttcagctgcccactctacagctttgaccgcgcggctgtgctgcatgtctggggccgtctctggaacagcacctttctggaggtgaggataccactcggctctagtctgtgtttcttcttcctccaaagcccctccaggactcatttctcctcctccttcctcactgtccaaatgcagcatccccccccttttttttttttttgagacggagtcttcctttgtcccccaggctggagtgcagtggtgcgatctcagctcactgcaacctctgcctcccaggttcaagaggttctcctgcctcagcctcctgagtagctgagattacaggcacgtgccaccacacccgatatttttgtatttttcatagagacggggttttgccatgttggccaggctgatctcaaactcctgacctcaggtgatccaccctccttggcctcccaaagtgctgggattacaggtgtgagccactgtgcccagcccaaacgcagcatactcttaacccaaaccaggcagaaacatcctctgtgttgggcaccattacatttataatttcaggaggtaaggggaagggagggagacatggggcatttaggagaagggtctccttccctgttcccttaggagtactcagctgtgaagtccctggaagtgattgtccgggccaacatcacagtgaagtcctccataaagaacttgatgctccgagatgcctccacagtggtgagctgcagggttgggggataggtggggaggactctcttctttcctgctccctccagttcttgttccattgacctcttgctccattgaccccttgctccccagatcccagtgatggtatacttggaccccatggctgtggtggcagaaggagtgccctggtgggtcatcctcctggctgtactggctgggctgctggtgctagcactgctggtgctgctcctgtggaaggtgaggcttggaggtggggctgatgggggtggacttcctggttgggtgagcagcattttgtattgtggttctgtcacccacccacacactcatgtattcagcaaatctgcactgaacacttgccctgcatgtctcaggaactctattagtccctggatgtttcaaagataaatcagatgcaggctgggtgcagtggctcatgcctggaatctcagcactttgggaggcctaggcaggtggatcacttgaggtcaggagttcgagaccagcctggacaacatggtgaaaccccatctctacttaaaatacaaaattagctgggcgtggtggcacgcacctgtagatccagctacttgggaggctgaggcaggagaatcgattgaactcgaaaggtggggttgcagtgagccgagatggcgccattgcactccagcctgggtgacagagcgagactccatctcaaaaaaaaaaaaaaaaaaaaaagccgggcatggtggctcatgcctgtaatcccagcactttgggaggctgaggtgagtggatcacctgaggtcaggagttcaagaccaagctggccaacatggtgaaatcctgtctctgttaaaaatacaaacaaataaaaaaaattagctgggcatggtggggggtgcctgtaatcccagctacttgggaggctgagacaggagaatcgcttgaacccgggaggtggaggttgcagtgagccaagattgcgccactgcactgcaacctgggggactgagcaggactctgtctcaaaaaaaaaaaaaaaaaaaaaaaaaagaaatcagatgcagatctcgttctcagggattttatagtccagtgggatgggagtggtgagcctgtagtcaaggacaaggcaggaagtgttgagttgagaaaatggagtgggagtttagagggaaaaaagcttgagaggaggtagcactggaaccagtcctcagaggaaggtggggtagtagggtgaggatgtaaggggatgaggtaggtggggtccagcaggaccatggtaggcaaagtcgtggaggcagagaagtgtgatctgacttaactagaatgtggcagtgaaaactggaaaggtaaatgtggccaagaaggccaacaagcacggagaacggcctccaggggactgccctcatggcggaactcagagcttccacataccaggctctgcatggaagcattcttgtacacccagagctgtataccgaatcatactggtatccagggctcaatgtaaaagtatgcacatgcacacgtcagtacacggaatcacatacatcaccggggtcatatgctgagccatctgccacatcgggggctatgttcagaaccacacatgtccttggggctctggagaactgcccctgcctgtgcctgctctttgggaccaatcagagactgagccaccctttggcaagtgtgaatcatcagtagaccaggctctggagtggcatccaagctgttgggaaccttcccagtcttaggggagattgatgcctctgtgaaactggtcccaggatgcttgctccctgctcccatggaaggaagacagagcagagataggggatcctgtccttcctcaatctttccatcctctgcttcctctgccctgcttctccctcgacatcctagtgtggcttcttccatcggagcagccagagctcatcttttcccaccaactatcaccgggcctgtctggctgtgcagccttcagccatggaagttgggggtccagggactgtggggtaactgttgtgtgtgtgcatgtgtctagtgtgtgtgggtatgtatgtgtgtgaatataaggagaattcccagcattcaggggatcaggaatgttcagggtgaaaaatgagattgcatgagagtgatgtgaggtgagaggtaattagaagggtgcagatataagggtaagtctacacagcctgaggcgtgcacaaagggttggtgggctcatggggtgtgagcatgtgggagtgtggggaggtcgcatgcatgcttttttctatgggcatgagtgtgcaaggagatgaatgtgtaaggagatgccatgcagtctgagcatgtaggagtcctgggcctctgagtgtgagtgtgcaggggcacattcccaccctggtgtgtaagggccagcatggtcctcatttagggtggggctagactactgtattgatggacaagagggtattgctgtaaggggcgtgccgcccaaggtacaagtacacggggtgcatgtttatgaggcttgagaggtatcattccagagatgcaggggactaggaagccattttcttcctcaggtcttgtttgtgttctgggggacactattgggtctcttaagaagctagagggggtacaaatcttgagtccggtcctgatgctccaccctcaaggccctctttcaggggccaagggagatacccttggtcctgcctcttggacgcccttctggtctctctcttgctgtgaatgagaacctggggacacagcactgatgggagcaccgtgggtgctgcccaccacaccagatgctattcagcctatttcctttctgccgcagcagggatggtgagggtgaggagctgtgccgcgctaggcatctgctccagggaccgcagctcttcaggctcctcatggtctggcctggtgtccttatagatgggattcttcaaacgggcgaagcaccccgaggccaccgtgccccagtaccatgcggtgaagattcctcgggaagaccgacagcagttcaaggaggagaagacgggcaccatcctgaggaacaactggggcagcccccggcgggagggcccggatgcacaccccatcctggctgctgacgggcatcccgagctgggccccgatgggcatccagggccaggcaccgcctaggttcccatgtcccagcctggcctgtggctgccctccatcccttccccagagatggctccttgggatgaagagggtagagtgggctgctggtgtcgcatcaagatttggcaggatcggcttcctcaggggcacagacctctcccacccacaagaactcctcccacccaacttccccttagagtgctgtgagatgagagtgggtaaatcagggacagggccatggggtagggtgagaagggcaggggtgtcctgatgcaaaggtggggagaagggatcctaatcccttcctctcccattcaccctgtgtaacaggaccccaaggacctgcctccccggaagtgccttaacctagagggtcggggaggaggttgtgtcactgactcaggctgctccttctctagtttcccctctcatctgaccttagtttgctgccatcagtctagtggtttcgtggtttcgtctatttattaaaaaatatttgagaacaaaacctctgcctctttgagtcttgctctggcatccccagcatctctgattctccctggtgcccccagctcaggaagaaggtggtagtggggagagagggtcaggggggcttggcagggatgcaggcaccatgacttttgtgaccagttcctagagacgcatgggtgtagcctcaggaggaaagcgagaggagctttaccatgggaacgaaggaaagggacaacattgggaggcaaacgttgggagactagtccagaaacttgcagttgaggatacaacagggtcctagtgtttcctccctgggtcagcgtagaagtagagctttttcactgtcgaaggcgggattgaagttagagattgccctggcagaggttggggagagagggactagtaggtggtacatgaatgtcttctctcattctgctaggtccctctcagtggaagatagataggctggtgggtggcttgttctaattggaggctggggaaggagcaaatgagtgccttggagcttgggaaagattatttgacagcctttcccatgatgtggggcccaacaggtagccacttcaagggagggggctgtcgttccatttggatttcggagaactgggcgttctcaagatccttccaggtctctctggtgaggcagcagccatccccaatgtgtttccaggtgggctcgaaaacttgctgccacatgaaggcccagcttccatatggttctgccacatgctcccagaaaaagagcacacctccctgggagggatgagagagttagtgtcacttggctccattctgaccctgctccctatcgcgctgatcaagacagtcaaacttcttggtgaaatgggagctgctggtctgagagttcatggagcaaactgtcgtgcccctgaccttttctgcatcccctgctaccgccttcaaagtgcatgtgaagaacctcataactgaaaggagtggctggtgggagatctttaaagcctgaccagaataaccgagggcatgcagaaggggaaactgagaaacaggagtggagggctcattgtattattattattattattattttttgagacagagtctcagtctgttgctcaggctggagtgcaatggcgtgatctcggcgcactgcaacctccacctctcaggttcaagcgattctcctgcctcagcctcccaagtagctgggattacaggcatgagccaccacgcccggctactttttgtatttttcagtagagacagggtttcaccatgttggccagtctggtttcaaactcctggcctcaagagatccacctgccttgcctcccaaagtgctggattacaggcgtgagccacctcgcccagctgggcttattgtattctgagatacacgcacaacctctctcacaaaacccagatgcatgcacaagctgcttcctggacatcgctgtgaacatcccagggaaacctcaggcccaactcttgactgaagctggggttcctcaagctcctcgcctcactatactctccctaggtgatctcaaacctagtaagtccaaaacagctttcttccatctcagcaaatggcacttttcatcagctctcccctcagttgctcatgctagaaacctggaaactattctgaacgttctctccacagtctgatggattctactctacttcccctactatctttacctagaacactcttttattttccccaccccgtccacactctgcttaatccctcagatctctctctctctctctctttttatttatttatttattttttttgatacagggtctcactctgtggcccaggctggagtgcagtggtgcgatcatagttcactgtaactttgaactcgggctcaagtgatcctcccacctcagcttcctgagtagctaggactataggcatgtgccaccacgcctggctagcttttgtattttttttttttttttttttgtagagacggcatctcactatgttgccttggctggtc

SEQ ID NO: 623 - DNA, 90923 bp, Human
  misc_feature (1)...(90923): n = A,T,C or G
ttgtgaagagtacagtccagtttctgttgtagaacgtccttgaagttggtcccggaatatttgtttaaagtgagttgggaaaccacattcacatgtcttttggttatgtgtgtatttgtcaaacagccagccttgtgctgcgtgctgtgatggggagcattactcaacagagcctggccctgaccttggggatgtagtttgggtttgtggggaaagcagctaccgccaggtgggctttacggacccctgtgtgtctcatgactagaggcactgacgcttggataaatacatactggatggatgcaggatgagtccgcattctagaagtgtgcagaggtacagaagtggccctgctccctgtccagcacccagtcatcagctttccctggcttcccgaggcaccctgacgttcacactccaaacacaaagtcttctctcaggaatctcgagtgagctgcagtctgggttctagccctgccctagcagggatctgctcagtgactgggctgctctcttcctgctttaggccaatgcgggggagaggagaccactgtgactctccccagtgcccttggagcgcagaatgaagtgaggggaggaggagggtcacgagccctggagcgctgggaagacaggctgtaggccgcaggccccgatcctgcctgggacgaggttcaacagaagtaggatggtttcatcatgacctggcaggaaaaccaccagacctggaattttgcttttacaactgtttaacttctgtttcatacaggatggaaaccggtgaattgtaatctcacataaccgagcaagatctagtagtcataagcactttgtcagagcaaagcagacaaggcaaagtgttggaaatgtcatcggatcttcacagaaccttagccaagcagcctttcaatgcgagaaacaaaataacatggatttttatctagtaatgaagtcaacaccattgtccaccctgggttaacacattcacatctcaaagcgaatggggctgcagacactcatgttagagagccttggaatgtcctgcctttttacgtttaattaaaattaaataaaatatacaaaattcagttcatcagttgttctagtggcattttaagggtttagtaccatatgtggctcatgagtaccatcctggacagcgtcgacctagagcagttccatccccgcgcagagttctgtttgacggcgccactctgcacttccagcagcctggggagcaggggtgcaggagagttccttctgtgtcacagacttggtcacacagtacagatctcagatcagcacttaaacacgactgccagctgtcaacggcgtgttctgtggaatgctgggatgcatcacaggtatgctggaagatgtatagaattttacttctgttattctggtaactcagagtcctgttcagtcagtttccacgtcaggttgctgtcctggttttaaagagaatgaacgcagccgaagttgaatcgaggcagtgatttcactcagtgcgttgggtctttccactcacctggccctccagaaccccagggccttgagtgcatgggctggtacaagagcccagtttttggctggggaggcacttcctatgggagggggacgcctgtctcagtgctgaggcaaccaccaccgaggaccctgggctggaagctgggctgagatgtctggtggtaggttctgaggcaggacaggggaccgactcaaatggatgatacgaacggcaggctggattcacgttgctcctgcacctccagcatctgctgaggacacctagaactgtggccctggccaaacctcagctccctattccatgaaagtgtgggtcaaagtgtgggtggtagagtggggctgacagtggcccctaagctcctagggtccagcccacaactgaggaagccacacggctggttgtgtacgagccggagtgtctctgtttggttgaaagtgccggtctgtgggtccttgctggtgtgtgtgcttctgtccccgcctcctggcctcctggctgaggggaagctgagtgggccacggcccatgtgtcgcactcgcctcggctcccacacagccgcctctgctccagcaaggatgtggctcttccacactctgctctgcatagccagtaagtcctctcacccgctgcttcgaggggctgctgtgccctcagctccagccaggtgtctgcagactacagccttgactgtctgtctctgatggggctcagttagagccagaggttagagagtggcagctcctccaggaaaggagtcttgctcggtgggtcagggccccaggcttgttgggaagggcggctgaggcttcgtgttgccagttctgtcagccagggcctttggactccagggctctgccattctgttcctcctccagccagcctccccccgccaccgaggccctctccccatggcacccacttggggcaggtccttgactctgtagtttgttctctgagtgtggaggctccgcctggcagagctcccttctgttacagagcaggggttgggctgatgagggtgaggaccctgtgagagagtgttgaccagagactgggggcaagtgtctgtatggtagagggtgtgagtgttggcagggagcctgcttcctgtgttgtcaggcccagggtaaaaactggaatgtggggtggggggaggcacttctgctgcctggggggtcccattttagcctttaactgtcccatggaagcctctgggcaagccaagccatgagtcctttcgggggccccctgtgatgagacagcacggtcaggtgagcccctggaggctgctaagattaagccggaggccagggtggtcctgcctagtgatctgagcagacttcccatgggtctcctgcccctgctcaggaggttggccggagaattggatgggcatcaagcttatgtggatgaaaggctcctggtagctgagttctccctgaaagatgggctgaggctgtgctgggaggggacttgggattagcatcccacctggggccagatcacccaggaagcaggccacaatgtgtagggtaccagcaaggaacacgtttttggacagattttaatattttatatttcattttattttattttattttttgagacagagtcttgctctgctgcccaggctggagcccaggctggatcttggctcaccataacttctgcctcccaggttcaagcagttctcctgcctcagcctcccgagtagctgggattacaggcgcctgccaccacgcctggctaatttttgtatttttagtagagacagggtctcaccatattggtcaggctggtctcctgccctcaggtgatcgacctgcctcggcctcccaaagtgttgggactacaggcatgagccaccttgcccggcctaatattttatatttcaaaaacatcagaatagtcaccatggaaaggtcaacagtttgttgaacttccttttattttacaatttagacttctctgtttttagttacatgtggggtgtggagagagtctcactctttttatggcttgtggctttgatctcccattaccaagaatatctggagcagatgcttagactagactcttgtctaccctctcccagtacagaggaggtgactggggcacagagcgggcagtgactacccaggcttgcaagcaactgataatagacacgaggctcaagcccaggcctctgtcctgcctcccagctccagaatactcctgtggctcatctgtctcctttagcctctgagaccaccacccatcacctcagtgccttttccagcaggtggcatcgatcaaacctcttttgaggcctaggcccttcccaagctgatgggcagcagagagcgatgatggagcagacttgccatgagaccacttagcccacagctcagctcagccacgggaaggggaccagagcagggcccccgcagctccggtgtgggtggcggaaacgaggctgctgcagttctgctccatgctgtgaggtcctgagactaggatgggccagtccaggagagtttcctggaggaggtgaggtggcgttgagtcttgggggctgaggagagtctgagaaagaaaatgtccaggagatgctgggaggaagaactccctcagactgtggctccaggcccagcaccctgtaccctgtgccgggttgggcctccttaggctggagagaatccaggactggcctggcctggccctgaccttccactctctccaggccagccactctggtgatgcctacttcttatttgtggcagcagacggaataatagcagttgtctaagggagattttagaagcattgggtgcagacagacactgaaaccctggaactgtccacaccctgaccaccagccccatcatgccctcttaccctgtggcctgctgtccccaagtcagtcttcacccctgactcattctgcagtcacatcaactcacttctccatcctgggtctcagaggttgagtttccacccttgcgtgaagaagcctgtcctgtcagcctacaacaccttacaggggtgaagaagaaggaaccagaagtccagggcccgctctgctggtggcacgcactcgggctgaggccaggggctgtgccggggcatcaccccgggcctgtgcgtgatagaaaacctcagtccttggggagtgggagactgtagcatctgaggtgggctctgaaggacggggaggtccttggcaagtacaggctgggggtgagcagaggggccttctgtgcaggggggataggagggaccaagccctggggtgtgaagagtctggtttgtaggaagatggaggcgaagtgtgagtgggagcaggagattgtctcctctggtgttgctttcccttccagccccgccccaaatcgggacatgctgggccctggaggtgcgggcagaggcgaggccacccctatcccagcccctgtgtgaagagaaggcaggttgtgcacacagtagcctccccggccccggcagggtgtcacagcacgggggtagggaaggggcactccaggcagaggggcagcccaagcaaaggtgaaatgcccccggaatgcagtgtgtgggggagagctggctgggggagtgtgggccgtgtgggagccccacatccctgcccttctctgggaggcctgcattcgtgtggcaggtgtggtataagtggaggaatgcgggcatccagtcccgagaggcccacggtggaggtggtgaggaacgtggggacctgagtgccggcctgggggagcttggagttcctgctgagggcagtggggagccacagaaggtcttgaccaggatggcgacagaattgtatgttgtgtgttagttggaatctgggggagaggggaggcagagaggcccgtgaggaggctgctgccttggccccatctgcggctgttgcggaaggcagacgtggggaggaggacacactcatgagaaacgtttagtttcctggccaggcacggtggctcacgcctgaaatcccagcactatgggaggccaaggcgggcagagcacttgtgatcaggagttcaagaccatcctggccaacacggtgaaaccccgtctctactaaaaatacaaaaatgagccaggcatggtggtgcgcacctgtaattccagctacttgggaggctgaggcaggagaattgcttgaacccaggaggcggaggttgcagtgagctgagatcacaccactgcactccagcctggaagacagagagagacaccgtctcaaaaaaaaaaaaaaggccaggcgcagtggctcacgcctgtaatcccagcactttaggaggccaaggtgggcagatcatgaggtcaggagatcgagaccatcctggctaacacagtgaaactccgtctctactaaaaacacaaaaaattagctgggcatggtggcgggtgcctgtagtcccagctactcgggaggctgaggcaggagaatggcgtgaacccgggaggcggagcttgcagtgagccgagattgcgccactgcactccagcctgggcgacagagcgagactccgtctcaaaaaaaaaaaaaaaatatatatatatatatatatatatttagtttccagcacacagtagtgctcaaggcctgttggcctttcttgttattagggagatgaagggtgagggagagagatgggctcagctgactgtgaggtttggggtggagttgatgaggctccgtgtagaagatcgaggtggggggactgcggctggctgcagatggctctgaggcacagtgctcccacgaggccccgctgggtgttctgggcggggtgtcgggacccctgcatctagccccacttcttcagctcctggtatcagtgtgggcaaatcatgccccatgggcctcggtttcctaaattgggaatcgtggtacttattgtactgtgagaatgtgagttgaaattgcccggagtgctgggggagacagagggttgaggggagacagtggtggctgacaggatggagggggatctcggtctgactcagcaggcctccgtggctggggacagctcagagaggtggtcctgtgggtagtgtggtgacagacactggtgtagctatgtctgtaagtcagacaacacgggaggggggattgggagggagggccagccctcgcctgtggttataactctctccaacctcagcctccacgtgctgagcctcctgcgtcagacctggggccgcgtatcgccccatttgatctgcacagccccatgtcccagaggggagacggaagcgaggtgccaagcccagggtccttcagtgactccaaggcagtgaggatttgaactcaagaccatctaccaagacaatgctgttttctgagtcctggtgggaaatgcaacaggaggtggtttcctgatggaggcgcagctcaaaggcaaactgttgggcctggggcgagtccagtctgaggaaacaagctgagccaggcctggcagacctgggcaccagctggctctcagggaaagcccagcaaatacagcgaactaccccaccacacacacacacacacacacacacacacacacacacacggatgcacacacacacacacggatgcacacacatggatgcacacacacacggatgcacacacacagggatgcacacacacggatgcatacacagggatgcacaaacacggatgcacacacagatgcacacacggatgcacacgcacacacgcgcacatggatgcacacacggatgcacacacacagatgcacacacggatgcacacacgcacacacagggatgcacacacggatgcacacacacggatgcacacacacggatgcgcatacacagatgcacacacacggatgcacacgcacacggatgcacatggatgcacacacacggatgcacacatgcacacacagggatgcacacggatgcacacaagcacacacggatgcacacacatgcacacacacacgtacacagtctcatgccaccgtgcctctgcggcaggctcttgctgacctagttaccagccctgtaagcagagccctgctccagctcagtgagccgccgcacggcaggagcagtgcccagcttcttgaggccatttgtgaccctggcctctctctgtttaccaacccctcggtgcctccagctattactaaaggctttgaaatcgggcataaacacagaatctgagccccagacacaaatattcaatcttccgacgggccatgcacaaaccacacccctctctgagcctcagcacctagcgtggtgcctggaaggcaacaggtgctctgggggagcggaaccctcagttgaacaagatctctgttgaacaaagtgaacacaggggtggggtggcgtgaggaaagggaatatctggcccactctgacctttttagagcaccttttttgggtgggcctggccctgcgctgagctgggctctgtggctgggggtgttgtgtgtgactcagatcacatcacagttcagggcagacaaactgaatcacagatcaccctgatccagacagaatttggtcacagccagacagaccacaggatgctgagggggctcagggtttggtcagagccagacagaccacagggtgctgagggggctcagggacccgggagttactctgactgagtctggattggctcctggctcctggctggctgagcagggccacaaaagacgggctttgcagacagaggtggagagtgctgagcaggcctgctgggtggagggagccgctgtgtcgaggcctggaggcaggagtgtgcagagggtgcgccgggcagagcgggggggtgccacggacgcccaggagaggagactggactttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagannnnnnnnnnnnnnnnnnnnatcagctgggcgtggtggcgggcacctggagtcccagctactcaggaggttgaggcaagagaaaggagtgaaccgtggagtttgctctgcggcctccactcgtgccttttcagttataccgacagtgaaacggggggaagaaggccccccacccacccctcgtaacatgttggcagctcgcactttttaattctcctctaggcagtttgctgacgtcctgttttttccccagagtgactgaccaggaggcacagggctcaacgtgacgtgggccccggggccggagcccagactccctgctgggcatcctttatctcagttctggattcgtgggggagcagcgggaacagtacggccttcttccctgcctaggggtcttgatctggaacctttgagagtctatgtaggctgtaagtggccactctcccagcacctaccgagggtgggccaccatgccaggccctgagataatgtggcgatcgaggcagatgcagtgtgtgcccccttggactcactggtggcagggggcagtcactggcaatagggaaacaaggaaggccaagcacagtggctcactcctgtaatcccagcacttagggaggccaagactggaggatcacttgagcccaggaatttgagtccagcctggacaacatagcaagacccccatctctacaaaaaatttaaaaaaaaattagaggccaggcacggtggctcacgcctgtaattccagcactttaggaggccgaggcgggcggatcacaaggtcaggagttcaagatcagcctgaccaacatggcaaaaccccgtctctactaaaaatacaaaaattagtccggtgtggtggcaggtgcctgtaatcccagctacttgggaggcttaggcaggagaatcgcttgaacccaggaggcggaggttgcaatgagccgagatcgtgccattgcactccagcctgggcgacaatagcaagactccatctcaaaaaaaaaaaaaaaaaaaaaggatgaagaggaagccaggagacaggctgaggacagagcacttcaatcaggcaaggggaggattttgtacacatgtgcactcaggggatcaggaagggctccaatgcttccatcagattctcaaagggggccaggtgcagtggctcacacctgtaatcccagcactttgggaggccaaggtggtggatcacgaggccaggagttcgagaccatcccggctaacacggtgaaaccacatctctactaaaaatacaaaaattagccaggagtgctggcatgtgcctgtagtcccagctactccagagacccagtattttgagtcctggcctacactcggtaggtgctgggagagtggccacttacagcctacatagactctcaaaggttccagatcaagacccctaggcagggaagaaggctgtactgttcctgctgctcccccacgaatccagagctgagataagggatgcccagtagggagtctgggctccggccctagggcccacgtgagacaggagaatcacttgaactgaggaggtgggggttgcggtgagccaagatcacaccattgcagtccagcctgggtgacagagtgagactccaactcaaaatgaagaaaaaaaggccgggcatgatggctcacacctgtaatcccagcactttggaggctgaggcaggtggatcaggacgtcaggagatggagaccagcctggccaatatggcgaaaccccatctctactaaaaatacaaaaaattagctgggcatggtgatgggcacctgttttcccagctactcaggaggctgaggcaggagaatcgcttgaacccgggaggcggaggttgcagtgagacgaaagttgtgccactgcattccagcctgggcgacagagtgagactctgtctaaaaaaaaaagaaaaaagaaaaagattctcaaagggatccattacccccaaacaagaacgtctggtctggttatgtttcctgtgttttctactttggggcattggcagggaggacacaaatcacaggtctgcaaaagctggggtgcagggtttcttcattgtgttctcacaaaggacccttagggacagttttttctctgatttgaataaccagactggttgtgctttgcctggaagtgttttgttttttgaattttgtggacaccgcatggcattaactgatctttttcatgttgatatcaccttcaagaaagcttcattcattcatgtatgcgttgaatcaacaaatgattttattaagccaaaggattttaggaacacttctgtgagccagcgctgtgttcagagccaacagtggggcacgtgatagaaagtgctggcactgcgtgatctacatgttagctgttggcctccttcctggcttgttgtatccccctctttttttaaaccatcattttccttctgttcttttttgcctgccccattattttaagcgagttttatcttacctgtattatgtatttttatgaatcaccacaaatcattccaggcgaggcagagatgtgaagaaaaaggaataaaatatagatatcaggccgggcgcggtggctcacgcgtgtaatcccagcactttgggaggccaaggcgggcggatcacctgaggagttcaataccagcctgggcaatatggtgaaaccccacctctactaaaaatacaaaaattatccaggtgtggtggtgcgtgcctataatcccagctactcaggaggccgaggcaggagaatcgcttgaacccgggaggcagaggctgcagtgagccgagatcgcgccactgccctccagcctgggcaacagggccagactccatctcaaaaaataaatacataaataaaataaaattaaatatagatatctactttgtgccagactcagggaaatggccttaaatgcagggatgagagatccagagcctggcctcagagccatctccccaggttcctcctcctcctcaagtctggaaggttgatttttggataataaaattttaagcatgtacacaggtaaacgagataactataacaaagccaatatgtccatcaagcggatgacacaatgatcaagatcctgccacacaagctgaatgtattttgtgttccccttttcatttttgttgtcaaggtatttaaagcctggctgctcaaaatgtgacctgaggaccagcagtgagagcatcgtctgggagcttgttggaacagactcccagccccattctgattcattatctgctgagtcagaatctgcattttaacaagatctccgatgactcatttgcacgctaatgtttcagaaacagtattttaaaccccaaacatcgtgtcatttcactcccaaaaaacatggacattttcatttctaaagaacatgaagggccgggcgtggtggctcacacctgtaatcccagcactttgggaggccgaggctggtggatcacctgaggtcaggagtttgaaatcagcctggccaacatggcgaaaccccatctctactaaaagtacaaaaattagccaggcatgttggcacacccctgtaatcccagctactcaggaggctgaggcaggagaatcacttgaatccgggagacagaggttgtagtgagctgagatcgcaccactgcactccagcctgggcaacagagtacgactcagtctcaataataaagaacgtggacattttcttaaatagccacaatgttcttaccacctaactaaattaattctttggtatcatctaataccaaatacttagtccatatacaaatctctctgtctcaaaatgtcttttttttttttttttttgagacagagtctcgctctgtcgcccaggctggagtgcagtggcgcgatctctgctcactgcaagctctgcctcctgggttcacgccattctcctgcctcagcctcccaagtagctgggactagaggcgcccaccaccacgcctggctaatttttttgtagttttagtagagaaggggtttcaccgtgttagccaggacggtctcgatctcctgacctcgtgatctgcctgcctcggcctcccaaagtgctgggattacaggcgtgagccaccatgcccggcctccaaatgtctttttaacagttggtttgttcaaagcaagatccaaacaaggtccgcacatgacatgcggttgctgtggctctccgtctggagtgcacccccatccccattttctgctttcatgcctttgatttatggcagagtttggtcacgtgtgttgcagaatatctatgttcaggatttgtgtgtttgcttcctcttggtgtgatttgtctttttattccccaaactgcctgaaaactggaagtttaacgtcaggtttcagttctgtggcgagcacactctaagcagttgtgaggattttgccccacttcctgcagttatttcacctctttttcttttgtgtgtgtgtgtgtgtgtgtttgtttgagacggagtcttgctctatcaccaggctggagtgcagtggtgcgatctcggctcactgcaacctccgcctcccaggttcaagcgagtctcctgcctcagcctcccaagcagctaggactacaggcatgcgccaccacgcccagctaatttttgtatttttagtagagatagggtttcactgtgttggctgggctggtcttgaactcctgacctcaggtgatccacccatgtcggcctcccaaaatgctgggattacaggcctgagccactgtgcctggcccttctttttcttttctttgctgaagtgttttaaagccttggtactcagaatgtggtctgaagacctgcagtgtgggtgtcccttagaatcttgttggaaatgtagtcttgggcccttacatccttcctagagtgtcacaccaagaaggacatgcctgagaggcccactcctagggatgctaagattgactagtgggctcaggtggtgtcagcctaattgtaaagttagtctatcagactctcatttagaagctttacctgttgatgatcctggcctgaattaattattgtatttcattagggctcacaaaatagtttggttctattattcttcctacatttattagtaataatttatccataaaaaagacgtttttcatgccatttttataagggccagatgaacaaatgaaaaataaatttaaggctgggtgaggtggctcacgcctgaaatcccagcatttgagaggccaagtgggggcagattacttgagatcaggagttcaagaccagcctggccaacagagtgaaactccatctctaccaaaaatacaaaattgatctgggtgtggtggcacatgcctgcaatcccagctacaggggaggttgaggcaggagaatcgcttgaacctgggaggcagaggttgcagtgagccgagattgcaccactgcactccagcctgggtgacagagcgagactccatctcaaaaaacaaaaaacaaaaaaaaagaaggaaagagagagagggaagggagggagggagggaggggggaggaaggaaggaaggaaggaaaacttaaaagacaagaagtactttttctcattaaccaggatgatttgatggccctgaaatgcacttcatgtaggaaaggcaagaaaaatgcttaatacttttcctaacagtcagttttcagagtaaagagatggtgccctttttacttccattggtagcaaattttctttttcgtttcttttttttggagacagtcttgctttgtcactcaggctggagtgaagtgtgatcaccccagtgcactccaggctgggcaaaagagtgacagctaatctccaaaagcaaaaaagcaaagaaaacatactgtgtacaacctggggggctaaaaaaattttttttgaacttcattaagctgaagaacatctgtctagcaaaaaaaaagnnnnnnnnnnnnnnnnnnnnttttgtttttatttttctctctcttgtaaatatcatgaacttatgaaagttttatatattcagtgtgtttcacatacttgtaattcttattctaaaaaatattttaattataattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaaataattattttaataattattatttttaatgtagactttttaaaagtacaacatacagaaaaatggacaaatttagatcagtaaatgttcatattaagtcacacccgtatcaagaaacagaacaggctgggcacagtggctcacacctgtaatctcagcactttgggagcccaaggtgggaggatcacctgaacctaggagttcaagaccagcttgaacaacacagtgaaacctcgcctctaccaaaaaaaaaaaaaaaaaaaaaaaaattagtcaggtctggtggcacaggcctatagtcccagctactcgaaaggctgaggcaggaaaaccacttgagcccaggaagttgaggctgcagtgaactgtgatcacaccactgcactccaggctgggcaaaagagtgacagccagtctcaaaaagcaaaaaagaaagaaaacatactgtgtacaaccttgggggctaaaaaaattttttttgaacttcattaaacttaagaacatctgtttatcaaaaaaaaaaaaaagtaagtgagtgaaaaggcaaaccacagaataagaaaataattgcaacacaaattgataaaagattaacttcagaatatgtaaagaatttctacaaatcaataagaaaaaggcatgtccacaaacagaaaaaggacatttcacaaaagagattatcaaaatagtcaggaatcttgtaaggagacttcagacgtcagagaaaggcaaattaaaaccaggtgtggtggctcacacctgtaatcccagcactttgggaggccaagacgggtggatcacctgaggtcaggagttcgagagcagcctggccaacatggcgaaaagcccatctctactaaaaatacaaaaattacccgggcgtggtggcgggcatctgtaattccaggtactcaggaggctgaggcaggagaatcacttgaactcgagaggtggagattgcagtgagctgagattgtgccatggcactccagcctgggcgacggagcaaaactccctctcaaaaaaaaaaaaaaagagaaaaccatttgtcagtatccactaaagctgaacatatgcttaacaggatccagaagttccacggttagacatatgcccaacaggaatgtgttcatatggtcatgaagacgtctgcaagacactcatagcaggccagacacagtggctcacacctggaaacccagggctttggtatgccagggcgggaggattgcttaaggccggtgtatgaaatcagcctgggcaacatagctagaccccaccgctttaattcttcatcagattaaagaaattcacagccgggcatggtggctcatgcctgtaatcccagcactttgggaggctgaggtgggcggatcacctgaggtcaggagttcaagaccagcctggccaacatggggaaaccctgtctctaataaaaatacaaaacttagccgggtgtggtggcacatgcctgtaatcccagctacttgggaggctgaggcaggagaatcgcttgaaccagggaggcggaggttgtagtgagccgagatcacaccactgcactccagcctgggcgacagagtgagactccatctcaaaaaaaaaaggaaaaaaaaaattccctctgattcctggtttgctaggactttttatcagaaattagtcttggattttatcagatgccattttctgcatctatcataatcatatgatttttaatcctttatttccctgttgtaaggagtaaactgattattttaaatgtcaaaccactcttccatttccgaaatgaactctgcttgttttgatgtatcatgctttttttttttttttttttttgagaggagtctcgctctgtcaccaggctggagtgcagtggcgcaatcttggctgactgcaacctccgcctcccgggttcaagtgatcctcctgcctcagcctcccgagtagctgggactacaggtgtgcgccaccacgcccagctaatttttgcatttttagtagagatggagtttcaccatgttggccaggatagtctcaatctcttgacctcgtgatccgctggccttggcctcccaaagtgctgggattacaggcatgagccactgcacccggccgtattatgctttttataattccctggatttgatttactggaattttgtgcagcatttttgtatttatgttcgagagaaacggttgtttcaattttcctttcatttattgtgcttgctggattttaatatcaatgttatactggcttcataaaatgactgaaaaatgttttctcattttctattctctaaaacagtttatataaacttggcattatttctctttaaatgtttggaaaaattcgtcagtgaagctatctgggcgtagagatctccctaagatttttagtcatgagtaaaatatcttactcaggtgatacatttctttttttgttagttttggtgcatttctatttcaaggaatttgttcatttcacccagattgtcaagtttactggcataaggttggatataacatcctcttacttttttttttttttttttttgagatggagtctctctctgtcacccaggctggagtgcagtggcgcgatctcggctcactgcaagctccgcctcccgggttcacgccattctcctgcctcagcctcccgagtagctgggactacaggcgcccgccaccacgcccggctaattttttgtattttcagtagagacggggtttcaccgtgttagccaggacggtctcgatctcctggcctcgtgatccgcccgcctcggcctcccaaagttctgggattacaggagtcagccacctcgcctggcccctctaaaaaaaaaatgtcttaggatctattattgatgtcccccctttctatttggggggggggtgggtgattggggtgttctctttggggggggttgttcagtattgctagtgatttatcattttaaaaatctttaaaaaaaacttcagcatcattagttttctctactgtaagttggtttgctgtttcattgatacgtgttcatatctttattccttcccgtacttcctttaggtctgatttgctattccactgtaattttatctttcaccctgggttatttagaaatgcattgcttaattttcacgaggttcagatttttctagttttccttccttccttccttccttccttccttccttccttccttccttccttccttccttccttcctccttccttccttccttcctttctttcttctttcccaagtctcactctgtgcctaggctggagtgcaatggcacgatctcggctcactgcaacctccacctccctggttcaagtgattctcctgtctcagcctcccaagtggttgggattacaggtggctgtcagcatgcctgcctgatttttgtgtttttagtagagatggggcttcaccatgttggccagggtggttttgaactcctgacctcaagtgatccgcctgcctcggcctcccaaagtgctggggttgcaggcatgagccaccatgtccggccatcttttcttccctttctttcttttttcttttttttacatggggtcttgttctgtcacccaggctggagtgcagtgatacaatcttggctcactgcaacctccacctcctgggctcaagcagtcctcccacctcagcctcctgagtagctgggaccataggtgcatgccaccattcctggctaattttttgtatttttggtagagatggagtttggtatttttgttagataccagccatgttgcccaggctggtcttgaactcctgagcttaagcaatctgcctgcctcagtcttccacagggctaggatgacaggcacgagccactgtgctggacctctagttttctttttgttattggtttagattctagtatagtcagagaacatattctgagttatttcaattcattgatatttattgaggctttagctttgtgatctagcatatggtcaattttggtaaatgtttcacgtgtacttgaaaataatgtttctgagggtgcggtggctcacgcctgtaatcccagcactttaggaggctgaggtgggtggatcacgaggtcaagagattgagaccatcctggccaacatggtgaaaccccgtctctactaaaaatacaaaaattaggcgggcatggtggcgcgtgcctgtagttccagctactcgggaggctgaggcagaagaatcgcttgaacctgggaagcggaggttgcagtcagccaagattgcaccactgcactccagcctggtgacagagccagactccgtctcaaaaaaaaaagaaaaatgtttctttttccattgttgggtacagagttttgtctgtcaggtcaactttgctaattatgttgttcatatcttctatatccttgctcaatttttggtctgcttttatttttatttttttattttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcagcctcccaagtggttgggattacaggtggctgtcagcatgcctgcctgatttttgtgtttttagtagagatggggcttcaccgtgttagccagggtggttttgatctcctgacctcaagtgatccgcccgcctcggcctcccaaagtgctgggattacaggcgtgagccgccgcgccccgctggtctgcttttatagttgacgtaaaaggcttaattaaagtgttaaagtctcccactttcattgtagtgttttgtatttttccttttaattcagtcaatttttgcttttatattttgaaatgatgttattggataaatacagatttaaaattgtcacatcttcctagtgaatcaaaaacaacatatttgtgtgcatatatctccttcccttccttatacagaagctagtgtcgtttatacacttgtccttcatgtagtgattttaatttcttcctgaaatctactgctgagtaaacagccattaattggaaaaaatatttgcatcaatttcattaaaaaaattgtgatgcattccagccaaccaaagatactcaaatgacttttactgttaggaaaatgtattaattgaccaataaaacaagtttagataaataaaaacaatactttgaatataaaaatacagtttccgtataaaatgtattgtcatgaaggtttattggcctcattaaaaggagaagacaagatttgacagtgggggctaggcgcggtggctcacgcctgtaatcccagcactttgggaggctgaggcgggcggatctcttgaggtcaggacgagtatgagaccagcctggccaacatggtgaaacctcgtctctactaataatacaaaacttagctgggcatggtggcgggcgcctgtaatcccagctactccggagactgaggcaggagaattgcttgaacccaagagccagaggttgcggtgagccaagatcgcgccaccgcactccagcttgggcgacagagtgagactccatctcaaaaaaataaaaataaaaaataaagtcatagcaaaagttacagagaaacaccttgagggcaaaataaatactgaacccaaaagcacttccaaacacatggaaataggctgtgcgctcatcgacttcagaatcatagaatcttcagccatctcaatcgacatacatcagcaaaagcaggcatatgggatttatccaaacatgacatgcaacgcagatttgttccatatgatattgttggactagaaactgttacatagtaagtaaatgggtgagtgtgtcttcccgtgagagtgcgatgtcaaatgtcattccttatatcgtgtttactcagtgtatttagagacgaaaaagtcactaaaccaaaaaaaggagtgttgccaagaagttgtatagcttttcaagagtgtttatggcaaaagtcgttaattgaacagtaattgaacaggtaaatctgtaaactggaattcaccttgcttttttcccatgcaaatgtagattagagatgggagcagtggctcacacctgtaatcccagcacgttgaacggctgaatcacctgagatcaggagtttgagaccagcctggccaacacggtgaaaacctatctctactaaaaatacaaaaattagctgggggtggtggtgtgtacctgtaatcccggctacttgggaggctgaggcaggagaatcgcttgatcctgggaggcgaaggtgtcagtgagctgagattgcaccattgtactctagctcgggcgacaagagcgaaactccatctcaaaaaaaaaaaagtacacacacacacacacagagatttaagcaatggagtggcatggtcagaccatgctttgttttttttttttttttttttttttgaggccgagtctcactctctcacccgggctggagtgcaatggcgcgatgtcagttcaccgcaacctgtgcctcccaggttcaagcgattctcccttgtcagcctcccgagtagctgggattataggcacccgccaccatgcccggctaatttttgtatttttagtagagacagggtttcaccacattggtcaggctggtctcaaactcctgacctcaggtgatccaccgcctcagcctcccaaaatgttgggattataggcatgagccaccgcacccggcccagaccatgcttttaaaaaatctttctagcatctgatgtggagaggatgtatccagaagtacaagtcttgaaagaggccaggagactaacgtgtccaagcaaaagacgatgaggtcagtggggcagagctgagtcctgacagaggcccaaatgtgcatgtgaattctgaggatgataaaggtagcatttccaaactatgggttaagaggagctactcaacaaataatgatgagacatttcaactgtgggaaaaaagtaaagttgtatccctatttcactccaaatgtaaaaataaaatccagatggacaaaaggttcgaacataagaaattaaagaagagaccgggccttggctcacgcctgtaatcccagcactttgggaggctgaggcgggcggatcacctgaggtcaggagttcaagaccatcctggccaacgtggtgaaaccccgtctctactaaaatacaatattagccgggcatgatggcgggtgcctgtaatcccagctatttgggaggcttaagaggctcagatgggagaatcccttgaacccgggagatggtggttgcagtgagccgagatagcgccactgcactccagcctgggcggctcagcgagactttatctcaaaaaaaaaagaaagaaagaaaaaagaaatgaaagaagaaaaaaaatatagaaggaaacatgagtggatgaaaagaaatagcctgagtggaggagcatgacccgaagctgaagtcataaaggaaaaacaatatgacaacatcaaaaaacgtagttgtgggggaaaacagcatatgcaagacaaacagctgcgtgagaagcggcatctataacacattgcctgtttctcttggatagagaaaagctcttacaaataaataagaaagtaatatcgtttcatgaaaatgaataatgtacatgagtaggcagtaaacaaacttacaaaaagagacttgacctcactcataatttaaaaatagttttggggctgagcttgttggctgacgcctataatcccagcacttggggaggctgagatggcaggattacttgagcccaggagttggagaccagcctgggcaacatagtgagacaccatctctacaaaaaattttttaaaaattagccaggcctgctggtgcgcatctgtggtcccagctacttgagaggctgaggcgggaggatggattgagccctggaggtaaagactgtagggaaccatgatcatgccactgcactccagccagggcaacagagtgagatcttgtctcaataaaataaaaagtaaaaaatatttgggaggctgaggcgggcggatcatctgaagtcgggagttcgagaccagcttaaccaaaatggagaaactccgtctctactgaaaatacaaaaattggccgggtgcagtggctcacgcctgtaatcccagcactttgggaggccgaggtgggcggatcagctgaggtcaggagttcgaaactagcctgaccaacatggagaaaccccatctctactaaaaatacaaaattaggccaggcgcggtggctcacgcctgtaatcccagcactttgggaggccgaggtgggcggatcacgaggtcaggagatcgagaccaacctggcttaacacggtgaaaccccctctctactaaaaatacaaaaaattagccgggcaggcgcctgtagtcacagctactcaggaggctgaggcaggagaatggtgtgaacctgggaggcaaagcttgcagtgagctgagatctcgcctctgcgctccagcctgggtgacagagtgtgactccatttccaaaaaaaaaaaaaaaacaaataaacaaacaaacaaaaaaaccaaaaattagccgggcatggtggcacatgcctgtaatcccagctactcgggaggctgaggcaggagaatcgcttgaacctgggaggcagaggttgcggtgagccgagatcgtgccactgcactccagcctgggcaacaagagcgaaactccatcttaaaaaaataataataattttggaacaagatgatgatatactcttaaaacaaggatgaaaatgtcttcacagtcagtccaggcaacactgggggagataaaccttctcccatgctgtcgttggagtatgaattggcaaaacctctttgggaggtaatctatcgatatctatttttccccaaaaaattttaaatgaaaaatttcaaatatatagaaaagttgaaaaattatatggtggacaaccacatcactacacttaaatttgacaattgtcaacacttttgagtgtttcttttatcacgtatatctatctacccatccagcaagccatcttatattttgatgcattttaaagtaaattgcacgctggatgtggtggctcacacctgtaatcccagcactttgggaggccaaggcaggtggatcacttgaggtcaggagttcgaaaccagctcggtcaacattgtgaaaccctgtctctactaaaaatacaaaaaattagccgggcatggtggcaggcgcctgtaatcccagctatgtgggaggctgagacaggagaatcgcttgaacccgggacacagaagttgtagtgagccaagattgcaccactgcactccagcctgggcgacagagcaagaccccatctcaaaaaaaaaaaagaaattaataaaaataaattgctgacttaagtataattcaactctaaacatttcagcatacatatcaacaaaatgtgtttgtgcttcttctttaaggtaatatttacatacagtgacatgcacaaattctaagtggaccattcattgcgtgtgttctgacacatgcacaccttggtaattcaaacacctatcaagatatagaatattttcatcattccagaaagttccttctagtcccttcccagttagtcccatcctctcaagcatttttttttttttactataggttagttttgctggttctagaacctcatataaatggagttatacaatatgatttttattgccttagcttaacaaatctgctgtgctctgtttgaattccctttccctacatcagggtcataaaattcctccagaaagaaagctgagggtaacgacagggctcgtgttatttgtccatgttttctagagatcactgtcctgctctgcccattgtcaaatgtctgaaaacattttataggttttgtccagtattctagttgtttatggtgaaagaattagtccagtaccaatgatttcttcatggaaaggccaaataagggacactttgagaaccaatatagtgataacagattataaccattgaataaaatagaattcatgagcctattctgctgtaaataaaaaaaatcacacataaatgagaagaaagaaggaagacctaaggcttctgtcactcagcataatgatatttgttgttgttgttttgagacggagtcttgctctgttgctcaggctggagtgcagcggtgcaatctcggctcactgcaacctctgcctcccaggtttaagcaattctcctgcctcagccttctgagtagctgggattacaggaacgtgccaccgcgcccagctaatttttgcgtttttcgtagagacagggtttcatcatgttggccaggctggtctcgaactcctgacctcaagtgatccagccgcctcggcctcccaaagtgctgggattacaggcatgagccactggcgcgcggccagcataatgatttttgggattcatcacgctgctgtatctgttgttgactcctctttactcctgagtaggattctactgtaggaatataccacagtgggcttttccagtctcctgttgatggacatttgggttgtttgcagtttggggctcttccgaataaagctggtataaaacattcttgtgcaggcagttttggggatacgttttctcgtgggtcgcttgaagggggtacatagaacatacacaggccctcttcctggggctcacagtctactgtaacttcagtacaagacgcagtgacgtgagtacacgctgtgtgtcaggtgcagaaatgacagtaagaggcgtgaggaggtgggaagtgcttctttggggagagctaggggcggcttcttggaggaggggggctcgggtactggtacagcttggtttagtaggaggatcagaggctctgggtcagatacacctgcgtctagtctttctctctcacacacacataaagatccctgggcagtctcacttttctcagctgtaaaacggggttcatgacaccacaggatttgctggaataacgggagtaaaaggcctctttcattaaacgctcctcttttccctacaggcctggccctgctggccgctttcaatgtggatgtggcccggccctggctcacgcccaagggaggtgcccctttcgtgctcagctcccttctgcaccaagaccccagcaccaaccagacctggtgagtagggccggtgggcaagaggccttcagactgaggggcttccaggcaatctgagatgggccccagagacggccatggcagcccaccccaccccaccgtcaggagaggaactcctttctctttcagaagggcatgcaggagaaagagagaaggtgtgagagaggctgtgggcatcgggctggtctgtggggtccacggaaccccagcctcacgcctcactgggcctctccctgctccattgcccagggggagggtggacttaaagacaattttagtggccgggcacggtggctcacgcctgtaatcccagcactttgggaggccgaggcgggcggatcacgaggtcaggagattgagaccatcctggctaacacggtgaaaccctgtctctactaaaaaatagaaaaaattagccaggcgaggaggcgggcgcctgtagtcccagctactcaggaggctgaggcaggagaatggcgtgaacccgggaggcggagcttgcagtgaaccgagatggcgccactgcactccagcctgggcgacagagcgagactccgtctcaaaaaaaaaaaaaaaagacaattttaaaataaagcatattaaggctcttttgttccttatggaagtaacacatgttcaatatagaacatttggaaacaaaaaataacaaagaaaaaactgggcctggcaccgtggctcacgcctgtaatctcaacacttagggaggctgaagctggaggatttcttgaggccaggagttcaagaccaccctgggcaacatagtgagacccccccaactcaaaaaaaaccaaaaactgtctgggcatggtggtgcctgcctgtagtctcagctacttgggaggctgaggcaggaggaccacttgggcccggaggccgaggctgtagggagccgtgattgcaccactgcactccggcctgtctccagaacaaaaaccctgaaactatgaggaacaagcgtgtactggtaagaggcaggctgtggctctggcagccagggttcagtggcagcttcaccgtggatttgccgcatagcctgagcaaggtgctcgggcctgagcttcagtttcccttctctgcagtcagcgtggggaactacctacttcacaggattgtcgcaaagactatttgagataatgcatgtaaagggcttagcacaggttctgccgggcgcggtggctcacgcctgtaatcccagcactttgggaggccgaggcgggcggatcatttgaggtcaggagttggagaccagcctggccaacatggtgaaaccccgtctctactaaaaatacaaaaattatctgggcgtggtggtacacgcgcgtagtcccagctactcgggaggctgaggcaggagaattgcttgaacctgggaggtggaggttgcagtgagccaagatcgtgccattgcactacagcctgggcgacagagcaagactccgtctcaaaaaaaaaaaaaaaaaaaaagggcttagcacaatttctggccacattaatgctcaataaacattactttacattttttaaatatcatctatacccacctattagataagcaaaatgtaaaatctgccaacattgctggtaaggttgcggtgaaacagggacgtgtgggagtgtgaattgcgatcaccaccttggagagcaattttgccgtatctggtaaagctgaggatgcacgtggcctctgacacttccactccccgatcccagctctagagaaattctcagacacatataaaaatgtttgtgtgccgggcgcagtggctcacacctgtaatcccagcactttgggaggccgaggccggtggatcacctgaggtcaggaattcgagacctaggctggccaacctggcgaaaccccgtctccactaaagatacaaaaaaaaaaaaaattagctgggtgtggtggcgggcgcctgtaatcccaggttcttgggaggctgaggcaggagaattgcttgaacccaggaggtggaggctgcagtgagccgagatcgtgccattgcactccagcctgggtgacggagcgagactctgtctcagaaaaagaaaagcaagcaaaaaatgtttgtggtagcattgtttggaatcatgaaagactggcaatattcctcttaggaaaatgggaaaaatactgatatgactcatgcaatgcaatactaaaagcagatcccctgaatgaagccagtgcaatggttgtttacctggatccatctggaaacataccgtgagttgaaaaaggcaagttgtagaatttaatatacaaaggttggcaggtgcagtggctcacctgtaatcctagcactttgggaggtcaaggcgggtggatcacatgagcccaggagttcgagaccagcctgggtaacacggtgagaccctgtctacaaaaaatataaaaaaatcagccggatatggtggtttaagcctgtagtccgtcccagctattgggaggctgaagtgagagacctgcctgagcccgggggcgggtgggtcgaggctgcagtgagccgcgattgtgccactgcacttcagcctgggtgacagaacgagaccctgtctcaaaaaaaaaagaagcaagtaagtaaaatatgcattccctcagatggcgatggtggccgcgtgctgatgtaggagtgtgtctgcagttaggagaagctctggtggaaagggtcatgagatccgaggctcatttgaatttcccatgtgtcaccaaaatgacttttatttatttctttacctattatttatttattggagacagagtcttgctctgtcacccaggctggagtgcagtggtgtaatctcagctcactgcaacctccgcctcctgggttcaagtgattctcctgcctcagcctcctgagtagctgggattacaggcgcccgccaccacgcccagctaattttttgtatttttagtagaaacagggtttcgccacgttggccaggatggtcttgaactcctgacctcaaatgatctgcccacttcggcctcccaaagtgctgggattacaggcatgagccaccgcacctggccccaaaatgacttctagtgctgtgttgttttaaagccagatctggtcaaggtttatgtattacgtattgctgttatgtctctgtcattgatttcaatccaaagcagtgatttctcccccatttttttctgggtggtcatagggcttttcttgtgcatactctcccactgagcgggcccagcctaggatggttacctcctcatcccaccccagcccaccagattgctttgctcctggtcagtggtcaagggtttccttcacacccagcacacaggagcaagtgagcccagggttcaaacaggcactggggcagagccaggtgaggagccagggttcctggctgggcagggcgggagctttgcttgaataggatgggtgggcagtggtggctcccgaagcagcctcataggccctgggacttgggccttgaccctgacagccaggcagacttggatcctgtgatactgtgaaatgtatatttgacattccaagactgaatatatattttacaatataacaaataaaaatatatttggtctcaaaataaacatttggtcccattatctggcatacatgcctaaaatctctggaatctccaaagtaataaatgtctttttctttgttaatgagttgacgggggaccggcagcccccagatagcttcaaaatgggggctggtcactggagagaaccaggcacgatcagagggttgggactttcagccccacacccctcttctgggagagaagggctgaaggtttagttgatcaccagcggccagtgattcaatgagtcatgcctatgtaatgaggcctccataaaactcaaaaggacagggtttggggagcttctgggtagcagaacatgtggaagtttctggagggtggcccccgagagggcatggaagctttgcccctcacccccactttgcccctcacccccactttgccttatgcatctcctcatctgtatcctttgtaatatcttttttttttctttttgaggcagagtcttgctctgccacccaggctggagtgtggtggcatgctctcggctcactgcaaccactgggttcaagcgattctcctgcctcagcctccctagtagctgagattacaggcgcctgccaccacgcccatctgagttttgtatttttagtagagacggggtttcaccaatgttggccaggctggtctcgaactcctgacctcgtgatccgcccgcctcggcctctcaaagtgctgggattacaggcgtgagccaaggcacctggcctgtaatatcctttataataaaccagtaaatgtcggtaagtgcttctctgagttctctgagccactctagcaaattaagcccaaggaaagggtcccagaaaccctgatatggttgtttggtcgaaagcacaggtgaaataaccggcggctggtgatgggcctcggaagttaggagcagtcttgtgggactgagacctcgacctgtgagggctgatgctacctccaggtggagcatgtcggaattgagttgaacgtgaggaccttcagctggagctggttgccgaaggactgcttgccccgtgtggagggaaaaccccacccacctggggtcactggactgttctgtgttgtgagagctgcaggggagacagagctcgacgtttcctacatcattagagagtcctttctggatcctggtttcatcggtgcagtcaaaagtctggtcactgccaggcgcggtggctcacgcctgtaatcccagcactttgggaggctgaggcgggcagatcatttgaggtcaggagtttgagatcagcctggccaatatgctgaagccttgtccctactaaaaatacaaaaattatctgggcgtggtggcgcgcacctgtagtcccagctgcttgggaggctgaggcaggagaatggcatgaacgcgggaggcggagcttgcagtgagccgagatcgcgccactgcactccagcctgggcgacagtgagactccgtctcaaaaaaaaaaaaaaaagtctgctcaccattagatttaagtggtaaggatggggccaattcattcattcattcattcattcattcagcaagtatggatggagcacttactcagtgccaggcaatatttggggaataagagggagacatggtcactgccttcatggagctcccgggctcatgagggaaacacaagctagacgatgacaagagtgacaatgaccccaccgaataacagctctgttgggggacgtccgaggtacgggggggcgcatcgaggcaggtgtgttcatcagcgtctactaggatttgcagggtgactgggaattagcatgagaaggaacgggaaggggatggcaggcacagagaacagcttgatcagaagcctggaggccggctgagtaaggtcaggaaactgagaaaatcacgtgtggctaaagctgacagtgatgaaaagtaagctgggagagtgtggtggtgcctcgtcacccaggcactgagggtttggaggaactagagggtctgaagccgggaggggtggtgaggttttcagggagttttgtgttgcacgaagatgaattaaaggtcaagattgtgtttggtttgggtaaaattttatcaacatgtgccatacagaagaatgcacacccggctgggcgcgggggctcacgcctgtcatcccagcactttgggaggccaaggcgggcgggtcacctgaggtcaggagttccagaccagcctggccaacatggtgaaaccccgtctccactaaaaatataaaaattagccgggtgtggtggtgggcgcttgtaatcccagctacttaggagaggcaggagaattgcttgaacccgggaggtggaggttacagtgagccaagaccgcagcattgcactccagcctgggcaataagaatgaaactctgtctctccaaaaaaaaaaaaaaagagagagagaaaaatgcacacctcataagcatgcagcgcagtgaacatccgcagagtgaagcactgtgtaagcagcatgcagatcaagggcacgtgagctgcggcgcctaggccccctctaagccccgcactcccttccagacacatctgctgccaagagtaacccccagctgactttcatctccgtggattagcctcgcctggttttgcatttagtatcaacgaggcatacggtgtgtgccccgctacgtcgggctcctctctctccacataaggcctgtgaatttcatccatcctgttgccccaggcggtacttcttctggttgccagggttacattgtgtcgacagtactgatgattggcatttgggctgttttcttgggctgtgatgaatagcactgatgtgcacctccttttgatggatgaatgttcttttttttttttaatccctcagagttgatcccaaagaatgtactcatttttggggagggcatatgtgctcaggagtgggattgctgggtcagaagttatgcaattggttctgcattcagttttccatactgtttgtagggtgtgagcaggtttcagtcagcgttttctgtaactgtctcctgcctagttccctcccaccaatacccagcgaccccacgcctcagctccaggtcccaccgacattcacagtccctctctcagaagcctaaaggccagggtgcaggagagagtttggagcccgtgtcgcagagggctctgagtccaccaggggctgggggagggcccagcggggctccctgaacacctgctgaagcagagaggggctcccaggcttgaacacgctggggaggaggatgtggtgggaggcacttctgggttcctgctgcagagagtggggcctgagaccacgggcctgctgcatggggcaggaagtgcgctggctggccaactcgggcctagaaaaaggcaggggctgtgctcctgcttgagaatgacgtgtgcctctcactcacattgtctctcttaaaatgtaagagaccagggctggcagcatcatgggttttggttgccacagaaggtatgggtgggacagacagcagacatggaaatagaccctgagggctgggcatgggggctcacacccgtaatcccagcactttgggaggctgaggccggcagatcacttgaggtcaggagttcgagaccagcctggccaacatggtgaaaacccatctctactaaagataccaaaaaaaaaaaaatttagctgggcatggtggcaggtgcctgtaattccagctactcaggaggctgaggcaggagaatcacttgaacccaggaggcagaggttgcagtgagccaagatcatgccattgcactccagcctgggcgacagagtgagactccatctcaaaaaaaagaaaaaaaaaaaaaagaaagaaagaaataaaccctgagaacaggacaggttagagctgggtgaaggcaagatgtgagcttcaagtcagtgaccagttaaaaagattgttaaacatttaaatacaaaatactaaataaggtcaggcatggtggctcgtgcctgtagtctcagcactttggaaggccaaggcaggcagatcacctgagctcaggagttcaagagcagcctggccaacatggtgaaaccccatctctaataaaaatacaaaaattaaccgggtgtggtggtggcacatgcctgtaatcccagctactcaggaggcagaggctaaggcaggagaatcacttgaaccagggaggcggaggttgcagtgagccgagatcacgccactgcactccagcctgggagacagagtgagactccatctcaaaaagcaaacaaacaacgaaaaacatactaaagcaataaataaaggcaggagatggacaagggttgctgggctgtacccagctcagggtgtaacagggcccctgtggctgcgagctgatggccagtcctctgtcagagctggtgggtcaatggtttgtcagccacgtggtcaacaaacctgcaaactcccggcagtgggggataaaaggtgtgggaagcagaggcagctcagagggccccaggccatgtcattgcatgatggcggcatgaatggcagtcttgggatctgcagtgcgcaccctgcacagctgttcatgatggcctcctgggaacgcgcagtccaggtgggaagaaagggtgggggtggggtgctatagtcagggctgctgcagggcctggaggggatcaggctgcacttcctttgggaaggcttcctgaggagctggggtttgggatgattgctctgcagcaggagggatctcaggcagaggaaacagtccgggcagaggactgaggaggagagagactggaggcgggtccaggcctgcacctaccccaccaaaacggggtctgcggtggagcccagttttgaccccacccttcctgggggagcagggaaggagatgctgggtctagggctgaggtcggggctggggagagaggcagggttgctaaggaagcaacctaatttgggggctcagctgcagagccggaacagaggagcagctctctgctgcacccagccctccgcccctcagccctgccccagatgagccccctcagctgttgcctgggctgttgttcaatagtcactcaacacttactgagcccttgttctgtgccaggcattgctccagaccctgggaataacacagtgaagaagatagacaagatccttcgggagcctactgtctcgtggggagacagataataggcactatcagatgatggcaggttctgagaaggaaatcaaacagggtgatgtgaagcagagtaactgggttgtgaggcacggctgggtagagaaagcatttatgaggaggtgacaggcgaggctggggaaggagaataagccaaccttggggagagtggaaggtgagggctctgggaataggaaacagcgcggtggagggaacagtgccgtggagggaacagcgccgtggagggcctgaggcaggaaatgctggcgctggtcacccaggaactggggctgccactgacagaagggacattggtgtaaactacatgagtgggccaggtgctgtggctcatgcctgaaactcactgtaactcactaggctcactcccagcagtttgggaggccaaggcaggaagattacctgagcccaggagttcgagactagcctgggcaacatggcaaaaccccatctctacaaaacataagaaaatttgccaggtgtgatggcacgcatctgtggtcccagttacttgggagactgaggtgggaggatcgcttgagcctgggaggtcaaggctgcagtgaaccgtgatcatgccactgtacttcaacttaggtgacagaaggagactctgtcttaaaaaaaaaattacatgagtaaattaaaaaccaaataagtgggccaggcacagtggctcacttctattaatatagaagttttcttgtagttttggaggccagaagtctgaaaaggtgtcagcagggctgggtcccttctagaagctctgggggagaatctgttttcttgccttatttggcttctagaagctgcctgcattccttggctcacggcctcctcctcctcaagcctgcagcatagtaagctttgcatctttctctgacactttggaagaccaaggtgggagtgcttgagcccaggatcagcttgggcaacacagtgagacttcatctctatagacaaattaacaaaattagctgggcaaggtaactcgctcctgtaggcccagcaacttgtgaggctgaggtaggaggattgctgagcccgggaggtcaaggctgcagtgagctgtgatcacactactgcactccagcctggacaacagagcaagacactacctaaaaaacaaacaaaccccacaaaataacaggaggctattaccatcaacaaggccggacgatgatggaaggagcatctggagaagagttgctttctagaaataatttggagagtcaggcacggtggctcatgcttgtaattccagcactttgggaggctgaggtgggtggatcacctgaggtcaggatatcaagaccagcctggccaacatggtgaaaccctgtctctactaaaaatacaaaaattggccgggtgtggtggctcacacctgtaatcccagcaatttgggaggccgaagtgagtggatcacctgaggtcaggagttcaagaccagcctggccaacatggtgaaaaccccatctgtactaaaaatacgaaaattagctggtcatggtggcgggcgcctgtaatcgcagcactttgggaggccaaggcaggagaatcgcctgaacccaggaggtggaggttacagtgagccgagatcgtgccattgcactccagcctgggcgacaagagtgaaactccatctcaaaaaaagaaaaaaaaaaaaaagaatttggagagagaaccaacagggttggcaggtggattggatgtagggcatgagtgaaaacacgacgaagtgaggatgcctcctgggttttgccttgagaacttagtggttgctggtgccatttgctgtggcggggaagatgagaagaagcaggcttgacaggaaagaccacaggttctgtttgtttcctatcgacgctgtaacaagttaccacaaatgtagtggcttacaacaacacaggtttattattattattattattattattattattattattattttgcactctttcacccaggctggagtgcagtggtgagatctcagctcactgcaacttccacctcccaggttcaagtgattctcctgcctcagcctcccgagtagctgggattacaggctttcaccactatgcccagctaatgtttgtatttttagtagagacggggtttcaccctgttggccaggctggtcttgaactcctgacctcaggtgatccgcctgcctcggcctcccaaagtgctgggatgacaggtgtgagacactgagcccagctgcaagtttattatcttgtagttttggaggtcagaagtctgaaaagctatcagcagggctgggtcccttctagaagctctgggggagaatctgttttcttgcctttttaggcttctagaagctgcttgcattccttggctgacgggctcctcctcctccttaggcctgcagcatagcaagcttcacatctttctccgactctgattctcctgcctccctcctagaaggacttttgtgattacactggggctttacagcccagccaggacagccctgggggcttctgggatgggagaggcctccttgggaggctcccagcattccctgcagtctcgccacttctcccctctgcctgcctcaacgtccccctgagtccctgcggctcgcccatgccaccgttttcggggcctccctcatagaaggacccttgtgatttcactgagcccacctagataatccaggataacccccccatctcatgatccttaatttattaactcacatctacgaagtcccttttgccataaaaggcaacatattcacaggttctggggattaggacgtggccttctttggggggccattattctgcctacgatagcagatggagaggtgggaatttcagccgttataggtgtattgaagccatgggcttggaagggatcactagggagagtgtgccggcaaggaagacagtgacccagcccccagatcctggtggcagatagaggtcagaccgcgaaggcaccagcgaagccttgaggaatgaggagagagtaggcagaaatctagaaaaaagtgttcgaaggagatggttactcatgtttggggcttctgagaggttgaggaagatgaggacagagagcggtccgttggatgtggcattgtgggggcccctggtgaccttcacaggaactgactcagagggtgggaagtcagcttggggtgggttcagttgtgggtgggcggatggacgcacaggtgcagactttcttattattctgtaagccatgccgatacgtgaatatatttcataatgtattaaaatgtagagtgataggagttgaggaagtggagacggtatctcatttctgccccaccttcctgtgctctttagtctgtcccaacccactgtagccacatcatgacctttttttttttttttttttttttgagacagagtctcgctctgtcacccaggctggagttcagtggcgtgatctcggctcactgcaacctctgcctcctgggttcacaccattctcctgcctcaggctcccgagtagctgggactacaggcacccgccaccacgcccggctaattttttgtatttttagtagagacggggtttcaccatgttagccaggatggtctcgatctcctgacctcgtgatctgcctgcctcggcctcccaaagtgctgggattacaggcgtgagccaccgcgcccggcctcatcatgagcttttgaaagcacagctaatcatgtgcttcccctttataaagtcctccatgacttctactgccctctgcagaaagaccttggacttggttcactgttaaccaccaagcccctcgtcccctccccaccatcccctatgacaacccccggagctcactgtctgtctcaggacagcccagttctcctgggtaacgtggatggtgagaatgttgaggctgtccctggaatctgccgtctccctggactgggcctgggtgggggcaagaagtttgcagtcaggaggcgcagctcttgaggctgccttaatcaggctgaggcagccacccccaaacctccagttcttttatttatttatttatttatgagacgaagtcacactctgtcccccaggctggagtgcagtggcgtgatctccgctcactgcaacctctgcctcccaggttcaagcaattctcctgcctcagcctcctgagtagctgggactacaggcacacgccaccatgcccggctaatttttgtatttttagtagacacggggtttcaccatattgatcaggctggtctcaaagtcctgaccccagatgatccacctgcctcagcctcccaaagtgctgggattacaggcgtgagccgccgcgcccggcctccaaacctccagttctgactgacccacaggataggggcaccagcgtactcttctcaggaactaaggccaggcagggcaggccccctgggtggcccacgaggaagccagcactgcccccaacagaaccaaccccaacgctggtggttttctggcctccccatccctgtccccataagagagcagagtttttattaaccatcagtatcaccccttctttgtcagggtgggcagcaggcagagaggggttgcatttaaccatttcctgcctggtgctgtgtagaagcagaggttgggcaaatgtcttccccataatccagagtctgggctaggaatctgccggccagacagggagcttgtgagtgcaggcaactggaatgggaagggtgctgggcaggcagggagaagacgaggaacatcagccagctcagctttgcaacctcccctcccactcaggctcctggtcaccagccccagaaccaagaggacaccagggcccctccatcgatgttcccttgtccaggatgaaatcctttgccatcctgtaggtaagtcagccccaactccagggaatgctccccaggaccccctttctagcaaaatccccctcatctaaactcaaaccattccaaccccagccctgcctcatccagcccgttcacccctagactccagcataacccacagcaagattccatcccaatgcccagtcccaccccaacccaatcctaatccccagccacctttcctgacacagtcctagcaacagaaatgatacctacagcgtattgcgtgcccaccctgtgcccggcagtcctctgagtcattctgttttcatcctcaaaaccgcgccatttataagagaggaagctacagttcagagaatgtaggtcttttggttgccagtatgacaaagttcacacttttagtgttggtggctgattcgaaactctagcccttcctgatgcaagtcatcacacctcagtgcaattcaccccctacatattcagtctaactgtggccaccctagtaactagcatggggcctgacatatattaggtactcaataaatgccatttgaatgaatgaatgaatgaatgaatgaatgaacctgattcactcattaaactctatccatcctacccagtcaaactcaggtcacagatttactgacaacctcttggctatatatatataaataaatagaatccttgtcttgtctgaggctgggcgccgtggctcacgcctgtaatcttagcacactgggaggccaaggcgggtagatcatttgaggtccagagttcgagaccagcctggccaatatgatgaaaccccatctctaccaaaaatacaaaaatcagccaggcgtggtggtgcatgcctacaatcccagctatttgggaggctgaggcagaagaatcgcttgaacccaggaggtggaggttacagtgagctgacattgcaccactggactccagcctgggcaacagagcaagactgtttaaaaaaaaaaaatcctgccaggcacggtggctcatgcctgtaatcccaacactttgggaggctgaggtgggccgatcatgggtcaggagatcgagaccatcctagctaacacggtgaaatcccgtctctactaaaaatacaaaaagaaattagccaggtgtggtgacgggcacacgtagtcccagctactcaggaggctgaggcaggagaatggcgtgaacctgggaggcggagcttgcagtgagccgagattgcgccactgcactccagcctgggcgacagagcaagactctgtctcaaaaaaaaaaaaaaaaaaaaaaaaaatccttgtctgagaggcactgagttgaacagactcaatctcagtccagcagggttgactgagtgattccatgactgaaaaataagacagtatcctgaggctgacagtggggaggacgaggaaggagctaccatttctgcccctgaggctgggggcagtaagattccccaggatgggtctgtgaggctggggggttccttggtccacacagccagtcccacggtatcttgcacattccttggcacttacatacccaccaggcagtgcttctccacccacctgcccgaccaaacccactgaggaaaagcagcaggcatccgctgttgctggacgcccatcaccacgctcacaaggctgggcacagagcagacgtcaatgggcacgtgttgaaagggtcagcaaatgagccccggggatgggcactcggccctgaacgtgtccagtcctgaccttgaaggcccccgctctagctttctagaggcttctctgagtggccaacagttcctcatgggggcctgaccaaggtggctctgtgccctctgaccttggcttcgggtctctgcctcccagagtcccctcctcctcctcacctgggcttaactttttcagagcatgtccccatccccaaggggaggcaccggggagtgaccgttgtccggagccaccacggtgttttggtgagtgcaggagcgagaggagggagggccttagggaggctggtgctagccctcgtggttgaccctggtgttgagaccagttctgactgccatgctgttcccgaggctgagtctagcgtctccctggtgccaaccccagggctgactgtagctctgaccaccctgataccagggctgacctaggtattccctgtgacccagcacactcctgcaggtgtcggcctcggccttgatgccaacactgactcctacacccggtgaggggtgggccagctcttcctgtgccccctgcctggttgagccactgagttctggaatgggggtgagaatgtggctgtggctcgggaatcgggaggtgacctggtgtttccccaccctctcttccctcccacagatatgcattcaagtgctggtccggcggcctcacagcctcagctcagaactcacaggcacctgtagcctcctgggccctgacctccgtccccaggctcaggccaacttcttcgaccttggtaaggattggacattcactggccttggatagctctaaagagatctccttggtctccaagaaaaggcaccagctcacggcagatgcagtgggacgcaggcccacagtggagcaaggcagggttgaggcatcacgtgaaaggaatcagggcagaaccatgtgtgagcgtgctcaggcgaggatggagcctttctgactctgagctcttccatgtgtgtttttaaagaaaatctcctggatccagatgcacgtgtggacactggagactgctacagcaacaaagaaggcggtggagaagacgatgtgaacacagccaggcagcgccgggctctggagaaggaggaggaggaagacaaggaggaggaggaagacgaggaggaggaggaagctggtgagaagaggcagatctgggttgctctgagtctatcagagccaattcctaggctggtggcctccaagggtgaggggtgcctcagtctgagagatggggagcagtggctggactttacagacctgacctgtaccagctccacccactctttcttataagtggggaaactgaggctcagagagtggtagtgatgggaatggctcacacagcacacaaagcctgaccaggttctagctctctttttgaagggggagacaaaagcttctctcttggggccaggtgaggtggctcatgcctgtaatcccagcattttgggaggctgaagtgggcggatcacttgaggtcaggagttcaagaccagcctggccaacatggtgaaaccccaactctactagaaaattcaaaaattagccaggcatggtggtgtgcattatagtcccagctacttgggaggctaaggcaggaggattgcttgaacccgggaggcggaggctgcagtaagctgagatcccaccactgccctccagcctgggcaacagagtgaagctctgtctcaaaaaaaaaaaaaaaaaaaaaaaaaaagcttccctcttgggagcttctccaacttcttccctgaactgagctggttgtcagggctgcagtgggggtgcatgccctacacatgctacccttacatctgcctcacatcccatgcccactcctgacctgtttgtcttggccaggcaccgagattgccatcatcctggatggctcaggaagcattgatcccccagactttcagagagccaaagacttcatctccaacatgatgaggaacttctatgaaaagtgttttgaggtgggcttccctaagagctggttaacacttatctattgctgagaatcaccctacctcagaacaacaatcaccacatttgctcacaattctatgggtcacatacttgggctgggctcagctggatgattcttctgtccatcttgcctggagttaccctggagctgcaggcgtctggttgcttgactggggctggatggcctaagatgacctcacttacttgtctggaccatgtgtctttagcaggccagcccaactttttcgtggcagcaacattctaagagggccagatccaatgcatgcaagtatttttcaagtctctaattacatcacatttgctgatgtcttattggccaaagccagtcacatgaccaatcccatcgtcagtatggagggcactacacagggagctggggagaagtctgtgattcactgggggcctttactatcgcacccttctccacccctactcgcttagagattttgctctgccttagcatctctttctgcccagggataaggtagaaggagtggatttttctgctgcttccagcgggagacatttcaggggcagaggtggcaattcttccaacctcctgccctcctgcccatcccctgcagtgcaactttgccttggtgcagtatggaggagtgatccagactgagtttgaccttcgggacagccaggatgtgatggcctccctcgccagagtccagaacatcactcaagtggggagtgtcaccaagactgcctcagccatgcaacacgtcttgtgagtgtgggggctgcaggaattattctggccatgcccagagtctctgtggcatcactcatggaggaagtggctggccagaaccgcaggagaagagaattagggctccagcctttccctggccgagagagaacgtgagggatgacacctcaaggctgtcctccaaaaagtcttccaaagacttcctcttgtgagatgcaggagagcagagtgctcagtggacaggctggctgggttcaaatctcagctctggttttttttttttgttttttttttttgagatggagtcttgctctgtcacccaggctggagtgcagtggcacgatctcagctcactgcaagctccgcctcccaggttcacaccattctcctgcctcagcctcccgagtagctgggactacaggcggccaccaccacgcccagttaattttttatatttctaatagaggtggggtttcaccatgttagccaggatggtctcgatctcctgacctcgtgatccgcccgcctcggcctcccaaagtgctgggattacaggcgtgagccaccgcgcccggcctcagctctggtttgtatctgtgtgaccccgggcaaactgaaggaccttgtgacctgtgcttcagtttcctcactttaaaaatgagaaaaataggctgagcgtggtagctcatgcttgtaatcccagcactttgggaggccaacacaggtggatcacctgaggtcaggagttcaagaccagcctggccaacatggtgaaaccccgtctctactcaaaatacaaagttagctgggtgtggtggcaggtgcctgtaatcccagctactcgggaggctgaggcagggagaattgcttgaactcgggaggcagaggttgcagtgagctgagatcgtgctattgcactccagcctgggtgacagagcgagactccatctatctcaataataataataataaaaataaataaataaaatgagaataataatagtactcacagcttggagcagtggcttgtgcctatagttccagctactcaggaagctgaggcaggaggattgcttgagcccagaagttcaaggatgcagtgagccatgatcacaccactgcactccagcctgggtgacagagtgagacgccgtctctaaaaaagaaagaaaaataatagcacttgcctgatagattttgtgacggttggatggcttaaaatatacagtgtttacaacagtgcctggcacatgataagtgccatgtgagtattatctatcgttttaatatcatgagtcttcctgtacgcacacaagaggaatggactgccaggcagtaccttcctgctgggagcaggtgagaagcaagaacacctgtgttgcagccctccctctgcccagcctcgctgcgtgacttaagggggcatcacccccttctctgggtctttcgggaggattgtgaaccctcccaattctaatacaggtcagagaataaagtctctcctggagctcggtcatccttctggcaaagctctcttcttcatttactctcccctgcttagagacagcatcttcacctcaagccacggctccaggagaaaggcatccaaggtcatggtggtgctcaccgatggtggcatattcgaggaccccctcaaccttacgacagtcatcaactcccccaaaatgcagggtgttgagcgctttgccattggggtaagagccaggagccgggagacacctcctgaacctgcacagcctggggtggggagaagccagggttgtcgatgggggcttttctgtaagcagcttatccagaccctgttctatttgcaaatgctcctcttctcttcatgctctgtcatcccagagagggctcatttccccatggtggtcacagcttactggccaaatagtggtgggagagccacaggaaacacaccaaggagggttcctggaggaccgtggtgccaagctgagtcctgccagacaaatgggagtagctggcctagggcacaggggaggcagagaggggccctgcaggcagagggaacagcatgtgcagaggtgaggaggagcttggtgtattcaggagaacaggtgtactttggtaaaactggaattttgcccagagtatgggtagaacagggagcagggaaaggaggagaaaggaaggaaggagacaggtaatggagggccccagaggccagatggaggggctcagctctctccctgggcctggggaatccacgcagcgctgactcgctgacccaggctgtctgtgcaggtgggagaagaatttaagagtgctaggactgcgagggaactgaacctgatcgcctcagacccggatgagacccatgctttcaaggtgaccaactacatggcgctggatgggctgctgagcaaactgcggtacaacatcatcagcatggaaggtgagggctccgggacccaggccaccgcaggaggcccgagcctatgctccagcccggcctctgtcccatcttcatgtggtttctctgagcaactcccatcatctccctgaacctcagctcttccatgtctaaaaaggcaatggccgggtgtggtggctcatgcctgttatcccaacactttgggagacagaggcaggtggattgcttgaggccaggagtttgagacccgcctgggcaacatggcaaaaccccatctctactaaaacaaaaagtagctggggccaggtgtggtggctcacgcccataatcccaacactctgggaggccaaggccggtggatcacctgaggtctggagttcaagaccagcctggccaacatggtgaaatcctgtttctactaaaaatacaaaaaaatgtagccaggcgtggtggtgcatgcctgtgatcccagctactcaggagcccgagacagaagaatcactcgaacccaggaggcagaggttgcagtgagccaagatcgcgccactgcactccaggatgggtgacagagcgaggctccatctcaaaaaaaaaaaaaaaaaaattagccaggcgtggtggcgcatgacctctattcccagctacttgggaagctaaggcaccaggtcacttgaccttgggaggcacaagttgcagtgagctgatattgagccatggcactccagcctgagcaacagagtgagacactgtctcaaaaaaaaaaaaaaaaaaaaaaaaaaggcaacaatatccccaggcctccttgcgtcccagaatctccatgaagctctgatgaactgagctggtgctggagaaacaaggatggctggggcatagtcccttctcccaggagctcacagacgaggaaactgaggcctagaaagagtgaactgcccagatagtagttgctcaaggagaacctgggtctctaccctcagccgggttctcttcctgttacaccaagcatggttccttctgggagtgaggccaagctggactgtcccctgactcagtttctcccttcacctcggcccacagcagtctcactgggcttcttggcttgcaggcacggttggagacgcccttcactaccagctggcacagattggcttcagtgctcagatcctggatgaggtacgtggctgactcagcaccaggcaggcttgcccattggtgaggggcccaggacacctaggattcagggactcctgcctcccatccagggctctgccctacctgtggtgattcctgtaaaagagcgattttattttaattaattaatttatttatttattttgagacggagtcttgctctgtcgcccagtctggagtgcagcggtgcaatctcggctcactgcaacaaaagggtggccatattgatgacaggaggtcgcttttttctgtgtgctcaaacatccagttgttcccctgaatacagaccaggcaacaggactcggcctgggtcagcttatcaaccaagctgcttgcttctcccggaggagggagtgcaagggcacgaggcaggagcccagtgttggccatctcaccttcccgcctgcatctctggccaggcgggcactagaccaccgaacgcccccctgctcccagccaggttagccgcgctggcccggagacccgcggccaccgtggcccggccttgggtccctcccactcatctgggccccatccccgtccccttcagcggcaggtgctgctcggcgccgtcggggcctttgactggtccggaggggcgttgctctacgacacacgcagccgccggggccgcttcctgaaccagacagcggcggcggcggcagacgcggaggctgcgcagtacagctacctgggtgagggcggggccacctgatgagggcggggccacctgatgagggcggggccacctgatgagggcggggcctggaggctccctgggcgagggtggggcctgagggctacgtgggcgagggcggggcctacctgggcgagggtggggcctgggggctacctgggtgagggcggggcctggaggctacctgggcgagggtggggcctgggggctacctgggtgagggcggggcatggaggccacgtgggcgagggtggggcctgggggctacctgggagagggcggggcctggaagttacgtgaggagggtggggcctggagaccacctgggtgagggcggggcctagaggccacctgggcgagggcggggccgagatggggacaccgaggctgcgcattaggctgcacttgaggtttccggatgggggcgggacctggtcagtcacatgggccgaggggcgggtcctggttagggaccctgaggctgagtactacagcctcctgggtaggtacaaggcctgtcaggtacaccaggcacagcagccacccaggggagggcggggcctctccattaataatagtggtgcagtagctcacgcctgtaatcccaggaggccgatgcgggcggatcatctgaggtctggagaccagcccggccaacatggcaaaaccctgtctctactaaaaatacaaaaattagctaggcgtggtggcggatgcctgtagtcccacgtactcggaaggctgaggcacaagaatcgcttgaacccgggagggggaggttgcaatgagccaagactgtgccactgcactccagcgtgggcgacagactgagactctgtctcaaaaataaataaataaataaataaaaataataatagtggtgggcgtcctctcacccctcttctccgtcctcctagggtgtgtgtgggagcgtgggtagtgaatgtgtgcgaacgagtatttcgagcaaagctgcatacgtgacagacagcgtgtgcatcatatctgtgtgatggggatgtgtgtgactggcaaagtgagagtgctcgctgatgccgatttttaacatagtgagaaagacagtctctcctattttgcccccctccccaggccactttgaaggcctgactgggaaggtgccggggccaagagagaggccaggtgggagcacacggtgtgttcacagccacaccacccttgccccaggttacgctgtggccgtgctgcacaagacctgcagcctctcctacgtcgcgggggctccacggtacaaacatcatggggccgtgtttgagctccagaaggagggcagagaggccagcttcctgccagtgctggagggagagcaggtacctgctggggaaagcctccaccccttatgaccgatggggaatctggaggcccccaagggaaaggagtgggtcccacggtgcacagtgggccagggcccgggctgggtgaaactcaggctcctgagtggagctcgagggctctgcttcagctctgcatgtctgattgctaggcagtttcctccgctgtggggcctgggctgctcctccactcttctgttactctcagtgagcaaattgatatgtaacgacccaaattgggtggtccaggaagcacgcgggcaggggtgtagccttgctgaggggtgcaggagcggggctcctggtgagctgagttcctcccgggctgtagatggggtcctattttggctctgagctgtgccctgtggacattgacatggatggaagcacggacttcttgctggtggctgctccattttaccacgttcatggagaagaaggcagagtctacgtgtaccgtctcagcgagcaggtgggagagtctccatcttcatgagcttgctgaggctgtggcactcagcctgacacagaggtgatggaggctgggagtgccctggccctgcctggcaccagtgggcagtgatggggaggtgctcaggctggatggcggctgggcggggcagcggcatcgctctccgcacccactttcttacccaagggtgatcgttgatgataatatctctaatatccctttttttgtggttgttgtttttgagatggagttttgctctcgttgcccaggctgcaatgcaatggcaggatcttggctcaccgcaacctctgcctccggggttcaagcaattctcctgcctcagcctaccaagtagctgggattacaggcatgggccacacacccggctaattttgtatttttggtagagacagggtttctccatgttggtcaggctggtcttgaactcccgacctcaggtgatccacccacctcggcctcccaaagtgttgggattacaggcgtaagccacctcgcccagcatttttttttttttttccgagactgagtctcactctgttgtccaggctggagtgcaatggtgcaatctcaacttactgcaacctctacctcctgggttgattctcctgcctcagcctcccaagtagctgggattacaggcatgtgccactacacccggctaatttttgtaattttagtagagatggggttccgccatgttaaccaggctggtctcgaactcctgacctcaggtgatccacctaccttggcctcccaaagtgatgagattatgggcgtgagtcaccgcgcccagctgataacatctcttacagctgcatggttggcaaagcccgtttagtccaggatctcacttgtttctcatagtaactatgggaggtagctgccactctcatcttacgggtgaggaagctggggctcggcgagcctcagtgatgccgagacttgctcaagtgtacctggcatgtgtgtggcagagccacgagtgaaacccaggcctcccatttgcagcaatgcacccctgcccatggaactagaggggggcgggctctgactcctgaacttccaggtaggaggaccccagctttcccctggtgctcactgtatggccttgggaaggtccctggccagtgagcgtgcatcctgggtggcaacggagtgggcacccaccagcccagcgagcgtgcatcctgggtggcaacggagtgggcacccaccggcccagtgagcgtgcatcctgggtggcaatggagtgggaacccaccggcccagcgagcgtgcatcctgggtggcaatggagtgggcacccaccggcccagtgagcgtgcatcggggtggcaatggagtgggcacctagcaccccttcttgagggctgagctgtttgtttgctttacaggatggttctttctccttggcacgcatactgagtgggcaccccgggttcaccaatgcccgctttggctttgccatggcggctatgggggatctcagtcaggataagctcacagatgtggccatcggggcccccctggaaggttttggggcagatgatggtgccagcttcggcagtgtgtatatctacaatggacactgggacggcctctccgccagcccctcgcaggtgacccatggggccctctccttcctctcctctggggctctgacctctctcagatatgatgacccaagccccaagtcggcttcagtcctaagtgctgggcaggtctcgggggttgggaatgcccagtgaaagaaagaagtcccccaggctagggggagcttccagaccagggcctcacctcagccccttcaggttggggggaggttccagaccagggcttcacctcggccccttcaggttcgggggaggttgtggcggtacctgtctccttccctggcctataccccctccttccacccacctgcctcgggtccctgcttcctctctttctgtccctcgctcctgtctcccacccagcacctccgcgccttatctctcattccccagggctcccttgccagcctctcacactgcatgtattaacaggcacttccacccacctccagctcctcatgagcacctccacctggatggcccccaggcatctcactcccacacggcccatctgagagcacctgcttcccctagaactgatgctcctctgagacctcatccccctccacaccccacaccggaaacctcagacagtcctcagcacgctcacagcctgcacagcctgtcagttcccacgtcctcatgattctagctgtctcccaactccagccccttctctctatccccacccctgcggtcccagctcaggccttgccatcccactcccagcccacccagcttcctcctcctctccatcttccaccccatgtcttcagtgccatttctaaagtgttatcctgattatgtcacttcaaaacaacagaacctttgttgacaccccccatccccaagccccacatcaagcctccttgtaccccaatcccctgtggtccaccccgtccctggccctggctgcttctcagaaggccctgctctttccccatgcctcactctttcccttactctcccctgtcaagtcccacctgccctacgaggctccatccaaatgccacttcctctgggaaagcttgctccctctttcctggttctagactcggggctccctggggctggatggtgcctgcgatgctgatcgggatagatcatgaaaggactccccgccccgtttccctcccttccctcgccccacgccttgtgtttctgcctccacagcggatcagagcctccacggtggccccaggactccagtacttcggcatgtccatggctggtggctttgatattagtggcgacggccttgccgacatcaccgtgggcactctgggccaggcggttgtgttccggtagggttctgtcctgctttctggggtcccaggcccagcctcacccatttgccctgctctaaatagctccatgcagacattaggcactgagggagggagccagcaccgtggttgtgggcacaggctctggagtctgcccgtctgggtttgaacctcagctctcagccctctcagcctttgggcaggttatttaactctaagaccttacctaggaattataagagcacctacctcccagagctatgaggatcatgcaagcgaatatatacaaagtatttagcacagtgctcagcgatggctgtgattgcagagttttttgttttttgttttttttctgaggcggagtcttcctcttttgcccaggctggagtgcagtggtgtaatcttggttcactgcaacctccgcctcccaggttcaagcaattcttctgcctcagcctcctgaggagctgggattacaggtgtctgccaccacgcccggctaatttttgtatttttagtagagacagggtttcaccatgttggccaggctggtcttgaactcctgacctcgtgatccacccatcttggcttcccaaagtgctgggattacaggcatgagccactatgcctggccaagaattgcagagtttttgtgccccatccctcagtgaatgatcaagtcccgtggctgtaaatgagctcatggagcgcccgtctgtcccgtcctctccaagctgcagacttgctgtctacccagcacctccctgagctgctgctcacagtcatcccgaagtgaacacgtctaaaaacagagcttttgctgggcgcagtggctcacacctgtaatcccagcactttgggaggcccaggcgggtggatcacaaggtcaggagatggagaccatcctggctaacacggtgaaacctcatctctactaaaaatacaaaaaattagccgggcatggtggcgggcgcctatagtcccagcgactcgggaggctgaggcaggagaatggtgaacccgggaggcggagcttgcagtgagcggagatcgcgccactgcactccagcctgggcgacagagcgagactccgtctccaaaaaaaaaaaaagaaaaacagagcttttatctccccccacccttcattcccccaaatctatcctgccctcaggctttctgtctcagcaaatggcatcatcatccacccagcaattcaggatgaaaacgtaggcgtcatctttgatgcctcttttccttcctctccaccacatcaacaagtcttagttggctctgcctccagaccagtgcaggcactgtcttcactccctggacactgctgccacagcctttcctgcttccagcccctgcgctccattctccacacagcagcagccctatcccttcactctgctgcctgaaactcctccacggctcctatttagagtaaaatcccaattcctcaccatggctttacagggctcttcgtggcctggcccttcccgcccctccattcccatctcctcctcccatcctctgtctcactaattagattccaggcatgctgacctttgtgctcctcaaacaaaccaaaagtgttcctgccacaggcccttggcactggctgtgctttcttcctggagtgctcttccccagatcctcacacagctggctctttcttgttaacaaatctcaaccgaaatgcctcctcatcagccacgccatctgtgaccacccagtctcagtagccctcggtccttattaccgtatttttgttgttgttgttgagatggagtcttgctctgtcacccaggctggagtgccgtggcaggatgtcggctcactgcaacctccgcctcccaggtttaagcaattctcctgcctcagcctcccaagtaggtgggattacaggcgcccgccaccacacccagctaatttttgagttttttagtagagacgatgtttcaccaagttggccaggctggtctcgaacccctgacctcaggtgatcctcccgcctcggcctcccaagtgctgggattacaggcgtgagccaccgcactcggccaacagtattttaatttttctcatagccttgccaatacatagtatctccctgtttctctcgtttatttgcttgttgtctgctttcccaccaaagcagaaacttgtctctttccccactgtaccctgagactcagggatcacctggatgtgggcatgtttgatagagaaccattgaatgcatgaaccaatcagccaggccctgacccagaggctgagcagtcacttctcccatcctctttgctgtcttgtttagctcccggcctgtggttcgcctgaaggtctccatggccttcacccccagcgcactgcccatcggcttcaacggcgtcgtgaatgtccgtttatgttttgaaatcagctctgtaaccacagcctctgagtcaggtaaaaaaatggtccagctgacccctgcctggtgtgatggtctttcctttttggcttctgtaaggggcagggaaagaggactggggcggggggtgggtgggtgttggtctgaggtcctggtgcttgaaatccctcgattagagcttagctccttagtctccaggtttgttaaatgcaaactgcctcaagaaagggtggtctgaggttatgtccacactcagaaggggtttagagctgacactgttgggaagagggacactggggcccttcctcagggttgaagggttgagtttctgaaaaaaaagactcagaaggccgggcgcggtggctcacgcctgtaatcccagcactttgggaggccaaggcgggcagatcacgcggtcaggagatcgagaccatcctgcctaacatggtgaaacaccgtctctactaaaaatacaaaaaattagccgggcaggtgcctgtaatcccagctactcgggaggctgaggcaggagaatagcatgaacccaggagacggagcttgcagtgagctgagatcgcaccactgcactccacgctgggcgacagagcgagactccgtctcagaaaaaaaaaaaagactcagaaaaaggcagccatttctccatgcccacgtgtgtgcgtgtgtgcgggggcttctgagacacaccctcctctttctctctgacttgtgtcttctccccttccctcctcactatgtgcctccggcccaggtgggattggatcacctgttggaggcctggtttctctttccttacctgaaactcattaggagactgttcccagaaaggaggtggtgggcatggctttcacagcccaggtatttactgctcatccaagagctcccccctggaacgattcctcagcaacagtccccgaggtttaatctctcaggagcaatctctgagatggtctctgcctcccacagtcagagagcagtctcctggggtggggtggctttcccaaagcagcaggctattatccacctggggattgaaaatgacagacctggccgggtgtggtagctcacgcctgtaatcccagcactttgggaggccgaggtgggcagatcacgaggtcaggagatcgagaccatcctggctaacacggtgaaaccccgtctctactaaaaatacaaaaattagccaggtgtggtgacagatgcctgtagtcccagcactttgggaggccgaggcgggtggatcacaaggtcaggagatcgagaccatcctggctaacatggtgaaacgccgtctccactaaacaaaatacaaaaaattagccaggtgtggtggcgggcgcctgtagtcccagctacgggggaggctgaggcaggagaatggtgtgaacccgggaggcggagcttgcagtgagccaagatcgcgccgctgcactccagcctgggtgacagcgagactctgtctcaaaggaaaaaaaaaaagaaaaaagaaaaaaaaaagaaaataacagacctgtcccttccaggacacagagctcgatgggctgtgcgatgctgggcaagtgtctctccctagctgagctggttctgttctgtacagtaagagaggcggccccgggatctccacggtgcttccagctgtgccgtcctggggtttttctcctcagagtccctctttccctctccattctctttgttgtctctcttcctccttattttcttcttcaatctcgatccccttcccgagccctccttccctaaagaaggctgactcagtcctgggaatgtgctgctccgggtttggggcgggagcactcagagaccctggtcaggtgtcagaagacggtgagaaaaatatctttgaaaaaccgacgcaggagtccagccgcagggaagtacctgcatggggacactgttcaggaggggccacaaggaacctcaggcaggctgggggccttctgtctgcggctggctcatccccacctcatcgggaaggtctggtcttcattcccaggcctccgtgaggcacttctcaacttcacgctggatgtggatgtggggaagcagaggagacggctgcagtgttcagacgtaagaagctgtctgggctgcctgagggagtggagcagcggatcccagctttgtgaggacctcctgctcatgcccacagagggagaggtaagtgacggagtttggatgggagtcaggaggggtctttgtcattgagaaaggatttgaggtgatgcagtgaagggcacatacccagacctacaaatgaggtgattaaaataatcataacaggccaggcacggtggctcacgcctgtcatcccagcactttgggaggccaaggcggggggatcacttgaggtcaggagttcgagaccagccgggccaacacggtgaaaccctgtctccactaaaaacacaaaaattagccgggcgtggtggcgggtgcctgtaatcccagctactcgggaggctgaggcaggagaatcgctggaatccaggggagggaggttgcagtgagccgaaatcatgccactgtactccagcctggccaacaagagcaagactccatctcaaaataataataataataaatcaagaaccacgtaatggcacggaagatggagatgctgtcattgctgacgtttttcttggtaataactcaggaatgccagtgttcttggcatgcgttatcagacctcacctgataataactaggaccgagggcctgaatgtcagttggcatcaaaaaagtgaacaactaaaaggaagaataaaaagatagaaacgaccatctagaaaggtttactcctggcaaaggtgcccagagacatggggtaaaaaaagtatgtcgggactcaaaccctgacaggatctcgaactttggatctatatggatcgtttattccaataaacaaatgcatgaattcttcttctgaatacacatttacccccaaagtgattgttaattggattaaagtctacagccttccttaaataaaggcttaatcacattctctaccagagaatcatgctcactttctcccatgggcttgaggctcttataggggcagaaaggcttatttaaacaaagagagtggcaaatggtatgctaagcaatctccttatcttctctcttacctctctaatatgtcctccatgttgctttgagaaagatcttggttggttgggcgcagtggctcacgcctctaatcccagcactttgggaggccgaggtgggaggatcacctgaagtcaggagttcgagaccggcctgaccaatgtggtaaaaccctgtctctactaaaaaaaaatacaaaaattagccaggcgtggtggcatgcacctgtagtcccagctacttgggagactgaggcaggagaaccttgaacctaagaggcagaggttgcagagagccaagatcgagccactgcactccagcctgggcgacagaacgagactccatctcaaaaaaaaaaaaaaaaaagagagagaaagaacttgataaacccaggtgtggctgtgactcttcccttctgtctgagccagttctttacccctttgtgactgggataagaaccatagcagctatagacacaaaaccgtagtagaatgaaggagatttttcccaaagcacttggcagcttgcttgaaggacgtgtcccttcagcctggcttatttggaagatgcttaggacttctgactcaccacttttattgtttatttcttcttatgatgacatcaaagtagaaagtattcttgcaaggtgcagtggctcatatttggaaatcccagcactttgggaggccaaggtgggtgaattgcttgagcccaggtggttgaggctgcagtgagccatcatggtgctgctgccctccagactgggtgacagagtgagtgagaccttatcttaaaaaaaaaaaaaaagaaaagaggccgggcgcggtggcttacgcctataatcccagcattttgggaggctgaggcgggtggatcacttgaggtcaggagttcgagaccagcctgaccaacatggcgaaaccctgtctctactaaaaatacaaaaattagccaggcgtggtagcacacacctgtcatcccagctactcgggcggctgaggtaggagaatcgcttgaacccgggaggcggaggttgcagtgagccgagatcacgccactgcactccagcctgggcaacagagcaagactccatctcaaaaaaaaaaaaaaagaaaaaaagaaaaagaaaaaaaaagcattattgttgtcatcttctcccccacatccaactctaaccctgccttccgtggtgaccccacagctctgtgaggaggactgcttctccaatgccagtgtcaaagtcagctaccagctccagacccctgagggacagacggaccatccccagcccatcctggaccgctacactgagccctttgccatcttccaggtgactctacccacagccagtacccagccctcttaagagcctatcccacagaaaccacctgctcccctaacttccaagaatggtggagttgggaggcaatgtcttcagacggcatttgggcccctcaccgtactcatggtgaaactgagtccctgagatggtgttaatgtgtccccgtgagtgaggactcatgggtaacgcaggtctccatctgcccctggggcttgttcctttatgtctttatgttcacaaaagcacttgctacatctttcatgaggcacatgcatacattgcatcctggggacctcacttggcaagcggctctgatgacgctgtgatgggggttccttgtgggagctagactggagctgtcgtgtcttgcactgcagagaggatgccctttggcacacctgcctgttcatgccctgccagggccttcaggctgaatggccccaccaaacctgtatcctagcctctcctcctggtgcccatcagtgcagcttagacaggcgggtagtgtcataagaaacttttgtcagccgggcgccctggctgatgcctgtaatcccaacactttgggaggttgaggcaggtggatcacctgaggtcaggagttcgataccagcctggccaagatggtgaaaccctgtctctactaaaaatacaaaaattggccgggtgtggtggcatgggcctgtagtcccagctactagggaggctgaggcaggagaatcatttgaatcctttgcccaggaggcagaggttccagtgagccaaggccgtgccattgcactccagcctaggcaacagagcgagactccatctcaaaaaaataaaaaataaaataaattttaaaaaatacaaagattagcccagtgtggtggtgcatgcctgtagttccagctactcaggaggctgaggcaggagaattgcttgaccccgggagacagtggttgcagtgaaccgagatcgtgccactgcactccagcctgagtgacagagaaagactccgtctcaaaaaaaaaaaaaaaaaccacaaaccttcaatatatatttcctaaaaacaaaggcattgtcttaacatagtacaataatcaaaatcaggaaattcacattgataaaatactattatctaatttacaaactttattcaaattttgccagttgtcctattaatgtcctttatagcaaaagaaaaaaaaggttctggtccaggatcattcatagcgttctacagttatttatctttagtctcctttaatctggaagggtttctcactcagtcttcccttgtcttttaatgacattaacatttttgaagggtacaggccagtccttttgtagaatgttcctcaatttgtctgatatttcttcataattagattcaggttatacatttttgttttgtttttgagacagagtttcgcccttgttgcccaggctggagtgcaatggcgtgatctcggctcactgcaacctctgcctcccaagttcaagcaattctcctgcctcagcctcccgagtagctgggattacaggcatgtatcaccatgctcggctaatttttgtacttttagtagagacggggtttcactatgttggccaggctggtcttgaacacctgacctcaggtgatctaccctcctcggcctcccaaagtgctgggattacagacgtgagccaccatgcctggccaggttatgcatttttgtcaggaatatcacagaagtaaagtgtgtccttctcagtacaccatctcaggaggcacctaatgtggacttgtccattcctagtgctgtttgcctgtgtcattaataagcacgtctcattttatggtgagatgccttgcgattgtatcctgcttaacatctctttatgtgtctttccttaaccagtgatgactattatgctatggcaaagagatttttaaaaagttattccccgtataaaatgggtgaggaaaaaaccacgtggtattaggcacatcggtgttaccagagagtgcgttctggctgggagtttagatggcttaaccccattctctttcactggggctgggtggaagagatcaggctatgtggctatattaaaaatacaacaaaaggccgggcgcgggggctcacgcctgtaatcccagcactttgggaggccgaggctggcggatcatgaggtcaggagatcgagaccatcctggctaacacagtgaaaccccgtctctactaaaaatacaaaaaaaaaaaaaaaattagctgggcgtggtggcgggcagctgtagtcccagctactcgggagtctgaggcaggagaatggcgtgaacccgggaggcggagcttgcagtgagcggagattgcgccactgcactccagcctgggcgacagagcgagactccgtctcaaaaaaaaaaaaaaaaaaaaaaaatacaacaaaaaaccctgcatgaaactgttgacccacttagagagagcgccacgctttgacttctgcaaatggcatcccccttccgcaggaagtagaaagttccctttcaagccctgggctgtcattccccctctaggccgtgggaacagacctgcagacagctgccgaggtggccaccgggagagaagtgcgaagtgcagaggctctccagccgaggagctggctgccttccttcataatacaaaaacagacccagctactttagaacactggaatttttaaaaacacgaactggagcttttcaacctccatggggccttttgaaatgtggctttcagaattagtcgattatgtgtaggcaagggaaatagttagcttacagagacgactagccaggccgggcgcagtggctcacacctgtaatcccaacactttggaaggccaaggtgggtggatgacctgaggtcaggagtttgagaccaacctggtcaacatggcgaaaccctttctctaataaaaatacaaagttagccaggcgtggtggcacatgcctgtaatcccagctacttgggaggctgaggcaggagaatcgcttgaatccgggaggcagagatggcagtgagccgagatcgcgccattgcactccagcctggatgacagagcgagactccatctgaaaacaaacaaacaaacaaccgaaaaaacagatgactagccatgaggaaggaacctccaaggcctggaccttgacgatatttggctaggcatcccccactcctgcccgggctgttctgcctatatccgaaaggactaaggaagcttctcttcgcgtaggtgtctgctccctgaatgctcaaagtcgtgagctgtgtgttgctgctgaattcgcatgatgtaaatgtcatgggcacccctaacattccgtgaaggtcaccccagtttttaccttggtcaaaggactgggtcacagtgtgcccatgttataggacagatccaggaatgtcacccaggaatgtcacagtccctgctcttcggggacaatcccagcctgcacccctcacctccctgtaactgcacttctcagggtgagcaggaggcacagcccaaaacttcctataaggagaagagccggaggcagggctgctggggaaggcggagcctgggctgatcgggactctctgtctggttacagctgccctatgagaaggcctgcaagaataagctgttttgtgtcgcagaattacagttggccaccaccgtctctcagtgagttggacatagccgtcagtttcctcgattaaccttctcccgaacgcttgcctgggcaattccttcattaggacaccctgcacatccccttcccctctccccgtggcccacaaatggcttctgcacttattatctcaatatgtcctcagctaccccagaagggaggcaagacagagatctgtcttcccactttctagattaggaagcagactcagtcgccgagggccctgcataggccatttggtggacttgaacctgggtctcttgacatcccggacaatgctatattcagaacccagcgttcttcacagccaggctgacctctacctcagttagaggtaacctctttcccggcccacctcttggccaaattaactaatcaatcaaatatttctggaccatctactttgtgccaagcactctaggtgctggggatacttctgtgaacaacacagacaaaaatccctgccctcctggtgctcttagggggagaagatggtaagtaggtaaattccatgttgatgagatgaacgttgaagacacagggaaggtgggaaggagtgttgggtggcagctgatgctgaagttttcaatggggtggtcacggagggtgacactttggcacacactggaggaggtaggggaacgagctatgtggatgggtgtctaagggaagagcagctgcaggtaccctgggttggaagcctgcctggtgggtggggggcagggtgaggagctagtggctgcagtggagtggggcggggtgtaatgagggaaggggaggaagggggaagaggccatggggcttcttaagccctcagaagggcttttgctgtgagctgggaagtcagaggagtgacacactcatgcagcttagcaggatccttcttgctgcttagctgagaagagaagcggcacttgctccctttgtaaccactcaggtgagaggcggtgtgggctgggccatgacgggagtaacagtttaaagtgacagctcatacgtagcacgtgctgacagaatggaggcggagggaggaaagagggccacagccccagcatgcggcactgcactgtccaacacaccagccacgcttagctgtttacatgtacatgagttaaaattaatcacaatgaaacattttgttcctcagtcacattagccacacttcaaagactcagtggccgcctgtggctggtggtgttgggcagcgcagataccgcctgtctccatcgctgcagacgttctattggaccacactgaattccagaatgacagtgttgccaagcacatgagtgtgggtttagacatgtagtggtcttagaatgccccccaggccgggcgcggtggctcatgcctgtaatcccagcactttgggaggcagaggtaggcggatcatgaggtcaggagtttgagacaagcctggtcaacatggtaaaaccccgtctctactaaaaatacaaaaattagctgggcatggtggtgggcgcctgtaatcacagctactgggcaggctgaggcaggagaatcgctcaaactcgggaggcggagggtgcagtgagccgagatcgctccactgcactccagcctgggtgacagagcaagactccaaaaacggggagggggggagggtaacaaaacaaaacaaacaagcgtccttggcgactagtgttgtgtatgtattgtgattctgttggccagctggctggagttgccgtatatggggaagaacgcagttccccaagtcctggtcagccctttcatagacatttgcaggaccaattgaagactttcaaatgctctggaatccaggctaacaagcaggcacagctgtttccagcagggaattaattacagccaagaaccaacctcccagccagctactgggggtagtagagatacagcacgcatggcttgccctacatcgccccctagtgtacatagcaagcaaacgcttctctttcaaaaacgctagtgagcctggtcgtcggtgtccagctgtctcagtggtttttgacctgaggacatagatccccaaaagaatctaatgaagactacagacccctctccttagaagatcacatgtgcatacataaattttggcattccgggccctctgagacggtccctaggcctcagattaggcaacgctgttaatattctgatgacactgaggtctcacgcctgagctctaagatgtgtgtccagctgacatgtcagcatctctgctttgttatcctatatgcacctcttgtcatgtccccgattgaacgcatcttcttccacccttgggtcttcctcccatgttacctccctcagtcaatggcaccactcagccaccggcaccactcagccaccggcaccactcagccacctgagctagaaactcagaacttgcccttaactcctctgtcccccctcccctgcctctttttcgtttcatttgctttactgtctctgacttctttccttctccactactgttgtcttttttcttcttcttcttcttttgagacagggtctcactctgtcacccaggcaggagtgcagtggcgcgatcttggctcactgcaacctccgcctcccggcttcaagtgcttctcctgcctcagcctcctgtgtagctgggatcacaggcgcacgtgaccacactcagctaatttttgtatttttagtagagacggggttttaccatgttggccaggctggtcttgaactcttggcctcaagtgatccacctgcctcacctcccaaagtgctgggattacaggcgtgagccaccgtgtccagccatccactactgtttccttatttcaggcatgtatcatctctcgggtggagacagcaggctctgtctctgcttcctgtctctccctccagtcaatccagcctcttctcagctgggataaaaaccaaaccaaaaccaaacaatgggaacaaaacacacctcacattacttcctaggccgggcgtggtggctcacgcctgtaatcccagcactttgggaggccatacttcctagatctgcacatctcatctttggacatttcagatggaaaacagttttctcggtattgctaatatgtttttctgtcaatctcagctactgagagtggttctgcactctgggtccctgtgatacctcagcattctggaggaccctttcacacatccccaggaccctcttttccaggacatgtggacccatgtcttaaaccacagccttttaatgggaagggtctgaatgattttgtgggtaggaagctgaggccaagaaacggggtaggacagtatgtcttatgcacactgttctccagtgcacagcagtgccccataaatattgtggcatggatgaatttgtgtcatagagtacctcacctagggtcacagtgaattggtggtagaaagaggatttgggtacaattctctcaattctttggactactagactccaggcatttaattagccttttatttatttatttatttattttgagacagagtttcactcttgttgcccaggctggagtgcaatagtgtgctcatggctcactgcaacctctgcctcccgggctcaagcaattctcctgcctcagcctcctgaatagctgggattacaagtgcctgcaccacacctggctaattttttttttctttttttgagatggagtctcatgctgtcacccaggctggagtatagtggcgtgatctcagccctctgcaaactccccctaccgggttcaagcaattctctgtctcagcctcccgagtagctgggattacaggcacctgccaccacacccggctactttttgtatttttagtagagacggggtttcaccatcttggccaggctggtcttgaactcctgacctcaggtgatctacccgcctcggcctcccaaagtgttgggatgacaggtaattagcctgtcttggcttctgtttcctcttctataaaatggagagtagctgtactatttcacagggttactatgagggttgagcgtgtgagacgcagtccttggcacatggtaagcactaaataaagggcagctattatcgtcatctcatgcaacaactgagatgggcgtggcagtccagctgtttgcttatgttgagaggaagaatgtctaagctaaacgtattccttaggcaacttatctaagaagttacttaagaaggtgctattctgggctgtgtgcggtggcttacacctgtaatcccagcactgtgggaggccaaggcaggtggatcacttgagcccaggagttcaagacccgcctccacatggcgagaccctgtctctacaaaaaatacaaaaattagctgcacattggccaggctgggtggctcacgcctgtaatcccagcactttgggaggccgaggcaggcggatcacctgaggtcaggagttcgagaccagcctgaccaacgtggagaaaccccgtccctaataaaaatacaaaattagccaggcatggtggcgcgtgcctgtaatcccagctactcaggaggctgagacgggagaattgcttgaacctgggaggtggaggttgcagtgagccgagatcgtgccattgcactccagcctgggcaacaagaacgaaactccgtctcaaaaaaataaaaataagaaaaatattagctgggcatggtggtaaacacctgtagtcccagctactcgggaggctgaggtgggaggatcacttgaacccaggaagtggaggctgcggtgagccgtgatcattgcaccacagcaccacgctctagcctcggtgaatgtcctattgtattgcgttgaggtttttacagatgaaataaactgtaacatttttatctgtaccctgtgcaggcaggagttggtggtgggtctcacaaaggagctgaccctgaacattaacctaactaactccggggaagattcctacatgacaagcatggccttgaattaccccagaaacctgcagttgaagaggatgcaaaaggtgactgtgacggtggctgtggaaacaggtccctcacgcccctccctcgctgcatgcctgcttttctgtggtgaccccctcactggcacccctgcctccagcctcctcctggtccaaccaacagatggttaataactagataaatccccgccagtccagctccatgcctcccgaggcaccatattctgctgcagtaccaccctccctatgtgcggccctttcttcaccagggttctgagagagaagtgagtctaatgccctaagacactgagaaagtaaaaattagcttagactgggaaagtgaaaatctgccctgccattcccaaggctggatacagacacagatactaggaaacagtctgtttcccgaggacaccctgtggctgacaagtatcactgcactgagaaattttattctctaaaatcacagatcagaaaactttgggccgggaacggtggctcacacctgtaatcccagcactttgggaggccgagacgggcggatcacgaggtcaggagatcgagaccatcctggctaacacggtgaaaccccgtctctactaaaaatacaaaaaaaaattagctgggcgcgatggcgggtgcctgtagtcccagctactcgggaggctgaggcaggagaatggcgtgaacccgggaggcggagcttgcagtgagccgagattgcgccactacactccagcctgggccacagagcaagagtctgtctcaaaagaaaaaacaagaaagaaaactttgctgtttgaagtagttacgtcagtaattatgaacccctatccctcttgcctggagagtgtaagtcattttgaccaagagaagagtctgtttccacctgaggtagagagcttcagatacagtgtctgtcaactttctactccatattaatggtttcccaggaagcgggccctgggtctgattcacaggctggcctgctggtgactgactccttgacactcagccctgctttaccatcaaaacaggactttatttacatttcatctgaactccacccttccctggagtcctttaataaccgccttttccattgttcagtgatacacacaatagtgtagtttttggatgggtgcagtggcccatgcctgtaatcccagcactttgggaggccgaggcgggcggatcacctgaggtcaggagttcgagaccagcctggccaacatggcaaaaccccgtctctactaaaaatacaaaaattagccaggtgtggtgatgtacacctgtaatcccagctactcgggaggctgaggcacgagaatcacttgaacccggaggtggagattggagtgagctgagattgcgccactgcactccagcctgggcaacagagcaggactctgtctcaaaaacaaacaaacaaacaaacaaaaccaaagtgtagttttcctcattgcagtgagtcaataaatttgaatttgttggactgtagatttgtccccggtcatcttaggctatttgggctaggacagtatccattatatgaatgaagcaatctcctaggccgggcaccgtggctcacggctgtaatcccatcactttgggaggctgaagtgggtggatcacttgaggtcaggagttcgagaccagcctggctaacatggtgaaaccctgtttctattaaaaatacaaaaaattagccgggcgtggtggtgggcacctataatcccagctacttgggagactgaggcaggagaattgcttgaacccgggaggtggaggttgcagtgagccgagatcgcgccacttcactgcagcttgggcgaaagagtgaaactccatctcaaaaaaatgaaaacaaaagcaaaaaacaatctcctaggcatctagaggggaactagggatggaccgtccctgggagaattaagaaaactcactgcagtcatcacctgcccctcgggggtccaggtggggagccctggtggctacgtggcagtgctggtgtgtgccggccttccagccaggctgtgggttatatttgcatcagtccatggcccagctcaaatgcctccttccccaggaagaccttacgaattcctccgagttggaattcatatttctccactgctgttctctgcagctccctcacagaagcaccccttcgaccttgtatttaaattcctcggggatctactgctgaccctgcctgtccggcttgtgaggaagacagggaccaagtggactttatttctttagctcctggcagggtgtctgacaggcagaaaaattagtgaatgtttgctgaattgctgtgaggaaaccacgtttttgttttgttttgtttggctctttaagagaatgtcatctgctcttttaacagcctccctctccaaacattcagtgtgatgaccctcagccggttgcttctgtcctgatcatgaactgcaggattggtcaccccgtcctcaagaggtcatctgtgagtcggtttggaccgattcgctcttctcaccaccctgcagttggcgtcttctgcatcttggtctcatctcaatctctcggttccagctttgcgcttcgcttgactgcagtgtgtccccagcagtgcttacagtggctaagctggctctgaaagtagggggtgatggggacgagagctttccagtacacagccctaggtgaactgcctgctcacctccgtgaagcagagtgaagttgtgggtagtatggagggcgtgtcagacaaaaagtttttttgtttgtttgtttgttgagatggagtttcattctgtcacccaggctggagtgcagtggcacagtctcagctcactgcaacctccgcctcccgggttcaagtgattctccttcctcagcctcctgagtagctgggattacaggcgtgcagcactacacccggctaatttttaaaatatttttggtagagatggggtttcaccatgttggccaggctggtctcaaactcctgtcctcaagtgatccacctgcctcgacctcccaaagtgctgggatgacaggcatgagccaccatgcccggccaagacgaaaagttattaaccctgatctgtcccttgtcatctctgtgctgtgggaaatctctgaagtggcttcttcacctgtaaaaggggaatgaggccgcctgccttgcttactccatatttgtatttgaggcttaactgaaataacggggccaggcgcggtggctcatgcctgtaatcccagcactttgggagaccgaggtgggtggatcatttgaggtcaggagttcgagaccagcctggccaacatggtgaaaccccgtctctactaagaatacaaaaattagctgggcgtggtggtgcgtgcctgtaatcccagctacttgggaggctgaggcaggagaattgcttgaacctgggaggcagaggttgcagtgagctgagatcacaccattgcactccatcctgggtgacagagcgagactccctctcaaaaaaaaaaaaaaaaaaaaaaaaggaagggaaaggaaacatgctgtgttagaaaaatgtgaggaatgtgaaaatctgaggaatcgtctcctaggtctgttccacgagtagctagcggtctgaattgtgagtggcatagagagaatcaactgaccatttttccccctttaaaataggctcatgtttcagtcgtttggcagctagaggagaatgcctttccaaacaggacagcagacatcactgtgactgtcaccaagtaagtactgcctgggtcacagcagagtcaggctatgaccccggaagacatctccctgccacatgcacgctgtgagaggaacggcccccttacagcccagggagaaaggaaaccccagtgagcccacagaaggcatctgtttccctgcagggactcgactttctcttcttgttaccagagataatgaaaatgttcttttgttcacacacaaagtaaaactgtggtacagcctggtggaatgagccctggagttctggttctcgttcactcagctttggaatagcttgggatagctatgttacctgcaagacctctgtgttggggggtaaggtggggaacgctgctgggaagagttctcaaagggaggtgattctgcccaccagaggctgtgcctgttttgattgccatgacttggggaggggggtgttcagtaggacatctggtgggtagaggccaggaatactgccaaacatcacgcagagcagtacaggacagcccccacaaccaagaactaactggcccaaaacgtcaatagtgtggaggctgagaagcccttttaaaatcagtattcttctaagtgtggtcttctagagacaattctgaactccaattgcttatctctgaaagccttttatttatttatttatttatttattttttatttattttttttttttgagacagtctcgctctgtcgcccaggctggagtgctgtggcgtgatctcggctcactgcaacctctgcctccaggttcaagcagttctctgcctcagcctcccgagtagctgggattacaggcgcccgccaccacgcccagctaatttttgtagttttagtagagatggggtttcaccatcttggccaagctggtcttgaactcctgacctcgtgatccaccagccttggcctcccaaagcactgggattacaggcatgagccactgcgcccagcctctgagagccttttcttatctgactcccagtgaccctggggagccaggtgcagaagcacctgttctgcagtgagagcacatggacacagggaggggaacagcacacactggggcctgtgggaggggcagggttggggagagcttcaggaagaatagctaatgcgtgttgggcttagtaactaggtgctgggttgacagctgcagcaaagcaccatggcacacgttcacctatgtaacaaacctgcacatctgcacatgtaccctggaacttaaaaaaatagccaggcgcagtggctcacgcctgtaatcccagcactttgggaggccaaggcaggcagatcacttgaggtcaggagttcgagaccagcctggccaacatggtgaaaccccatctctactaaaaatacaaaaattaactgggtatggtggctcacgcctgtaattccagctactcaggaggctgaggcatgagaattgcttgaacccggggggcggaggttgcagtgagctgagacagcaacactgcactcctgcctgggcaacagagcgaagccctttttaagaagcacttgctatgtacaaagcaggtgtgctatgaactaacactcttattcctagttccaatgaaagatggtctttggccaacgagacccacacccttcaattcaggcatggcttcgttgcagttctgtccaagtgagtactcccaagaggccagcagcggtgtgactccatcgcccagggggcagctttgggctctctctcgtagatggagctggtggtcaggatgaatgtggacactgtccttctgagaggagcctgcttagaacccaggctctgatattgatctctagggtgctaacatttgggtcacaaaaaccccactgtggtcatcaaaggaggtgtattgccaactagtcgtgctacaaaagggaattaatatgacgctgtggagggaagaaggcagctgtgggactgggaagtaaggaggggatgagtaaggccatttgagggataattagaaaatgaaccagcccaacgatacagaattcaaatattccacctcaccccaactgcgctacgaccactttatattttgacattcagcttttattccttttttttttttttttaaactgagacgaagtctcactctgtcgcccaggctggagtgcagtggtgccatctcggctcactgcaacctctgccgcccaggttcaagcgattctcctgcctcagcctcccgagtagttgagactacaggtggacaccaccaggcccagctaatttttaaaaaatttttaatagagacggggatttcaccatgttggccaggctggtcttgaactcctggcctcaggtgatccgcctgcctcggcctcccaaagtgctgggatgataggcatgaaccactgcacccggcctcattcctggtaaaggtctggtgccctctgtcctaatgtattcagttgaaagcagtcgagttcattcaaaaagagaaggccaggtgcggtggctcacgcctgtcatcccagcactttgggaggctgaggtgggtggatcacctgaggtcaggagttcaagaccagcctggctaacatggcgaaaccccgtctctactgaaaatatgaaaattagccaggtgtggtggcaggcgcctgtaatctcagctacttgggggcttaggcaggagaatcacttaaacccaggaggcagaggttgcagtgagctgagatcgcaccactgcactccagcctgggcaacagagcaagactccagctcaaaaaaaaaaaaaaaaaaaaaaaaaagggatgagtgtagtggctcatgcctgtcatcccaacactttcgcaggctgaggtggaggatcacttgagcctgggaggttgaggctacactgagccatgattgttccactgtgctctagcctgggcaacagagtgagaccctgtctccaaaaaagggagaaagactcctcaagggctgacgcatgtcctgtcaattgcagaccatccataatgtacgtgaacacaggccaggggctttctcaccacaaagaattcctcttccatgtaagtacttattattgtaaagctgtagatggcaaagcaataccagctttgatttcctactctgattttaatttgcaggtacatggggagaacctctttggagcagaataccagttgcaaatttgcgtcccaaccaaattacgaggtctccaggttgtagcagtgaagaagctgacgaggactcaggtatttaaaggcagttctttatcagtcacacctctttccacagtgactacagagtctcaagtataaaaaccagagttctagaaacagagtgaagacaagttaaccatgggaaaagattaggagtaaattcccgaagtcctgttcagaaggactctcaatcactcagctcttaaagcaacctgtcagttttcctccctttgaggaaaaataagcaaaaattggccaggtgcggtggctcacacctgtaatcccagcactttgggaggccgaggcgggtggatcacaaggtcagcagatcgagaccatcctggctaacacggtgaaaccccgtctctactaaaaatacaaaaaattctccgggcgtggtggcgggcgcctgtagtcccagctacttgggaggctgaggcaggagaatggtgtgagcccgggaggcggagcttgcagtgagccgagatcctgccactgcactccagcctgggagacagagtgagactccatctcaaaaaaaaaaaaaagcaaaaattaaaaccttgtcagtagacagagacattttccctttgaaaattgataaattctgcttctctgtgtgagtgatgtaacatgtgacatttcttacactgccccctataagttgcttactagcttcccttcttctcccctgagactcttttttggtctctgctttgcctcagcctctttgctttcagttgtctcatctgtagtctggttcccaaagctagccttgatacctgaagcaacaggctctgctcagtatgaagctgaagcctgggcattttttttttgctcagactacataagtgttaaggctcaaaaaacggaaaggaatttacagaaaggactctgctgacaattagaaagagggcttataggtcaggtgccatggctcactcctgtaatcacccagcactttgggatgccgaggtgggtggatcacaaggtgaggagttcgagaccagcctggccaacatggtgaaacccccatctctactaaaaaaatacaaacaattagccgggcatggtggtgtatgcctgcaatcccagctactcgggaggctgaggtaggagaattgcttgaacccgggaggcggaggttgcagtgagctgagatcgcaccactgcactctagcctgggtgacagagcaagactctgtctcaataaaattaaaaaaaaaaaaaagagggtttataaatataaacgtttgttttcacatgtagtttatttatttaaaaaaatagagacaggggtcttgctatgttgaccaggctagatatgaactcttgggctcaagcgatcctcctgcctcagcctcccgagtagctgggactacaggcgcacgccactgcgcccggctagtttacttctttcagaacatttgttatcagcaaatttaaacatttcaacaaatatttcagtttccatttggaaacaaaattcttgtttgaaaagctgactggaaacctgtgagaatgggagttccaccctcctgtggggatggaggttgaaacagcaccagaggcttcaagaccagtctcctctcatttcggggcagtaagatacatttagcttacttaaacagactgtgctggcagagcaagtcagtggcagagctgaagttcagcattgtcctgtggaactcctggatttttctcttaatttgcttcatggcaggagtgttacatttagtcttgaaggtcatttgtttcagcatcttgtctgtcaggtaatgtaaccagagcacattactataagggtgatattcaccccagcggttgttattctccttcttcatgagcctgtagatgtcaaactggtagtcaccgtcaccggtaaacaggtcctcatccatggaaacgtcacagaaaaccacaatcccatcccgttccaagcgcgacagggtgtagtcaatgatgctcacttgcaacccacagctggggatagtgctgctcttcccattgagggtgtagtggagttttttgaggctggttttctttaagagcacgttcccccagtgtaagtctcggtgctcaaagcgcagtgatgcctctgccactgcgagggaggctgtgagctggtgtagaatgctctttgcagtagccaaggaagacaacttggttcgcatttgctctaagtcaatccctccaaactcaaattccagcacaatgaagagctggtcgtctttaaaaaaatcaggccggtcatttgcagagcctttggttgaattatagtgatcccaggctttgaggagcaagggagggtaagatccctggacacagtgcactgagttcagcccgataaagccttctgtgcggttgcacacttcaccggataagaggctcaactctttggagatgatgatctctggcaggatttcctcaaaggttttctgatgggatccattgactaaatctggtccttcaatagcaatgatttttatggctacgggtgtgtgatcagcaattgtttgaaacacttcgccaaacaccccttccccaatcttctcacagcgttgcagtttttctgtgggaaggcaatggctaaaggggacaggacccttctgactgcattccccataaaccttttcagcatcagatgcctttttgtttgaaatacttagagtgtttaaggggcttagcaaatacatagaggaggagtgccaagaggacggagcaccacttgttctgttcatgacaggccggtttgaacattctgataggagggatccagagagagaagtggcagtggtatagatgctgcagacctctgacacatcagtcacaattttcttcttgtggaaactgaaggaagccctggttttggtccaaaagcaggcattctgtaaaggagtcaggtcctgggtggggaacgaatcttttcccagcttttggccctttttaaagcggtgggaatggaggagagaggtttccgttgcctcctgatgtttgctcttccggcttgatctagttctctccagcctgtctgttccccttggcacaatgcggcccttgggaacactggcctcctgatgctctctccggacggcctcttgaagccctctctcttgacaagagtcctggcctgtggccctcctcttgcctgtgcttgacagacctggaccctctggtccatttcccaccaccagtttccttttacagcaggactctctcatattcttcccatctgcccgaaactcagaatcctcaggggttcctgagttcataaggccaaagagaactgacctgaggctggcgcgggtttggtggaccatcctggtgtccttggctcctcctgtcgcttcctcctgggagcaggggagagatgctcggtccagggagacttctgggaggtggaggtcgctcgggacggctgaggctgcaaccagacaggcggaggtgccgatcgagatgacactgtcccttggcgttggggacccggggcagggcgaggccagagagctgaacagggaggcactgatgcccagctcgtcgccgtccctgggctggccgcacacgctgaggtccgggctgaggcggccggagtcgcggctggggaagggcggaagtcggagcgggccgcagggtgtgctgcacttctgcgggggccgagctcgcagccccaggcgtcttggggtcacggttaggcttgggcgagctcgcagcttccagcgctttggggtcacggtcaggctgggccggtccttgggcactcggccgccgggacacctccgccgccgcctcaccgggctgccggggaagtcggggtcgtcgggatcgtcaggatcgtcggactgcgaggggtcgccgatgctggcgtcgctgctgccgctgctgttgaagaaacgcctccggtcctgcggcgggaaccactgcgcggcttcccggcccggccgccgctgtctcctgccgtccgcagccccatatgtgcggaaaagccggctcccaggtcccgggagcgaagccgccatggccggcacccgccaagaggttcaaacgcaaacatcgcgagacttccgtgcgacgcggacgcgcccgcctgccgcggggtcctagctcccggccctgcgcatgcgcacctcgccagggccggggccgggacgggacggaaaactggcggcttggtttgttcagcgcgtcgcggtcatggctctcgtttcaggcctccacggtgtgcacctggagtcaggagcgcgcttgtgcgtacagttcggttcaggtaagcgcggccgtcccgagaggccaggggagggcggagggcctgaagcgggtaacgagaggccaggagactgtttttcctgggttacccctgccggccagtgccgggggctgccaggccctccctagcttcgtccctgggtctcaattgctcccgctggagcttcgcttgggccgaggtgagcgctgaaattgctcacaccctctattctgggaccttacgatgctctgtgtccgaagtgttaaaaagatttcagactttccgcacggaaaggaattgtgttcactagacctcgcttttccagcatgtggaagaatggcattcagtgagctgtgtcatcgcttcagataaagaaaatgtcaccgtggctgcagagatctcctgggatcactctgaggaggtgtttgagactgaaatgctccagatttgattatccagttgctcacgggcatcgcccctagaagagataatagcatctttgcataacatgtccatgtccaaaatagatcttttggtgcaaaaaaccaaccctctgtcccaacccgttccttagctaccctcaggagggagatatactccagttacagtacaaggaactcgagggattacctgtgactcctctttcctacatccccacgtctattccagcagcaagccctgccatttcagggccaaaatatatcctaaacccattcacttctctccatttccactgccgttgtaattcaagctaccctttcttgccagggctgttgcaataaccttcggcctgcctttcttgcctctgcttttcccacattctttacaaataattcccacgtaacagctatccgtcttctaagagcagacattagattgtgccattcccctgcttattaaaaataacaaacaaacaaaactgatgcttgagcacacttagactaaaatccatacttttttcatggccagagcaaggcagtacttgatctggtctctgcttaattcttcaacttcatctcctagtactcgcctttctctcccactgccccttttataatcgggttattctgtcctattcttctagctcgccagtacagcattattctggccacaagactttgtacttgctgttcctttgcttgacactgctcttcctctaggtcctgacgtaggtggtttcttcttaaatttagctcaggtgttcttttcttttctttttttttttttttagatggagtcttgctctgtcaccctcgctggagtgcagtggcacgatctctactcactgcaacctccgcctcccgggttcaagtgattctcctgcctcagcctcccgagtagctgggattacaggcgccggcgaccacgcccagctaatttttgtatttttagtagagagggggtttcaccatgttggccaagctggtctcgaactcctgacctcaggtgatcgcccgcctcagcctcccaaagtgctgggattacaggcgtgagccaccgcacccgacctaggtgttcttttcttttcttttctttctttcaagacggagtttcgctcttgttgtgcaatggcacgatctcggctcactgcaacctccgcctcccgggttcaagcgattctcctgcctcagcctcccaagtagctgggattacaggtatgcgccaccatacccggctaattttgtatttttagtagagatggggtttctccatgttggtgaggctggtcttgaactcctgacctcaggtgatccgccctccttggcctcccaaagtgctgggattacaggcgtgagccaccacgcccggctaattttgtatttttagtagagatggggtttcatcgtgttggtcaggctggtcttgaactcctgacctcagatgatctacccacctcagcctcccgaagtgctgggattacaggcatgagccaccacacccggccacacgtgttattttcttagagaggccttccctgatcacttattctaaagtgggaactagtgatcaagtgatcaagtttaatgttttacagtgatccaggtgacatttgtgaggtctcaactgaagaagtagcaatgggggtggaaaagaaagggacagatacaagaaataatttaaaaaaaaagaattgtgagtgtggtggctcacatctgtcatcccaacactttgggaggctgaggcgggaggattgcttgaggccaggagttcaagatcagcctgggcagcatagtgaaaccccatttcttaaaaataaataaatacataaattagccacgcatggtggctcatgcctgtagtcccagctacttgggaggctgaggcaggagtatcgtttgagcccaggaatttgaagcttcagtgagctatgattgagccactccattccggcccgggtaacagagtgagaccttgtctcaaaaaaaaaaaaaaaaaaaaaaaaaaaggaaaaatctcttacgttaaataaaatgaataagctgggtgtggtggctcatgcctgtaatctcagcactgtgggaggctaaggtgggtggattgcttgagcccaggagtttgagaccagcctgggcaacatggtaaaaccccatctctacaaaaaatacaaaaattagcccagtgtggtggggtgcacctgtggtctcagctactcaggagactgaggtgggaggatcacttgagcctggaaggttgaggctatagtgacccatgatcatgccattgcactccagcatgggtgacagagcgagatcctgtctcaaaaataagtcagtcagtcaagaactgactttggatggcacaagggaaaagaagttgaagaaaaggccaggcgcggcagctcacgcctgtaatcccagcactttgggaggccgaggtgggtagatcatctgaggtcaggagttcgagacaagcctggccaacatggcaaaaccccatctctactaaaaatacaaaaattagcctggcatggtggcacatgcccataattccagctactcgggaggctaaggcaggagaatcgcttgaacctgacggggtggaggttgcagtgagccgagatcgcaccacttcactccagcctgggcgaaagagcgaaactccatctcaaaaaaaaaaaaaaggaagttgaagaataactgcagatgtcttgtttgggtaactttatgtagtgttgtgtacgttagggccattaactaagcccaggaatacctttaaagggaaaggtggtgaaggctgttcaaacacagtgagttcatgtctaaaatatgttttgtttccctcattcctttccccatcttctagttactaaaagatgtaactgaactgcagatccttggtgaaatatctttcaacaaatctctatatgagggactgaatgcagagaaccacagaactaaggtaattcctggctggcttctgagtagtgcccaaggaaaattgtgcctaacctttgagcacctccacagacattctgttgccctcttcctgttttcagccttaacacttctgatcttggctctgccatcgctgcctttgtgacctttgagtgagtcagcttcttatgaaataaggcaattaagaggcctaagctgaggagttctgagttgaaataactaggctggaatctgcagtatatactttgatttgaaaatggattgattaaaaaaaaaaatttcgcagctgggcgcaggtggctcacgcctgtaatcctagcactttgggaggccgagacaggtggatcacctgaggtcagaagttcaacacaagcctggccaacatggagaaaccctgtctaccaaaaatacaaaaattagccggacatgatggtgggtgcctgtaatcccacctacttgggaggctgaggcacgagaatcgcttgaatctgggaggcagaggttgcagtgagccgagatcacaccactccactccagcctcagtgatagagtgagactcagtctcaaaaaataaataaataaataaaaaatgaattacctaagtgagaaattgttttttgtatccagtaactgtcttagtgtgctgtatcagtgtttagttatagtattaaacagtactcaggaatgcataaatcttttataagatttagactagatactggaactcttggaattctttttgcaaaagtatgactagaagtcagactgatgcctgtgatttgtggactgaatgctttgtgtgttaccctgtgttttcattcttgttgacccttgcctggacatggcttcagaggtgatctatctgtgagctctgagctctttagttaggcatgattctctactagagggaatgtcaggagagtgatgctggattgctaaatataaggtcctctgttttcctccctggaggaggagaaaggagcaattctctagacatgccaatataacatttccttttatttttaagtagtgtatttctttttcttttcttttctttttttttttttttttttttgaggaagaatctcactgtgtcacccaggctggagtccgttggtgccatctcggctcactgcaacctccacctccccagttcaagtgattcttcttcctcagcctcccgagtagctgggattacaggtgcccaccaccatgcctggctaatttatttattttttttaaatagagacaggatttcaccatgttggccaggctggtctcgaacttctgacctcaggtgatctgcccgccttgacctcccaaagtgctgggattacaggcatgagccaccatgtccggctaagtagtgtatttctaatacagaaaatagagggaaatggaaaatacagaaaacggaagaaatagaagtgccccattattgcactgcccagattttaacaaataaaaataatagcaagaaaatccaagccatacagagaatggtaccaaatgaaaaataattgttccttcatttctcccttcccatgcccccagcagggaggagttactattaagtttcttatgtgcacattttaaatttgtatgtttccccctcttacttactgatacttttatttctatagcatggattccccaaaattcctttctttaaatccaatatcctaagcaaagtgttaagtagttcctgacaataagcccctgacttacagtgactctatgagtataaacaaactgtatccaaatgcatttcagccacaagaaagggaaaatccagctcatgcagcataagggcatatgctgtttatccagtgagggaggccggcctggggcgatggcctggcttctttggtccttgtactctgccgtgtgggggacgcattccttcatggccagcacaaagttgccacatctccaaatgctgtattttcacatggcaggatacaaaacaggaagcaagaagtcagtagcaaaaggatgttggatttttcttcatgtgccttcccttttcagggatgaaacagtttccaaaagctcccaggagacatcctcttacatcttattagtgagatctgaatctcatgtcagtcactggcaaaggagaatagctgtgtcatgatcacctgagaccaacgatgattcctgaataaaatccgaaaggagagaggggcccctgggcaggccagcatccgtgtttgctgcaaacagtagtacccggtgccttgcttctcccttaacctctacttgggcatctttggggcacttttgggaatctgtgggtttagaagaagataaagggaggtggctttgagaaatagggacatttcttctactcacatctggcctgtttcccgagtcaccttgggacttcctttcacttcccaaacccagggtcttgagtccccctccttctcctgtagaatattccagccctctttctgttcttcctccctctttgttgctatggtacctccctattctcaaagcctaggacttcactcctatttagttcagctacctatgagctaaataggactggaaggtcaactttaggtcaaccagcatttataacttaattggaagaggccttaaaggtaagtttgtccagcccttcaccccgtacagaaacctctccaaagcacccctgaccttggtgcttaaacatacacgtgaagggttgctctgggcaggcagagaagtcttgttggctctctggccccacctaagtcctgggaacttcctctggccacaacttggaagggccatacctgggtctcaggaaggacatctcctgaactttctagctgagccctgccagaagagagattagactcccgaaattgggagagcctttggaaaacaaaacctgaggatgacttctaatagctgagctctgcaagtagtacacatggatataatttgcatttattatgtcccttaggtaatacacactttttagtctggtgaggggaagaccagtacttttgtcatattttatgtggggaaagtgtattaccaaagcctttagggatctgtgcaagatcaaaaagagccgtcagaacggagttggaaaggacttggagatcatttaaaggaagtcatcattttaaagagcataggcacggggctcagggacatagagcagtgtagcggcgtgacagcctcacagtcctgtgttgagaccggattccgtgggaccctctttcaagctgtcagagcatctttaacagaaggtcataatctcctgacagacctagcccttctagataaggggccagaatagtttcttacgaagtatttgggtgattggatagttttagatgatctaaaatgctgcatcagggaatatctagctttttgctttactgtcatcagctttgatcaatacacgggttgttgccaagtcctcgtattttgctccttaaaataacatgtaggattttttcctcgtttgcttcacctgatttattgggcgatctctttgtcttgtctagatcactgtcgtcttcctgaaagatgagaagtaccattctttgcctatcatcattaaaggcagcgttggtggacttctggtgttgatcgtgattctggtcatcctgttcaaggtcagttctactcatggcatcacagtgagggaagactgggctctagttttgggcacagaactccttaggacagccaacctctgacttagagcagctgccctggcctcgtggccacttttttctcctccttcaactgcacacccccatttagacaaatgagtaaaacagtatctgtctgaaaagagaaaactctgagtaataaagagtgattttatatatatttctttggtacctccctattctcaaggcccagaacttaatactgttatgttcggttacctgtgagttcaatagggcctggaaggtcaaccctaggccagcatttataacttacttggaagaggccttaacggtaaggccttaaaacagatgtgactgttgttcccctgttgaaatcttttccttgccttcccgtcttaatgtgcaaactcttctactgctatttaagatcctctcctctgtccgctacccgtctctgcccttaagtgttgcttttttttctttttttttttgagacggagttccgctctttcgcccaggcttgagtgcggtggtgcgatctcggctcactgcaacctccccgtccccccgccctgaccccgggttcaagagattctcctgcctcagcctcctgagtagctgggattacaggaatgtgccaccatgcctggctaattgttttgtatttttagtagagacggggtttcaccatattggccaggctggtctcaaactcctgaccttgtgatcctcccgcctcggcctcccaaagttctgggattacaggcatgaaccaccactcccagcctcttttttaaaaataaacaccagggtctttgtcccccaagctggagttcagtggcacagttaagggctcactgcagcctcgtactcctaggctcaggtgatcctcccatcttagtctcctgagtaactgggactgttactcaggtgcatgccaccacacccagctaattttttaattttaattttgtggagatgaggtctccctatattgcccaggctggtctcaaactccggggctcgagcgatcttctcatcttggcctcccgaagtggtggggttacaggcataagcacctgaccttgcttttttctcccaacaagtcaaactattccctaaataggttcgtgcctctgcgtacgcgtaggctgcttttcttgtcaggaatgccctccatgactgctcacttcactcactgtcttccctgaaagcggtctagagactcctgagtcctctgtgctggcttctgtgtgtttgctgtgagctcccttctagaaacccttccaaatggcagtcatcacactgtattgtaattatctctttttcctactagatgatgagcttgatgtaggaagctgtacttgatctccttctgtcttcagcatcataggctatactgagtatttttgcataaataagattagatccagtacagccgaaattatcatgctttgcaaaataagttaaaaaggttcaactgctcgggagagcagggttcagaggaaggtggagtcagttctgattgagggatgagcaccagaggtcttgaaggattggactctccaggagagattcagagtaagttaggagaagggagtagtaagtatgagaagcagaggaatataggggctatttaggcaacagccagaatgccggttttctgaaacagatggctatctttggcctgtaactggacttttccttcctttgtttcagtgtggcttttttaaaagaaaatatcaacaactgaacttggagagcatcaggaaggcccagctgaaatcagagaatctgctcgaagaagagaattaggacctgctatccactgggagaggctatcagccagtcctgggacttggagacccagcatcctttgcattactttttccttcaggatgatctagagcagcatggagctgttggtagaatattagtttttaaccatacattgtcccaaaagtgtctgtgcattgtgcaaaaagtaaacttaggaaacatttggtattaaataaatttacacttttctttgcagtagtgcctttaatctggaaatacagtattacttaggatttgcagtacattttgcctgatagggcaagttttcattcttatttttaaaaaatgatagattgtggctgggcatgatggctcacgcctgtaatcccagcactttgagaggctgaggcaggcagatcacgaggtcaagagatcgagacatccatcctggccaacatggtgaaaccccatctctactaaaaatacaaaaattagctgggcatggtggcgggcgcctgtagtcccagctactcaggaggctgaggcaggagaatcatttgaacctgggaggcggaggttgcagtgagccgagatcgtgccactgcactccagcctagcaacagagtgagactccatctcaaaaagaaaaaaacaaaataggcggggtgcggtggctcacgcctgtaatcccagcactctgagaggctgaggcaggtggatcacgaggtcaggagatggagaccatcctggctaacacggtgaaaccccgtctctactaaaaataaaaaaaattagccgggtgcggtggcaggtgcctgtagtcccagctactcgggaggctgaggcaggagaatggcgtgaacctgggaggcagagcttgcagtgagccaagatcacgccattgcactccagcctgggcaaaagagcaagactgtctcaaaaaaaaattatcgattgtatcctttcagataattcttaagtatcaatttttcagatttccagaagaaactctttggggttttaatttaaacatacaggttaagtttgggagcattgatatctttatagatttcctttctactccgcttgctgcgatttattttttattttttattttactttatttttttttttttgagacagagttttgctcttacttcccagactggtgtgcaatggtgtgatcttggctcaccgcaacctccgcctcccaggttcaagcgattctcctgcctcagcctcctgagtaactgggattacaggcatgcaccaccacgcccagataattttgtatttttagtagagatggggtttctccatgttggtcaggctggtctcaaactcctgacttcaggtgatccacctgcctcagcctcccaaagtgctgggattacaggcatgagccaccgcgcctggcaatgctgagatttttaaaaacactctgcagcaaggttttataattttcttcaaaggggtcttaatttataaagacttacttccagctgcatttttatttgtttatttattttgggggggtctcactgtgttgcccaggctggagggcagtgatgcagtcataggttgctgcagccttgaacttttgggttcaagccgtcctctgcctcagcctcctgcgtagctgggactacaggtgcaagccactatgcccggctcattttttaatttttcttttgtagagatgggatctagctatgttgaccaagctgatttcaaactcctggcttcaagtgatcctcctgccttagcctctgaaagtgttggggcgtgagccactgcgcctgacctgttattatgcttttgttgctactgtgtgaaaataccgttttttccccctgactgtttagagtttgcacttagaacagttggtggttttgaatgtttatcttatctggccattttactgaactgtggttttgtttttttggagacggagtctcactctgtcgcccacgctggagtgcagtggtgtgatctctgctcactgcaacctccgcctcccgggttccagcaattctcctgcctcaccctcccgagtagctgggactacagggacccaccaccatgcccagctaatttttgcacttttagtagagatggggtttcaccatgttaggctggtctcgaactcctgacctcaggtgatccacccgcctcaggctcacaaagtgctgggattacaggcgtgagccaaatccgggcccggccaaactgtttttaaatcactctttagttg

SEQ ID NO: 624 - DNA, 127546 bp, Human
  misc_feature (1)...(127546): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccttaagggaataaacccgctttacgcctgcctcctggggctctgcgcgctcctgccccggtttgcaggtaagccgcgccgcccaggcgcccagagaaactttgtcgcgcactcagccgcgggcgggcgtctcggaggggcggggagcgcaggcggtgcctgagggcggagggcgccttcggggcactccctggtgggccagtcgctgggggtacagccccgcggggcgctccccgcgcgcagccccgccgggctgtcgtgagtctcctgttccctcccgggctgaggaggagcttcccttcctgtgtaaacagcctggccggcctgctgacctagcccgccagggcccgcgcccagggcacggggaggaccgccgccagccctgccttggggcccgggctctccgttggcgggcacaaagcggtccttgtggccggccgggagcgggcgggctgctggggggatgccgtcggtgccctgttcccggagaagcaagggagtctcgaaaccccagccaaagcccggggccacctccactccggagggctcgcctcctggaacagcgggtgcacagggcccacagcgaatcctggagttcgctgcgcctaggctagccgcctgcctttgaagatgcagcccccaccctccccgccccccgcctgcttcctcctcgcctaggccaccgcaaacccgagggggcacccgcgtcccaaaccacagccccacctgggacttccctattaaattccttctgcccgactttatcccgcgatttgcacacgctcggagcctcacactcccctaactgtggaggattctggagcagaggacaggggctgtggagattgccttagcccgacgctgcggtgggctggcagcgttgcaaggatccctcggttacctgctctaacttttcagagttgggagatgattggacgtggtagtttggaggccctcgaggaaggatgcacttgtttgggatgcggactttctcctttcttttaggaaataatagtgctctattaactttcaagccggagatacttgattgctcttgtgagccaagtggttgcctggctgcccgaagggaggactgttcccccacggtgtctcatttacatgaaggcagtggaggtttaggtttaagagcggaggaggggtctgagcaaacaataacttcgttcagaccctaattcaaacttaatactgtagcaaggtttttggtttttgttttaaatgggaaaataatcactccagagcttggagagtagatgagtggattccaaacacccatccggcagccagtgcccatcacggatattttcatgggtccctagggaaagcgaggagcaggaagatgtagcctgcatcacacaggaatgtattgttgtcaacgctcccctgctccacaaggactttcctttagtttgaaattaggcactttttctttttttggtgggaacattttcttttaatacttcttaataatattagtagtttttaattttggcaaaataagaaaatctgacaaccctatgttaagctccccttctctttttctgtttgtttcttttgttttgtttttaaatcttagttttctttgaaatccaaaagttcagaaactgccaaaggagatggcttttaagttcctttccagcttgacattctgtaattctgacaaacagaattataataataatttctagttgcaaataattttttttttttgagtcagagtttcagtcttgtagcccaggctggagtgcagtggtgccatctcggctcactgcaacctccacctcccaggttcaagcaattctcctggcttagcctcccaagtagcaatgattacaggcgctgcgaccatgcccggctaatttttgtatttttagtagagatggggtttcaccatgttggctgggctggtcttgaactcctcacttaaggtgatctaactgccttggcctcccaaagtgcttcaattacaggcatgagccaccacgcctggctgcgaataatttctaaaaatacattattttccacttgcatcttgctttctctttttcagagttcacgtacatcttcatggtgatgtccattttctcatatgggctcaggaaggaagtgacttgcccttcccctctacttgggtcaggagtggtggaccagggaccatggcttttggtccagtgccctttgtcctaccgactcagcttaaggaagagaaaagcactgagcatggtggttcatttgcaactcttttggggtcctgttttcccattgcctatcttttcttttctttttttttgagacagagtctcactcttgttgcccaggatggtgtacagtggcatgatctcagctcaccacaacctctgcctctcaggttcaagtgattgtcctgctgagtaactgggattacaggcatgtaccaccacgcctggctaattttgtatttttagtagagacagggtttcaccatgttggtcaggctggtctctaactcccaacctcaggtgatccgccctcctcggcctcccaaaatgctaggattacagatgtgagccaccacggctggcctctgcccatctctttgactacaggttttggtggtggtggtggtggagcaagccatggcactggcctccagaacttgctgcttacctcttagggccctgaagcttctcaggattagcagaggttgactcacatctgtgtgatttctcctagtttttcagtgttgctgaattaacttcaacattctttttttttttcttttttttttttgcttcccttcccttctttgttttcttgaagcactacaggtactttattcagggagtgtttctgtcttgccactaggaacattatttgaaagaaaaaaacctagttactcagagaaaagaaagagatgaccctcagggccatgcctgcctgggtgttcctggaccagtggttgagtgcctctctctgttgctctaaccccactttcatctcagtacggatttccagcaggaaactgaccttaggtttcaggggctcatttcaaacaagtccctggccggctgacaaccccctcccgtccccaccaagggctatctcctgctctttttattatcttatggccaagagccttcagacagaatcctaggatgtggtcttcccacaaaaccaggggtctcactgaggtgaggcttttccacgctgcctttgctaagacagagagaggaacaccgtcttataaagaggatcctgcaacaccgctggaattatgtgtgctatcacattcatttctttttaaaaaagcaatcgaatgttcttctagtgaatgctctgcacatcctaagaaagccctttgttttatttagtggactcatgttggcagcacccttcctctacccccaaccccctaccacatttcctgtggtctgtgatggggttgttggaatttggctgggtctgcagctctctgtaggtaaccaggcacaggtttagagctgacaggacaatgaaatacaaacagtgggtttggtctgtagactgctgtttatcctatggatttacattttaactccatcatccttgagttgggggagctttttataaaggggattgaggcagaagagggcagggtctaattagctctaattagtattccccgcctgcttgttctccatgcttatttagctactgaggcaacggggaattaaaatatctaagtagtttggcaaaaggccttttgtgcctgcgtggcctggtaactactttttcttcttcagcctggccatggaaatattctgagatgctttaacgatatcagtaatgtgggacaattacaaactacttaaataatagggcccctttcacatggcagtgtgcagctgggttaatgggatagggtctcttttcacaggtatttccagttggctggagccgagggccttggagaactgactgccgtggtttgttttccttctttccggttcgaatgggattaatggcctctataaatgtaaaggaatgctttatttagaggcacccatttgtttctgaggcttcttgcttccgttgaatgcagggtttacttcccgggcctcatggtgaaaagtttgctctaagacaggcttgactcatcccctaaggctgatgctttgaaggcactgcggggtaccctgccctctctttataggattccctccccaactccagccagacattttcagagctggttgtctcttgtagagctgggacctacttctgcaacttgttctctttagttattctcaactgtccctcagagtgatcctgagatccaactcaagtcagatcatatctctctgcttaaaaccttcgaatggtttcccagagtcctgccaggctccacgaactctccacctacttctctgactttccttcaccactttcccttcgatcctttgctccagcagcatgggcctcccactgtcccttcagcgtgccagccatgctcccatggcagcccttctccctgcctggaatactgtcctccaagatatctgcatgaccggcttcctccaccctgcaaccctttttctagcatctcctgctcagccaagttttccctggccgctcccagctaaagctgcaacctcctccctatatcccgagttctttttatctgcttttcttctttaatttttgtccttagcactcaccaccatctaatgtaactacatatcttcttcactatttcccctaagtagaattctcccccagccaggatgtgagctccgtgaataagggagtcttgttggttttattcatctctgtatcctccatgcctacaacagcaccaggcacatatttgttgaatgaataatggatgaacctgaatcttggtaattgggaggtgaagagggcgatgcatcccgtcctcaactccctgttgccttccacagctagctttgaagtcagggactatgcatgcggcttgttaggaagaaacatcctgggagaaagagattctgttggaatgtgtcaggattttttttttaattggagtctcactctgtcgcccaggctggagtgcagtggtgcaatctctggtcaccgcaacctctgcctcccaggttcaagcgattctcctgcctcagcctcccgagtagctgggattacaggcgtacaccaccgcacctggcttattttttaatttttagtagagatggggtttcaccatgttggccaggctggtcttgaactcctgacctcaggtgatctgcccaccttggcctcccaaagtgctgggattacaggcatgagccaccactcctggctttgtgttaggattttttgagctggtatggaggccatttggtctactccctgagttgtttgcatgaggaagctgaggcctggaaaggttaagtgacttgccctaggtcacataaccaataagtgacagaacaagtcctctgatcttttatacccagtatatcctgttctccttccctacatccctgggtggagcagaactatctcctcctcctcctgctttcatggcccattccattagagagactgggggctgcagctggtctgtctcacctgctacctggttaatagccctggtcttatttacctgtgtccctgacacagccacaatgcttggtactcagatgatcccttctctcaccccaggattttaatgggcttagaaaaactttatttaaaagatttggccaggcaggggtggctcacacctatcatcccagnnnnnnnnnnnnnnnnnnnngtggtgtgcacctgtaatcccagctactcaggtaggctgaggcaggaaggatcgcttgaactttggaggccgaggttgcagtgagctgagatcacaccaccgtactctagcctgggagacagagactctgtctcaaacaaacaaacaaacaaacaaacttttacatatgtactttttcttttctttttccctttcttttttattttattttgagatggagtctcactctgttgcccaggctggagtacagtggtgtgatcttgactcactgcaacctctgcctcctaggttcaagccattctcatgcctcagccttccaagtagctgggatcacaggcacgtgccaccatgcctggctaattttttgtatttttagtaaagatagggtttcacgatgtaggccaggttggtcttgaactcctgacctcaggtgatctgcctgcctcagcctcccagagtgttgggattacaggcatgagccactgtgcccggtgtctcttttatttatttatttattttttaaaaaaagacagaatctcgctctgtcacccaagttggagtgcattagcgtgatcatggcccactgtagcttgaactcctgggctcaactgctcctcccacctggtccttgcaaattgttgggatcacagaagtgagccagtgtgcctggcccttaaaaaagccttcaaagaatttagagcagttttagatttccagaaaaattgagaagatagtgcaaagagttcccatctacctcacacccagttttgcctattattaacatcttacattagtatggtacctttattataattaatgaaccatattgatatgttattattaactaaagtccatcagtttagatttctttagtgtttacctaagtcctttttctgttctaggatcccatccaagataccacaatacattgagttgtcatgtcaccttgggttcccatggctgtgacagtttctcagtcttttccttgttttttatgaccttgacagttttaagaagcactggtcagatattttgtagatcatccccctcttgggattttctgattttttcccgtgattagacagagttaggtgattttggaagaagaacatagaggtaatcaattgcctctttaaaaaaataccttttgataggtaatatagtcccataatttttaaaagtataactcatatcaagcgagaagcctctctttcttgttgcccatcagtgtgggatatttctgtgacccccttttctaaataaattgtgcctatatagttcctattataaagctaataagctttcttatgtatcctgagggtttctatggatatgttacgaatatccctctttcatttttattcagaggcagcacaaaacacagtatgtatcttgctttttatttttaacttagcgatgtattggggtaagcttcctgtcaatacagagagcatgctcattctttctttatagctgtctagcactccattatatgaattggtgttttaaaaatagaagtcagatctgtaaggctggtattgttgagtgttgtgcagatgtctgatgttcataaaggcagtcttgaatgagaactgctgggatagaaccttcctagggcatatttgcatttcatggtaacatttagacatatggctatttagttgctggagtctatactgggactcttttgtccattgtgtgacaaatgtgagggcctggttcagggtgtggggagaagcattccagggcattgccatcttcaaggcagaaaggccatttcagcttctgtattcacttctgttatcctactgaatattttggatcaggaaattccaactgcagatgtatgttttagtagtagttgtctgaccttggacccatggggtgtacagaagtggagagaggctgaatggaaggaggccagccaggaggctatggcaggaatttagaccagagggcctggcttgggttgttggggctagaggttgcagacaggaagggttggcttaggataaacatttcttgcatcttgaaaggagtgatcaaccggatgcggtggctccttgaatgattgatgaaacacaggggtgagtcagtgaattttggaagaacatatttttagattacagtttgcagtaaacactgggcttcagagacgtgaggcaaaagagatacatggagttgccaccgagctgggaatagtcactatgcaaacagcaaagaagatgagatgtggctatcatctgggctgctagttcctgtttccatgacctagacctaacactgacatttgtgaactccgtgtgtttagttttttattcattgcttccttccttttcaaaatgcttattggtgccaaatgactcatccagcaaagtccaaactctgaaatattaataggtggagagaggagagatgccaaagggagtgagtctgacattacacataccagcacacagcctgtggttttggatcctggagtacctgtctggtacctggtacccggcacactgtgagttcctggacatcaagggctggtaggtcattcacctgtgcatttctagcatcccccccagtccagtgctcagcgtttagggtgtgttaagtgcagagtttcttgaatttgaatgtgtcccaacagcaactgaattttagggcaatcattttgagtacaaacgactttacttttccatgtgaatatttaataataacagaaacagttagtaatgctatatgacaaattgttttacagttgttcatgatgttttcataccaggtgactatcacatcctttgagtttctttggtattgtgtccaattaagtaagggcttttaggctggtggaccagaagaccagagctcagtctgatctgcatcagaattgaggagctcttattgtcctgagccctggacctccagcccaagttcccagagctcatgatgaggctctggtaattataaagtgttgtttgcaaatgtatgtggctttgaagctgggtacggtggctcacgtctataatcccagcactttgggaggctgaagtgggcagatcacttgaagtcaggagtcgaagtcagaagaccagcctgtccaacatgctgaaaccctatctctattaaaaatacaaaaattagccaggcgtgatggcatatgcctgtaatctcagctattcaggaggctgaggcaggagaatcacttgaacttgggaagcaaggttgcagtgagccaagatcatgcccctgcagtccagcttgggcaacaaagcaagactctgtctaaaaaaaaaaattatgtggctttgatcagagtcctacgtgaggcctttgacctcaaattcctttctgataaaggggctgttacagatctccagaggaccctagagctcagcaggtcacaccagccctacatccaagatggcagagggaccaccaggcaggtatcccatgtgggcacttgctggtcaggaccccgtctgacctcttttttgtagatagggctccttgtttcaagtcacatactctcattatcttacattttcatctataaaaagaggcaacttgactagctcatcttaaaacaatcctagccccaaggtgctataatctcatgattttatgaaaatgattttatatatcaaagaaaaggatatgccacaacgagcctgagtttgtatttgataaggttgaggagaggaggagcaaagttactttcattctagatttattttttttcccctgcagatagtgattgctgacaggtacggggatttgaccaaaaaatgggactgacattttgcaactcttttcctgcacacacttttgtttttaaaggcttaagtgcctatttaaaaatcactaagtgagccaggtgtggtagctcacgcctgtaatcctagcactttgggaggcccaggcaggaggatcacttgagcccaggagtttgagaccagcctgggcaacatggcaagaccctgtcttccaccacaaaaaaaaaaaaaaaaaaaattagccaggtgtggtgatgtgtacctggagtcccagctacttgggaggctgaggtgggaggatcacttgaggctaggagtttgaggctacagtgagttatgatcacactactgcactctagcctgggcagcagagctagaccctgtttcaaacaaagaaaaaaaaacaaacaagaaatcaaaaaaaagaaaagaaaagaaaactcactgagtgagtgaattcatttaaaattaggaggttgtcagcacatacacaggcaggtccagcttcccagtaggttgtgttctcagaccttcttcgtccacatttgggcctggatggcttttcctgctgaagtgaggtcaggcaaggtgggtgggtcccagcagcctcagagcctcctgctgcaggcctccctgggtgaggtagataaggatgaggaggcctagggttcagggttagggctggtggaaacctttgttctcaccccctgtgggttctcaaagcctctcttcctttcttcctagcctctcagcttctgcctgtttctcccttccctctggtcccagctactatccttatgccaattggtatttcttccttctaaagtccctggggtgacatgataaagcttccttcccctaccaccacctcctgcacccacccctctgccagtcagcagttttgccgtttgcgatttctgtgagtttttactgctagtgacaaaggagaagcagggagttaaaattagcaaattagggaaatgttccagttgcaagatactggtttgttttttttttaacccctattttggcatttcttctcttttactttttaaatttttcttttctttttccagctttatggaggtagttgacaaataattgtgtatatttacagtatatgatatgatgttttattatatgtatatatttgtagtgattactaccatccagctaattcacatatttatcacctcccatagttatctttgtgtctgtgtggtgagagtatttaagatctactctcttagcaattctcaagtgtgcagtacattattatgaactattttcaccattctgcacaatagatctccagaacttattcattctctctaactggaactttgtaccctttaaccatctcgcctttctccatcccacctcaaccccaccagccatggcaaccaccattttactctctgtatttctgagttcagtttttttccactccacgtataagtgacataatgcagtatgtctttctgtgcctcgcttaatagtgtcctccaggttcatccatgttgtcccaaatgacaggattttctcaattttttaaggctgaatagattacattgtatgtgtataccactttttaaaaataccacattttctttattcatctgtctgttgattgcatatcttggctgttatgaatagtgctgcaaggaacatgagagtgcaggtatgtctttgacatactgatttcattttctttgactatataccccgaagtggaattgctggaacacatagtacttctggtttaaggaacctccatatcattttccataatagctgtactaatttacattcccaccaacagtgtacagagtttccctggttcccttttatccacattcttgctagcactggcttttgtcttttttttttttttttttttgagacagagtcttgctctgtcacccagggtggagtgcagtggcactatctcggctcactgcagcctccgcctcctgggttcaagtgattctcgtgcctcagcctctcaagtagctgggattaggaggtgcaccaccacacccagctaatttttgtatttttagtagagatggggtttcaccatgttgcccaggctggtctctaatccctgatcttaggtgatccacccacctcggcctcataaagtgctagtattacaggtgcgagccacggtgcctggcccattgctcatttttgtaactgggttatttgctttcttaatattgagttgtttgaattctttatgtatttggatgttaaccacttatcagatgtgtggtttgcaaatattctctcgcatatagtaggttgtttctctgctctgttgattgtttcctttgctgtgcagaagctttttagtttgatagaattccatttgcctattttcatttttgttgcctgtgcttctgggataatattcaaaaagtcattgcctagtctgatgccagagagctttcctcgtgcattttcttttggtagttttacatttcaggtgttatatttaaggttttaaaccatattgagttgattttttaaatatagtgtgagataagggttcagtttcattcttctgtatatggatatctggttgtcctaaaaccatttattgaacagactggcctttccccattgtgtgttcttgacaactttgttgaagatcagttcactgtaaatgcctggatttatttctgggcactttattctgttccattggtctacatgtctgtttttatgccagtactgtgctgttttaattacagttgctttgtagtatattttgaaatcaggtaacacaatgcctccatctttgttcttcttgcttaagattgttttggctatttgggtttcatacaaacttttgtggttttataaaaattttaggattgttttttctatttctgtgaaaaatgacattgggattttgacaaagagtgaattaaatttttagactggatagcatggacattttgacaatattaattcttccaaaccgtgagcacaggatatctttccattttggggatattcttcagtttctttttctttctttctttttttttttttttttttccggcttttgagactgggtctccctctgttgcccaggctggagtgcagtggtacgatcatggctcaaagtgcacactaccacacctggtgaaattttgtttttcttagagacagggaccctatgttgcctaggtcggtttcagactcctaggctcaagcaattctcctgctttcgcctccaaaatgttgggattattataggcatgagccaccatgcctagccttgggttttttttttttttatttgacctattaatagatatattgaatcaatggatttcctctatcttaattcaacattgtattcctgggatacatggcttctttcagtacactgtacattttgatgtgagagtatttgatttagaattttatttttttaaaaaaattcttgaataaaaccaatgtattcttttttcttttcttttttttttgtactatttttgtcattttggatagactaagtgtaaaggggccttgttttctctcagcaagagaggatttgctgagttatggggaaaatgagaatccaagtgggtctagcagaagaaatggaagtcgctaacacaagcgtgcatgcttggtgaatgcttcaaaaactcaatgttcagccttagcaaatgagccttaacctgcaattagcaatggtacctgcaccctttagactcagagaggcctcctgttaaagaaggatgtaattccccctattcaaaggcttgatccatgaagtttatagccaggaactaattagtgcatctttatcttgctttaaaggtctcaacatatgcactagtggaagtgccacctcatgtgaagaatgtctgctaatccacccaaaatgtgcctggtgctccaaagaggtatgtaggtgggggaggggaggaagaagggaaggaatgctgcgagggtgagggtgagaaggaggccaacaccacaacacactaattcactatacataaaaatcctgtgcagattctgtaagctgcctcttccccatcagggcagagtgatgacaaatccaagtttatgagacaataagataaactgggtttcttgatactgtggaatgctaatcctgttttggggaaacaagactttccttcccttttgtttggagaccagttaggattcatctatagttttctgatctttggtataagaactccaaaagacctgagcttgtgaattgagtttgttgcataatgattcaaaacatatctagatggctggcatgttggtggaagccagtcatcttagtgtgtttacttgagaataaatattaggaattagcctttatggaatgattttatttagaaataatggctgccatttctttaagccttttagaaagagatataggtttgggacaatgttaggctattggtatcataaagcaatatgggctgggtactgtggctcatgccagcattgtgggaggccaaggcaggaggattgcttgaggcttgagctcaggagtttgagtccagcctagacaacatagcgagattctatctctactaaataaatcaggaaagaaagaaagagagagggagggaggaaggaaggagggaaggaaatgtaacttggtggactaatcagaaaatgatcgatttctaaatttcctctcttgaaggaaatttctgggtcacaaaccctccctgtaaaagtgccccattaaggttatttgtaaaggaatccaggactttttgactggctcagtctgcaatgcagtgcgtggtccctgtcaggaggaccaagagatggctcacgggaggctggggttagtctccatcatggcagcctcagaggtctagggattcctttaacctatgatggctaaaaatgatcatgtggggactctactagatgtcatacactttgtacatcatacaatatctctgatcctcacaatagctctgtcaggtgggtgtaatacacttgttttattgatgaaaatctcagactcagagcagtaaaataactcactcaaggtcacacaagtgtgccaaagctggggttttaatctgacctctgagcccaagcttttccctccagactatatggcctcttgcttgctatatgaactctctaaaatgccaattttaaaactttgggagttctcaatttactttgagagtggaatcttcccaacatataaacctttaatcatatttgtgattaattgtaccatctttgttatcacccttctttaaaatcttcctttcgttctctatgacctgcagggcagatccaagctctgtggctcttgccttcctcctaccatcatctcttgtctgacctgacatttagccagagggaaccacctgcagatacccagagagcccagcttgagaaaccctgcctgatcttcccggtgtttctcccctccctggagagccttcctggctttttcttcctcctttccttcttttatttatttatttatttattatttatttttatttttatttttattttttgagacaggatcttgctctgtcacccaggctggaatacagtgatgtgatcatagctcactacagcctccatctcctgggctcaagcagtcctcctacctcagccaccaggtagctgggactacaggtgtgggccactgtgctcggctaattgaaaaaaaatcttttagaggtgggatctctctatgtttcccagtcttgtctgaaacacctgacctcaaatgattctcttgccttggcctcccaaagtgctgggattacagatgtgagccaccatgcccggcccctcctttccttgactgataccttgttttatcgtttttaagaatcaattcggccaggcgcggtggctcacgcctgtaatcctagtactttgggaggctgagacgggtggatcacaaggtcaggagttcgagaccagcctggccaatatggtgaaaccccatctgtattaaagatacaaaaaattagccaggcgtggtgtcatgcacctgtaatcccagctacttgggaggctgaggcaggagaattgcttgaacctgggaggtggaggttgcagtgacctgagatcaggccattgcactccagcctgggcaacagggcgagactctgtctcaaaaaaaaagaatcaattcaggcctggtgtgcagtggctcacacctgtaatcccagcactttgggaagctgaggtgagtggattgcttgagctcagaagttcaagaccggcctgggcaacatgacgaaaccccgtctctacaaaaaatacaaaaaattagctgggtgtgctagtgcatgcctgtagtcccagctacttggggggctgaggtgggaggatcacttgagcccgggaggaggagctgtagtgagccaagattgtgccactgcactccagcctgggcgacaaagcaagaccctgtctcaaaaaagaaaaaaaaattaatcagtttaacctcatctactccataacgacctgcatacctgactgtctccatctgtctatccattcatttatccatccatccatctgtctatttatctgtgtatccatttgatatgagaatgtaagctccctccactggggtttttttttttttttttcttttgagatggggtctcattctgtagcccaggttggagtgcagtggcatgatgtcggctcactgccacctccacctcctgggtttaagcaattctctgcctcagcctcctgagtagctgggattacaggcacgtggcaccacacccggctagtttttgtatttttagtagagacggggtttcaccgtcttggccaggctggtcttgaactcctgacctcgtgatccacccaccttggcctcccaaagtgctgggattataggtgtgatccaccatgcccgactggggcaggggttctatctgttttcttcattgctgtattcctgaatggcgcttaccacatagtagctgctcaaaggatttcactggatggctatttattgtgtgtctgctaggtgcaggccatgactacctctttgtctccgtgtactctgtgcttctttagtatttataacctctttttgttttaatttgttttcatgcctgttaccaactaaatcatcatctccttgagaaactaaactgtcttatcttggatacccagtatccagccaagaatctggcaggaatttgtatttgatataagagtactgttaaaaagacatgaagttagaaaaaccaaagtttcaatcagttttgctgtgatttactcttaatttcttgatatgtaaaatgaaggtgattgttcccaccctccagcatgactgggagtgtaaaatgagatccgtgcatgagaggacttgtggacaaggctgattagctgagcctcctgaatggctgccactgtcatccatgagtattttctagtgacatgtggctagaaaatccagaagccaggtccatttttactttaaatagcttctttccttgtgctagtacttccacaagtcagacttcctgatgctgacagtaaatgaaggtgtccctaggagcttgttatcaccccagcccacacttaggttccctgtccagcccactgggctccctctctgctcatcaggagcctcattcttagctgaagaaattcctatgatccctgccctggaatgcagcttcccatcttctttgggggtgacttttccccaggacatgggtgtgttttagagagccaggttaggagagttcaggaatggttatttatttatttattcatttgaggcagggtctcactctcatcatccaggctggagtgcagtgatagaatcatggctcactctagcttcaacctcccagtcccaggtgattctcctacccagcttcctgagtagctgggattacaggcgcgtgccaccatacctggctaatttttgtatttttagtagagacggggtttcaccatgttgtccaggctggtctcaaactcctgggctcaagtgatctgcctgcctctgcctcccaaagtgctgggattacaggcgtgagccaacacgcctggccacaaatggttttgatcaacctgtaccccttagcaagacagagtaagtgtggctgggtgccttcttaaccatatatcccaggacatcatcaaagatgtaataagcatgtgatgtgtgtgtacactgagggttgctgcccagtagacagccggtgagggccaggttcccaacctatgaggatgaatcccatggtacattccatggggattctcctgctccagatcccatgaagacttacccttattgtacttgaagtgggcatgaggattccttatccctgcagttcacattccttgtaacctaattccatgcctgctggccacgtctcctcccacaggtatcatgtatgagtccatcagtgtcctttcccaccactccctgcacggtgctcttgctggttctctcttagttggctctgtgtcacatcagccctggctctcttgcttttgtttactttttttttcatttttaatcatttagttaatttattttcggagacagggtcttactctgttgcccaggctgcagtgcagtggtgtgatcatagctcactgcagcctcaatctctcagactcaagtgatcctcccaccttagcctcccgagtagctgggactatagacctattccacaacatccaggcaagtttttgattttttttttttttttttttttttggtagagaacaggtctcactatgttgcccaggctggtctccaactcctgggctcaagtgatcctctcaccttggcttcccagtgtgctgggattacagacagtgagccactgtgcctggcctcttgccttcattttctcaccatgctttacctgagggtttcagacttactttctgccctcatatccagagtcgccagactctcccctactctgagaccaggatgtatgggtcactgcctgtcttggcctgtccatgctgcccctgcctctctgcagcacactctctaccttgttctagacagccttggccgcctgcttctcagcccttatggtgctgtttgtacagcacagcttaagacacatgtattagtctgttctcacattgctataaggaaatacccaagactgggtaatttataaaggaaaggggttgaattgactcacagttcgccatggctggggaggcctcaggaaacttacaaccgtggtggaaggtgaaggggaagcaatgcaccttcttcacaaggtgtcaggaaggagaagtgctgagcaaagggggaagagccccttatgaaactatcagatctcaggagaactcactcaccatcaagagaacagcataggggaaaccgcccccatgattcagttacctccacttggtttctcccttgatatgtgaggattatgggaattatagggattacaattcaacatgagatttgggtgggaacacaaagcctaaccatatcaacacacaacaaatcccagcagtttatgatctattttgtccatcattttttaaaatggacattttgtttcccctctaacattgtaaattttacaacctagccagttgtcatgaggaatgtgcctggaggagagtgtgcggatgctttcaagcagggcctaggggtagcccacattcttcctactagcactgttgcctaaaacccagccacatggcaatgcctaactgcaatgagaactgggagacttgctctagctttgtgccccagaagaaagggagaatgggcttggtgtactggcagcttatgctcgtgtcactcgcaagaggacagtggtttgggagaagtgggcaaggctgagggatcagtgctccctgtgagaacagaaagcagggttggggaaagcaagagaggaggcaaaggcagacagagagattgcacttagggtttgcagaagttgggaggttgtcagggtgtgaatacgaggctccgtgaaatggtgtggctgtgggcagtaccaggctgctgtgaaatccgggagaaggaccaggttaggcaaggccaccactgtggagctgaattcccacagggagaagaacagtgaggccatggatgcatggaaatggggtcgggcatgggagaagactagtgaaaagaacagtgaggccatggatgcatggaaatggggtcgggcatgggagaagactagtgaagtctgggctggggtgagcggtctttgcctggggaagtggatgtggagaagaagcaatgaagcatcagtaggattggaggtaggagcatgaggagggagacaggtgagaggctgggaagcaagatgggccaactgaaatgaaaagaatcaatattcaatccagctcacataaactatagattctttaaagaacatctccttgtggtcagattcaatgaaagaaataatattggcctgttgtagacacttcataaatatttgttcagtgaattaataagtccattgaaagctggcagagggatttctccatcccccaggcagggagtatacgtggcagtgtgttgctggcacacaacacacatcttggttgtcatcagctaccttcccctcaaatccctgagggttctgccaagttggagctgcaggtgtggctggtcagggggccaggccctgccatatcccagccagaaaggtcggccttagcaagaagccagctccccgcctgtgtccacttctcccctgggctctctgcctttttcccagtttgttttcttccctcttcatcccagggattgggcatgctggcctcctttcttgcttgggttccttttgttcaagggcctacagtttctcaactcttctactctgtttcagaaacaaacaagaatttgtcttttcccccaaaacaatcaccctcacctttttagagttttagccttcagcaatggtaggcaggatggcactcaaataatgtaatgtctggtctggcatagaggaacctgaatgcactggctgtgatgctggacagccaagcacccattgaacactagctttgactgcagggtaagagaccttgattagcaaaaaatatgtagggagctgggcatggtggctcatgcctgtaatcccagcactttgggaggctgaagcgggtggatcacttgaactcaggagttcaagaccagcctggccaacatggtgaaaccccatctctactaaaaatacaaaaattagccaggcatagcagtcccagctattcgggaggctgaggcatgagaatcacttgaccccaggaggcagaagttgcagtgagccgagatcataccactgcactccagcctaggtgacagagcgagattccatctcaaaaacaaacaaacaaaatatatatggagtcaggtgttaacatattataataagtagcagacctcatcttatcctccatgtaacagtgatgatggggtgagtgagcatggtggcttacaataagttgcaaacaccagtgttgtaacaaactaaaaacaatctaaattttaaacacctctcttttctcttttatattattaccacttagtaactaaaagcagcaaaaggccaggcatggtggctcacgcctataatcccagcactttgggaggctgaggcgagaggattgcttgagcccaggagttgtagaccagcctgggcaacatagtgagacctggtctctacaaaaaaagtaaaaaatcagtgggatgtggtggcacctgcctgtagtcccagctacttgggaggctgaggtggggagacagcttgagcctaggaagttgaagctgcagtgagtggtgatcacgtcactgcactccagcctagacgacagagcgagacccagtctctcaaaaaaaaaaaaaaaaaaaaaaaaaagaaaaaagccgcaaaggacacttcaactttctattgccattctgctgcttttcccctttggagagtttgataagggcatttctggagaccagggatcaatgctttgtttgtgtacaggaacctcttccagcatagagcatggggagcatctgcaagcagttgtgttgtggcccattagaagcccatccttcttgcttgggttccttttgttcaaggaacaaaaggttgccatttttgcctgttgagatgaagtctcccctcctcttctataggttgaggctcctctgtacctgtttctctgcaaaaggatatttatccctcatgtttggtaggtaacagatctctgaatttggggcagcaaagaaatgctgccttcagaaggatggaagctttgggcccaaagttagtttcctgctgcagaacttggcagtggccttggctaaaatgggaggcggcacatgctgcaaagagcactggatttgggcccaagaagccagggccagatgaacttcaacttcttgggtgaacttaggtctgtggacctctgattccccacctgtggaagccaggggatggcaccaggtgatgcagtcaagggcccttccccttggaacttgctatgtctgacacctggcagagggtctgagtgtcaggtctctgggatctgaaactgttacgccatcagacatcaggatgtcattcatgtgaggaggactttctttttcttttttttttcaactttcatgttagatacagagggtatatgtgcaggtttgttatatgggtatattgcactctaagtagtgagcgtagtacccattaagtagtttttcgacccataaactctcctgtcccagtagttcacagtatctgttgttcccatgtttatgtctgtgggtgctcaatgtttaggtcccactgataagggaaaacgtggtatttggttttctgttcctgcattaatttgcttaggaaggaggattttcttaaacatcagtctgccttttctctaaggctttatgatatgaggcatccgtattcattgaatatggagcttagaaatataggtattgaggggccggatgtggtggctcacacctgtaatcccagcactttgggaggctgaggcgggtggatcatgaggtcaggagatcgagactattctagcaaacacggtgaaaccctgtctctactaaaaatacaaaaaattagctgggcgtggtggcgggcacctgtagtcccagctactccagaggctgaggcaggagaatggcttgaaccgggaggcggaccttgcagtgagctgagatcgtgtcactgcactccagcctggatgacagagcaagactccatctcaaaaaaaaaaaaaaaaaaaaaaaaaaagaaatataggtcttgagacattttttctttctttctttctttctttttcttttttcttttctttctttctttcttctttctttctcctctctctctctttcttttttttctttttttttctttttttaccttaaactactaagggttaagagacattttccagatttataatgtttgtatacctggaaggtcatagccattactagatatgcccctggtctctgtcattttggttttctctctttaaatatgcatctatccttgttcaaaattaaaatatctaggccaggtgttgtggcttatgcctgtaagcccagcattttgggcggccatggcgatcatctgaggtcaggagttcaagaccagcctggtcaacatggcaaaacactgtctctactaaaaatacaaaaattagccaggcatagtagcacatgcttgtaatcccagctactccggaggctaaggtggcgggatcacttgaacccaggaagcagaggttgcagtgagctgagattacaccactgcactccagcctgggtgacagagtgagactccgtctcaaaaatgaaaataaaaatacttagaaaggaacacatggaatagaggcgaagctcttggcttgtgacctaactccctctgttgagtccgcagcactctcagttccttttcttgggcaacaagaacctatagctacaaatcagttatggcttactctttccttatcgggtcaaaaataaatcaaaagaaattagtcacagcaattgtttggactccgtgccaaaagagatctttacctcttaggggaatttccctgttaaggtagctgccttaccctcaaaagcttcttcagacctgccttgccccgtggtgcctcagctagtggctctgagtccctagagctctgggaaaataatgacaggactcgatatataggtaaagatgcctcaaagttgttgagcacatcaacaaaaccatatggcctgacctagatagcaagaaagcgaactttgacactgatgatagagatgcctggcactgagaagaaatctaactttggtccgcgtggcatatggtgtgtcctttgctgtctataaagctggagttgctgagaataggactccctttgtaccatcatgttgctgacttggtctgtgcttccgaagtcagtgcaaccctgcaagttgcagctttaatgtgattaatggtggtttccacactggcaaccaggtgacagtgcaggagcccatgattcttgttgttggtgcagctaactttagggaagcctcgtatgcactggagctgaggtttatcacaacctcagctgaagaatgtttttaaggagaaacatgggaaaactgctaccagtgaagggcatgaagagggctttgctcctaacatcctagagaataaagaagccccagagctgctacagcatgcacttgggaaagccagcgacactactagggttgtaataggcactgacctgtccgcctcacagttcttcaggtctgggaaatatgatttggactttaagtctcctgatggtcccagcagatacatttggccctgtacaagttcttctgcaatgatgggtagtatccatcaaaaatccctttgagcaggatgttgggaagctcagatgaagttcactgccagtgcaagtatcccagcagtgggggggatcatctcattgaccaaactgaaggaattgtgcacctgcctcctgcttaggtgaagcaggttggctctgtgccctagtctattccagagtgtaagctggtccagaccagtgagagaggtgtcaggggttctcattactctgaaaaaactgaccatgcttccgttgccaccctggtggtggggctgtgcactggactgatcaaaacaggtgcaccttgacaaacagaactgggccaagtatagtcagttcctcagaagcagaggggctggatagcaaggctcagttcgccagtgagaaattcagaaattctctagcagagtaagcactgggcaggcaagcccctgagctcttcaagctctggaaagctaattagacatctacttcagacagctcaagacagcagacccaaactggcagggccctcaggtcgttacccctccttttccagaaccctgtgtttttcttctcactgcttcactagaactgctatatcagagccaagcttgaccacctggaaccccatttagaaagttctgcttttaaatctaaggccagaggccgggtgcactggctcacgcctgtaattccagcattttgggaggccgaggcgggcagatcataaggtcaggagatcgaggccatcctggccaacatggtgaaagcccgtctctactaaaaatacaaaaattagctgggcatggtggtgcgtggctgtaatcccagctactcgggaggctgaggcaggagaattgcttgaaccagggagtcggaggttgcagtgagctgagattgcgccactgtactccagtctggtgacagagcaagactgtgtctaaaaaaaaaaaaaaaaatctaaggccagaataatatatatatgtgtatctctctgtgtgtgtgtgtgtgtgtgtgtgtgtgtgtgtatatatatatatatgttttgttttgtttttttaacaaagtctcactgtcgctcaggctggagtgcagtggcatggatcatagcccactgcagcccggagctcctgggctcgagcgatcctcccgcctcagcctcctaaaatgctggcatgagccaccatggctggctagaaaactcatttttctaaccttgttgcacaacaagtgtttatggagccacttatacctttgatgtagtcctggaggttgttgacaggcaagatcctcggggatttaatgcacaaataaaaaatcgttattaaaaaaaaacaacccagaatataaacaaacataccgtaggcttaggacaatacatctggctttacttatttaaaaacactgcagcgtcttcttgacttcttgttcttttttgtgtttgttttttgtttttctgagacaggctcttgctctgtcgcccaggcaggagtgcagtggcacaatcgcagttcactgcagcgttgaactcccagcccaaatgatcctcctgcctcaagtctctcaaagtgctgggattacaggtgtgagccaccacaccaggctgacttcttgatcttgaattttataaggattctaaagggcattgggtagttccaggacatctgagaccttgagggagggtgcattcctctgatttttgtgcctctgccagcagtctggcttctaacaaagtggtcaagggatgctgactcacatgaggcttctggcaaagtgttccagagggaagaggaagggaccagtgtcctaactcctccagaaagactcataggacagcattggcttccagcctgccagagtggggggaatcttgtttttcacattcaccagggaaaaggtgaaacccctttgccggaaatgaccagggaggcttcatgatttataataaagtatattgtttcattttaaagttaataccttaaccttctggtgtcccaaatgaggttgagttgttctgatgtccagctttctcccaaacccaaagaaagatttttcttatcaatgtgtcgttatcatacaaacaacaaagataaaaacaaaaatgtttttgtcactttactataacacctcatttaaaattgttctttcaaatcctaataaatacaattctatattttgggtttttttttcctccttagtgtaaatattttaaatttcttcttaattcccataattatttgtaatggctgtcatctattgaagtgatatgctatgttattcttatggtttaaggatttaggtttgcaagttttaaagattatattataagtaatactgccgtatatatcacatagagtttctcctttctctttagatgattttcttgtaataagtttcttggagtagagcactgggtcagtggatatgacctgtactgccacattgttctcctgaatgattatccagcatccaatgcctgtgaaagatgataagtgaacaacttaaaggttaactcttgaatgcccaagggaagacttttcagctacttatatgtcatcttatttatttaactatatattatttcatctacttatttatttatttttagagaggaggtctcattatgttgcccaggctggtctcaaactcttgatctcaagcgatcctcccacctcagtctcccaaatagctgggattacaggcatgagccaccatgcccagcaatatataacaacttttaaaaaattttagctatacaacttctgatcatttctgtttctcttgctaatcatgtaggcagttaggagcattttaaccatcaaaataacaacaaaaccgaacatttttattatgtgtttacagtttacaaaatgctgtcatgtccagcagctcagttaatccttacaatacttggtgaagcatctgggatagggattaccatttcctccattttcagacaatgaaaatggaaagtagagaatttaaggtcaaccagatggagacgcagccacgacatgcgatgttttcgggagacaccctgaccacctcctgctctcttcctctttttccctgcctaggacttcggaagcccacggtccatcacctctcggtgtgatctgagggcaaaccttgtcaaaaatggctgtggaggtgagatagagagcccagccagcagcttccatgtcctgaggagcctgcccctcagcagcaagggttcgggctctgcaggctgggacgtcattcagatgacaccacaggagattgccgtgaacctccggcccggtgagttgcccacagaaagggctggatgctctgggatcaggaaggcccatgggggaggtgggacttgttaataatgggacaatgagtcaggccaggctgagatcagagccacgagatggtgatggggaggcaaggctcagacctcaggaagcagagtatattcttattgatgtgtctgtggacaggctcctgtggacagaggaagatctttgctatttttaaacaattgtggtgaaatatacataacatttaccatttaagcgttttcaagtgtacagttcagcagcattaaattcacaatattgtataaacatcagcagtatctatttccggaacattttcgtcgtcctaaacagaaaatctatacccattaaacattaactcctcattctctctttcccttggttcctggtaaccggcattctactttattttttatttttcatttatttttgtttttaaattttgtttaaatcagggagcaactgatggcagaaattacagtcattcagggtgtagtggctgcctactctactttccgactctgaacttgactagtccagatacctaccataagtggaatcatccaatatttgtcctttgaagtttgacttgtttcactaagtgtaatgttttcaagtttcacacatattttggcatgtgtcagcacttcattccttttttggctgagtaatatttcattgtatgggtgtatcacattttgtttattcatttgtcagtgaacatttaggttgtcttcaacttttggctcttgtgaataatgctgtggtttattctaggaggatgctggtagatttactccttagtgaatgcaagttgctcaggaaacacgccacttttaggaaaaagtgttttttcctgtcagcaaattccatttgagtctgtagcattctgcaaggacaaacttttagagtggagatattttgttttgtgaccatggggccctgcaagccttagagttgcttaatataaggaaacggtaatataattacttataatgtaatataaagaaacagttttgcacacctactatgtgctaaacacttgacctaactttaaggtagctatcttttttttttttttttttgagatggggtatcgctctgtcacccaggctggagtgcaatggcacagtcttggctcattgcaaccttcacctcccgggttcaagagattctcctgcctcagcctccctaatagctggatgtgtaccaccacgcccagctaatttttttgtgtgtgtgtttttagtagagatggggtttcaccatgttggccaggctggccttgaactcctgacctcaggtgatctaccttcctcggcctcccaaagtgctggggttacaggcgtgaaccaccatgcctggccaggtagctctcattttacacacaaggaaacaacctgctcaaggtctctcagtaagtggtgaatcgattcagccccaggtcttggtaaccacaaacccatggctgtttctagttcaccacttttatcattgaatattctgcatattagaagccttgcaatgtcaaagggttagatgtgcatgtggctaaattggaaagtattacgctattgggaaggggcagattttttcacattttactgattttttgctgttttcttctatcccatggtctaggaaaccattggcagtagctatttgtagatggtttatttagactccagggaagcttgtagcagtggaaagatcatggatctggctggctctcttgggttctagctctggctctgtccctagcttggaggccctgggcaagttactccatctctcagcatcttagggtctttgtcacctttgttcctcatgggcatgttcagaggcttaaatggactttttgtatcagtgaacttttcaaagttaaaatttttattattttcaaagagcagtggccgagggtaccagatggaggtttgaccagggatgctcagtgccttggaaatggattaacacagtgctgcatgtggtaagcactcagtaaagctcgttgttgttgctgtggttatcattgtatggtctgcaccaagagtttttaaagaaagctccaagtcatcatatagttgagaaatgttttattttgtctattttaattgtcttgaaaataagaaacaaaagaagagtgtaagttggccctgctggatagagaagcttaaactattgggttgcctgcccaggaatcagtgttgagattaattgaagttaggatttttgcaaaccttctcactgtaagcaacactcagcctttttgtttagtgagatactgaattgagagagaaaaggaagggaactcttacagagctgtgtgagtgggtagaaaaaagtcagctgagcacttatgtgggcagatggttggtaatgtcctctggggaaagagaaatctcttatgtgaagacagactcagggtccagggtttggaccgaaagggatataggagttgttatagacccttaatatgttggaacatcgtgttgtataagaatagtgtattttcttttttatcatagtaacagtatagcaataacacatgaaattctagaaaaataatccactttaacataaaattatttttcatttttactatgtcctctgtattattcacctttttgtatttttcatatacttatcataatgtatgtataatcgtgctattttcattcaataatctttgaaaattaggaaaaaaattcacacctccaaaagagtttgtagtttcagagccattgtggaggaaggttttaatttacattttctgaactcctcatctagaatagctctcaaagcctgtggtgttctctccaagaagtatcctttatggtggcaagtctctcttcttcaggatagacttaacttagacaagagttgcatcacacaaatccaaagatgtccacactttaataattccagtttttaaaatgagaattaaggtgtgagtgtgagcagagatggttgtctggtttgactatcaactggcttttacagcagtccctgtagaagagttagagagttagagaaggccgggtgtggtggcttatgcctgtaatctcagtggtttgggaggccaaggagagaggatcgattgaggtcagaaatctgagaccagcctgggcaacatagtgagaccccgttgctatgggggagactgaggtggaaggatcccttgaacccaggagtttgaggctccagtctagatgaagatgagactctaaaaaacaaaaacaacaacaacaacaagaacccaaaataaaaaataagtgatttgagtaacggcaggtttgcatacaatccgtatttatgcataaaactcaatatatgctcagttaaggaaaaaaatcattcttatttggtatagttacatctcctgctaagcattatgatatgatttctggtattagaaataaaatggaaaccgtgatcctatgttgatacaaaaccacagtgtggatgctgtgtagctctgtcttgcggaaggtgtcgtggtggagagcccagtgctggtggtgtcaagcagttggaggagctgactgcctcctgaaaacacacccagactatgaagagggttcagtctgaagagatgaagactaggaagagatctgatgaaaatacgagttcctaagacctacaagcattgtgaatatgtttcccaaatgtagaaacacttgaaaccaatgatgcctcttaaaattttgaaaatataattttaacatttacaaagagaagtacaggcaaacctgaagaatttgtggggagagaaaaatggtatgtggcagttagcaaaattttcagtcatgcaaaatgcatatttgcctcagggtatctcccccctgactctagggagggctttcaggtatataggggttggtttttcatatatctatctatatatatgtagagagagacagagtctcgctctgtcgcccaggctggagtgcagtgacgtgatttcagctaactgcagcctccaggttcaagcgattcttatgccttagccttctgagtagctaggactgcaggcacacaccaccacacctggctaatttttgtatttttagtagagacggggtttcaccatgttggccaagctggtctcgaactcctgggctcaagtcatctgcccacctcggcctcccaaagtactgggattacaggtgtgagccactgcgctgggcctccattgtatatttttagaaatgcttttgtgtcttcttccttgccctacccgccatgcctcataatagttattcgttgagtgaaatataagactttgccagacttatcgcagactaatcaaggacaagcctcagcataatatgaaagacacttcatgaaggcaaagtaattgttccaaggtaagtctcaggaaggaaataaaaattaaaaagaatttctgtctactttaagcaggacattttttatttttttaaattgagatataattcacagaccataaaattcactaacttaaggtgtacaattcagtggttcttagtatatttgcaaggttgtacagtcaacaccactgtctgattccagaacattttccaaaaagaagtcccatacccgtgaacagttactgcttaaactaccgtctcccaccctcccctttcagccgctggtatccactcgtctactttctctctatatagttttgcatattctggacatttcctatacgtcataaaatgtgtgggtcttttagctggtttctttcacttagcaacatgtttcaaggttcatccatgttgtagcatgtacttcattcctttttatggccaaataatattccattgtggaggtatagatatactatattttagtttatggacatttgggctgtttctactttgggacaattcttttttcttttaataactccacagttaacaccctatactttggggcaattatgactaatgctgctatgaacgttcatgtacacactattgtggggacatatgttttcaataatcttgggtctatagctaggagtggaattgctgggtcatatggtaattctatgtttaactttttgaaggactgccaagctttaagcaggattttgtgtaaatataggatcatgttttccattttatttcagtactggaaactacatgtcaggataagaaccttagaaaaaatcattaacaaagagcataaaatccttaagaaaggacataaacttgaaagtaaagcttattgagaaccgtcaaaagctaaaggtggttttgaaacactgagcaattaagaatagtttattaaagtcattattggcctcagtcctttaacctcttaaaaaatgacccttgattggtagctttcttacattttgaaataattttagactcacaagaagttgcaaaagtaacacagagatgttctatgtacccttctccgctgccctcaatgatagcatcttaatataacaaaagtacattctcaaaaccaggaaaccaacatggttacaatactattaactaaactacaggtaattggttgcttttgggtttcctgccagcccctatttttttcctcccttctccttccaggttctacttggaagaaccagtttttaggtattgcttctgcaataaagttgccaccctgggtgacagtgtacatagcttaaatagacgaagaaagtcttttgatgatggctggataaggggttattttaaaggaaaccagaagtatcgagccctgggcttggaggcagacactgtggaggacaactgtgtcttcaggtgacttgttccttggttccataggtcaacagtcacaattctgaggtggagagggggtgcagtacagcctggcatccttgttctaaaccagtgaggcaataatttggttctagatctggatttaatcctgggatactaagtgccttctgctgtagtgactggaagagctgtctgctcatttataatgtgtgcaccagggccttaattttctgttcagttgtagtcctgttataatagagttgatttttatgtttcccttctttctttcagtttccagcacagaatagtacttctagggaatcaaaaaccatttgcatttattttgggatggcaaaggtctttatttgctgaggtactactttgtcttaacactttgaacaaaatcagtcttaagagtttttgactcaaaggcaggaaacctgagggaaaagaagaaagaagaaaaaataaataaaaattaaaaaaagtttttgaggctgggcatgtggctcacacctataatcccagcactttgggaggctgaaggggaggatcacttgagctcaggagtttgaggccagcctgggcaacatggcaggactttgtctctactaataattttaaaattagccaggcatgatggcacatgcttatagtcccagctacttgggaggctgaggtgggaggattgcttgagcctgggaggttgaggctgcagtgagctgtggttgtgccactgtactctagcctgggtgacagaacaagaccgtgtctcaaaaaacaaaaaagtttttgctggaattctcaactcattctctagaagtgtttgtcatttgatatatatccctaaggaaaatgccaacttttcactttttattaaagggaaggcaaagagaagaaagctttaaaaatacatttcagatagaatgctagttgatacccgattacagtggaagaacctgtacttacaaactgagcagtgcagaaattctgtgcaaaatgcagttggagctggctactctggaaccaggaacaagcagaaggacatgaggggggctgcctggggtagcatttcacaggtgccaggtgatcagcttctgttttgagtttgccatttctctggtcctgcccctggtcctgaggctggcaggaattacgtggaacagccccagagagaagggatatagctacagggatacatgagcctgtagagaccctaagtggagagggaaggagcagagaaggatgaatcctgacacatgggccgggatggtgtcaccagagacgggcacagaccaagacaggcaaattaaaggcgagaagcgcttcccactctgccgggcagcgggaggtggcgattggcttaaagtctcgggtgtttttaaaggaaagcagcgtggccgggaaggagttggaagggaggagagtgcttaagcgtgcatggttctggaagtgtacccaaagttggaaaacatacccaagaccttctctcagcagaaagtgcacttcacatgcattaatggcttcaccttcaggctgttaacgttagaggcctccctttttggggagttgttggtacactggaagcttaatgcccacaccatggatctgaccaggaatgtcagtccctccaggatctgctgacagaacattctgtcattgccacggcctattcaggagtctgtggcatttaaaatcaagtatattagaggcagcaataaaccctcattctgaacatcagtggtgttaccatctttcttacatccctctctttctggaaaaatggcacactatttctttttaacaactgcagccttcctttgggaagggatgtgtgcgtgtgtgtgtgtgtgtgtgtgtgtgtgtgtgtgtgttttcttactgatcaatttctcttagaatgtaatgccaagaagtttcttgcttcagaatagatagcctcttaggatacaaagggacctatatatcatgccttctttccctcagccctcatgtctggaaaatttagggttaaatttgtatgcccaaggctgtagctgttgaaattcaagttgctggcaggattttctgtctctctttttatcctcacaggaaattgcttcagtaattgacttttgggaaaaccgaggccaaagttttctttgtgtaggaacatttgtgtggtgtttatctcttttaatccctataatagttaatatcctccccacttgactgatgcagaaaccgagcagtgagttgaagagagcctgagttctccctagtccttggtgacagggtctggattcaaacccagctttcctgcttccaagcctctatcccatagatgcctctcagcctcccggaatccaagccaattatttgtttcctggttttaaagtgcccatctgttaatttcttataattcgtaaaaaagtagaagtagattttggataaaataagttgtaggtgggaacttggggggacaggtggcagaaaatgcagaagacctgtgaaaagatcatggcatcaggcagaggaaataggattgcaggctctgtccatttggggtctgttgtctgcccatgcaagggccaaggagggagctcccttcccccaactcccccctcttccctgcccctccctcactgtgatgtggcacccaaggagccctctggcgggacaagctgtgtctgtctgaccaaaggcagacactgcagcagcctggaattcattctggaagaaaaccttgaacattcctctgtttgagtcagactctgatggtttttttttttgtttttttaaattattattattatactttaattttagggtacatgggcacaatgtgcgggttagttacatatgtatacatgtgccatgctggtgcgctgcacccactaactcgtcatctagcattaggtatatctcccaatgctatccctcccccctccccccaccccatggttttaaaaaataggcttataccaataggcaactcaaactccatcaatcctgaggcgcctagaacagtacacgcaaagacaagtcaggggaagcaggctcagagctgccactctgactgcaagcagtaatgatcataatcatacttcatccgtgcaagcctgtactgctcataaaacactgctctccctcatgagcgcatcataggcttaattgatgctgtgagcattgttacttccattttatatttcaagaaaccgtggcccaggttgcactcctattcaagggacagagctggaacttgaactaaaatcttttgatcattggattcttcgtgatctagttagtgaaatatgccttgttgtcacggtgggaggaggagaggaagcatagaggattgagttccctgcaagttaaagaagccttcagcttgctagttgtcagcttgagatgaaagactggttgctctgagatgtggctgccggcaagtcaggtgtagacccgctgggcaggagtgaggccacctttgctgttgtgcctctacacacacaaagaatctatccaaatttcaagtatgtatagacagttctactgcaggataaatagggcatctcttggcactcctgaaaggttaataagcccaaggcagatagaatgatctggtatgagttgagccttaaagttggttctaagtgatttgtttttagaaattatgaagccgggcgcggtggctcacgcctgtaatcccagcactttgggaggccgaggcgggtggatcatgaggttaggagatcgagaccatcctggctaacaaggtgaaaccccgtctctactaaaaaatacaaaaaaaaattagccgggcgtggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaatagaaattatgaaatgatttcaagatcattatcgtggcctgggtcttccagttattgccctgacttgagcctctctttgaactctatagggtgagacagaaaaggccacacctgccagacactagcttttctctttgttcttttcctctgaattaattccccttttctctgcctgttggctatcttattgtagctggtagacaaatctagtgctgtcttttctctttcttcttgttttcttttttcgatagagctaaaatttggaatctgtcttcctgtatttatatatgtagtttccaatgataatgagttgtgcctgtgatgtcccaaaacatcaaatatgccccccaaataaatactagtctggtaaatggcgagagaaatagaaacaaacacaggtgatgtggcataagcatgcatatttttgcccattggggtattttaaacaacgatctttgtttctctgccctcccttgccttgcacatctctctccccaacttggttcttccccactcaggcccacacccctcttttgttcatttcttccctgctttttgtttcaaacgcacattcccatcgtgactgggtctttctctggagttggtatgtggttggtgggctactctccacccagtttgtgttcatgaaattgtctggttcactgtccactgattactcaagggtctttgttgctgagaagacagaacactaccaaggagcctggttgttaaggagtttccttagaaatgctaagcccaggccaggcgtggtggctcacacctgtaatcccagcactttgggaggctgaggtaggtggatcacttgaggccaggagttggataccagcctggtcaacatagtgaaaccccgtctctactaaaaatgcaaaaattagccaggcatggtggtgggcacctgtaatcccagctactcaggaggctgaggcatgagaatcgcttgaacctggtaggcagaggttgcagtgagccaagatcgcaccactgcactccagcctgggcgacagagcaacactgtctcaaaaaaataaaataaaataaaaaaagaagtgctaagccgaatgtttaggaaggagaacccaggcctccattctcagcaccgtattcccttcaggcactttacttccaagaaaaatcttctgtgaggcacacaatcactaaagaaaagtaagaggcaaactagctttgaaagcaaatcccatccctcagccctcagcaggttgcacaacctctaacacacgtggcctctctgttggtgcaggtgacaagaccaccttccagctacaggttcgccaggtggaggactatcctgtggacctgtactacctgatggacctctccctgtccatgaaggatgacttggacaatatccggagcctgggcaccaaactcgcggaggagatgaggaagctcaccagcaacttccggttgggatttgggtcttttgttgataaggacatctctcctttctcctacacggcaccgaggtaccagaccaatccgtgcattgggtaagtgaccagttgcccttctgttgggtacttaagggtgggagaatggagaagcaggaaaatttagctcaaagaaagaattaaggaaggcatggttaggaggggtggccaggcttaggcgtttaatttgattaatgataagcatacattctctcctttcctgacgtgtgaagaagtgagtgaactgtcacaaggttgtaaagataaaatgatcacaaccccttgattttcctgcctgccatgcacagcaccatttgctcacattaatagaattcagaaaatgtcctcagggagtgatggatccagattatcagggaggcagcaggcagggcaacttaaactttccccttgcttgtagtaactgaggtgctttgggagaaatgaattcaaaatttgtccctgttgtttttctataaataactataacttattttcacataattagattaaaatcctattttaaatgtaagaatttttttttcaacataaacacctgaactagaaaagatttgacatattattagaaaacaggtgtctctaactgctgccagattctataataacaaagtgtataatggctcaaacttgctggaagtttatttcctgctcctcaagtccaactgggtctcttcatccatggaacttctcctgcaagcagtgactcagggactcaggtgctttccatcttccaggctttaccatcttccacacatggctcctaaggtcatgctgcctagagggtcatgcataggaggataggcctttgccatgcccgctcccacatgctattagacggaacaggactgagccaggaggctgggaactagtgtagctgtaggcccaggaatcagaagaaataggattagtgagcaggtctctgccatgggacgtttgtatgcatgctggggtgggtggttgtatgaggggattgcattcttcagcccatgcaacacaacctctactaggttggtttcttttctttttagtctttcaggagtttctttaaatgtcaagattatgcaagtgactgcagtgagtggtaacttccaactcttgctttcctcatctccacatttaactttagtgagggtttgtgttgtaaggtccaaaactagtcatgagataggaaataactaagacttaagtttttactaagtgtcaagccccatactaaatattttctgtggattatctcatttaaatctcataacaatctgttgaggtctctaaggtaagtgtaagccagattttagagatgcagaaactgaggcctagagagaataacttacccaatattatacaaacagcaaggggtagagctggaatatgaatacagacaaactacttttagagtctgcatttgcatttttttttgagacggagtcttgctctgttgcccaggctggagtgcagtggtgcaatctcggctccctgcaacctccgcctcccgggttcaagccgattctcctgccccagtctcctgagtagctgagattataggtgcctgccaccacacctggctgatttttgtatttttagtagagatggggtttcaccatgttggccaggctggtcttgaactcctgacgtcaagcgacccatccacctcagcctcccaaagtgctgggattacaggcatgagccactgcatccggcctgcgtttgcgtttaatataatgtcttcttccccattcaaatcacactacaacacagacactttaccttaggctgagtaataatacctgtccctaaaccaccctacccccatgtcctaggggcttacctgaggatcatggtaggttatgctgcagtaacgtagagtctccaaatctcagtggctcaacacaatgaacgttttttttttgttggttttttttttttttgcttgtgcaacatctgatgagggctgagctgctttccttggcagctctccatgcagtaactcagggatccagctccttccatcttgtgatgccattctcaattcttggtcttccagctgccaccaaggggagagagctgttcttaaatccctgagccctcccctctccacaagtcctctttggtagccttcagagctcctagctccaagttgggctgggtgataggagcaagttagtgtgctggtggcataggctcttctgaatccctccagatccttctgtatactctcccagaagctgacttagatcttttcaggtattgggaactgacactggtggaaaaacagacaagaaaaagttttaaatacaaatgaactctaaattctttaaccacgaagaggcactaggcatcatcatttgctgggtttagcttcctcctggcgacaggtggccacagggactattactactttgattctgtctccaaggcccttttcagctaagtctgggtgtcaaatgtttttgttgaaattttgctgcttaccaggagcaacagcatcttaactgcaagccttaagccttttttcaattcatctgaaatagtgattttatttgcttcttttcacctctgtcctaattgggccctgtctccagacagatagggtgtgtccccactttcattcttccaaggcccttccactgaccgagacactagattggaagctggcagagaatcaagggctggctctaggcgctcagcatttaaatattcaaagttatgacacatcattacttattcagagctcactctctaagtcctctaaggcagagcctgttgcagacagtaaaactcctgacagtgagtacaaggcacactgaaaagctacttgtaaggcaggaagtccagtgaagaatgagaatgtggaaggaaacctcgggcctgagttatgtgaagctctcttctctgagctggggaggcacacgcagcgtgggggcacactgtggcttggtgagcaggccgagctttgtctccccacgtccaggcagcacggcatcctgtgtctcctgggttcaagtgattctcctgcctcagcctcctgagtagctggtattacaggcacgtgccaccacacccagctaatttttgtattttttagtagagatggggtttcaccatgttggccaggctggtcttgagctcctgacctcaggtgatccacccacctcagcttcccaaagtgctgagattacaggggtgggccaccacgcccagcctaaagtattttaaattattctgtttctgtttcttgaattgtggatccttcaggtggatccacagccagtcagtgtattggacctgctgacatgccttcatgaattgtttttcatgcaatttataagcttttcattagctcttccttggaggttgtgggggcatccctgcagagcagttttatgtttgccgttgtcgagaatctccaggttcaccgtgggactagtttttctgttaatttttcaattggagatgtcttcaccataaaagcagtgtattccaattgctcaggcctggagttacagtttttatgggtaattcatctcattcatggtagatggtcagcttccgtgctgctttcctagaccagtagctggagtttttctgtttctggttttagtagcacagcagctcattgtgctgttcggctttatgcagacagccctattccagtgttcagccctctgcaggactgaggctcagcatctattcctggtagaccctgctccaagcctgtagggcctcagtcaaggcctgacccattgcgggggtccttggcatgagtgcctgcccatttcctaccttttttttttgagaccgagtcttgctctgttactcaggctggagtgcagtggcgggatctcagctcactgcaacctccacctcctgggttcaagtgattatcctgactcagcctcctgagtagctgggattacaggtgcccaccaccatgcccagctaatttttgtatttttagtagagatggcgtttcaccacgttggccaggctggtcttgaactcctgacctcaggtgatctgcctgcctcagcctcctaaagtgctgagattacaggcgtgagccactgcacccagcccccacctattcttttaagtccattcatttgttttttggtgttttctttttttttttttttttttttttttgccaaaaccaaatacttctgaaaggtccattcatttattgaatggtttcctcttcgtttctgggatttactttctaagcttccagcctaggctatatattaaaaaattttaaattacattttatccagcagttgtatatgtttagagttagaagaagcagataagatgttttcattcctgttccatgacatggagagcctttccatgtcagcttgatccatgatattctcctgaggcattagattgttttctggatttgcctaggtctggtgtcttcaaattggattcactttttatacatacagacactcccttggctctttaaccatatatattttattttttatctcccttgttaataatccttaatttagtaactctgtatgcatggcgcttatttggggtctcacagcacagacacatgagaggggtaggatagtctcctggcatgaccccagaacgtccggatcttcaggccactcagacagctgctctggggttaagtcagataactcatcacaggtgacatcctattccagtgtcagtggagactctcctagcgtctgtgtgacaaagctcttttcctaagtgactctgacttggttatagtaaattctctacaatgaaggcttctctctggcaaacacatcttctaattcctaactacttaacagtcattctttgcagtaaaaatgtatctgctcattgctgtttgcgggagtgaaagggaggaggtaaaacatgctgagctgtagctgagtttgtcacagctttcctggttaaacagcaatcattattcagtttcttttctccctgtccgcaaccaaccggaccaagtgtaaaaaaaccacacacctgaagtcctaaatcatgggccagagccacataggccagggcaggatcttggaggaagagagagggggagagtttggatagacttacttccttctgggcctatgatccacttgccaaatagctacagatgggacctcagttccttcttccagctgggaatgtaatttccatgattgttcttttcatgacaaaatgaggaggtaatggaaagtttgggtggcccgaggctgaggttaaaagagagttccacctgtccaagtacaaggtgttcatgaagacttcgggaaaggagaagggagaaacacaaaggaaagccaggcagggagatcccatcgctgccgccggccccgagagggagagcgcgactatcacaggagtggggctgattgattctgtgcagggtgggcctgttgctggggactctgtgctgtgctgttgtgactgtgtggatggagaagggactgtagccctgagagggaatggaatagccccttagagaaccaaagattgcccctttacagaagggagcctgcccagacctgccctggtgagtctgctttttgacagcatttaaggcagggtcctcctagctgttgctaaggctgttttctttcccatgtatgcagcttgaattagattataaagcctttccctcaggcctgttagtgctcgttttccatcatttatcctgaaagagcgacttccttaacatggctggagaccctgcacagtctggcccagcctgcctcccaggctcctcctcgcccatcctcacccgttactctgcaccacagccccccgacctccctctgtccttgggctctgtgctcccttctgccacaggactcttgcacatgctcttctctggctgggacactctcccctcttccctttactttgtgaacccattggtaaaacaatataagctctctcttccaactttattagttctagatcaagctgaaactcttagagctgtaatggaaagtaactcccttcaggaatagggccacttggagtctccacaggagactgaaaaggagatcaccccatatttcaggagaaaggcttggtattaacctattattgatgtgtaatacttccttcttttgtaatttccagacataactttccatttgaagatgcttagtttctaaataatttttattgcatttagcagaattgatagtttgttggtacaatatttagaaacgaatgaagaagcagataagatgttttcattcctgttccattcagcatttgtccatgtgcctgcacatcctggtcactgagtggattgacatgacgagattatgtgatcctgtgatcctttgttgcgtggcagcaacattgatgtagaagctggttgcatggagtaactgcacttacattgccctcactgggcatcatccatgttccttagcccagaggacacttcctctccactctgcctaggctggcccacaccccgggtcccacatacctttcaatgcctatgtcaagtcttcctccaaccacagtagcctactattatctctgtttcctttgaacaatttgtccataccattcatttataacttggcatatactgccttgcctgcagtttagggctgatgtttggagaacaggaactatgttatttatctttgctctctctgctgtgcctgtcctggggcatgtggtaggtgctgggtaaatagttattggtgcctctcaaggcactcagtgaatgctcagaacacttggttaagatttacagacaatgatggaaaagtgactcttctcttcttcctctctagttacaagttgtttccaaattgcgtcccctcctttgggttccgccatctgctgcctctcacagacagagtggacagcttcaatgaggaagttcggaaacagagggtgtcccggaaccgagatgcccctgaggggggctttgatgcagtactccaggcagccgtctgcaaggtaactttcctttctggtcctgtccctgcatggggaggtcaaggtagagagcgtcagtgggtgttggtacttcctgcaggagtctttgagtgccccagcatgtggctcctgaccactctgaagtcagagggtgagctcagtggaacttctgggaaatctacagcagtcaaatcagccggagctcgggaatggattgggctggtctgtgtctctgtgtcagggtgtggttgtgtgcaatggagtactgtctgctagaagacagctgtctgcatttatacattggctttttggtttattttcaggggaaaaaagtaaaggtcaagtcataggcatagaagcttgtagagctttctggaccaattttggcaaaccttagagattgctctcttgggaaacccagttgaaaaagaattgtgtgaggccgggcgtggtggctcacgcctgtaatcccagcactttgggaggccgaggcaggtggatcacgaggtcaggagttcaaggccagcctggccaacatagtgaaaccctgtctctactgaaaatacaaaaaaattagccgggcatggtgacgggtgcctgtaatcccagctactcgggaggctgaggcaggagaatcgcttgaaccaggaggcggaggttgcagtgagtggagattgtgccactgcactccagcctgggcgacagtgtgagactctgtctcaaatttaaaaaaaaaaaaaaagaaagaaaaagaattgtgtggcatctttggttgcaattctagttgttttcctcctgcttctctgtgatatatgaatccagagggagggcctagacttagatcagaaatgaactcatgcttcgagaggttccaatcttagcaaaatatataaatggaatgttggtgataacatagtcttaaaataattttctactgttgaaacaacccaataacaataacaaaaaaaaaacactcttaaattcactatcataacacatactttaaaaatctgtgagtctcttcttagtctttgtgcatacatttcatattttttcaaagtggtcatcaatagagtgtgaataattggtaatactttcttgaaaattcaggcagattcctcaataggtggggactcttccatttggtgagggcagggtcagaggctagaactcagtctagagagcctgcatatggcagctgctattcacttattaagtgataagcacttaattgctcacttacacagtttctgacctcagagcctgaatctggtgtgtcacacagactcctgtttcctctccactcaatccttgacaagatgggaagaaaaccccagttgtcctttctgaaataaaaaaccaaaatggcagaaggaaatggataaggagaaggtaaaatgtaaagaaagcagcaacagccatctgccattctcttgatcccactgtggttctgcccatcacagagtctgtgggcccctcctggagaagaaggtagcagtggcttcctatccaggaaggctgcagtgtggcctcttcccagctactggccagagccaaattgtttgattcagaagtccctggtgtctcttagcagtctgagagagacacatggaaacatggttagaatgtattcagtcctgaacctttcaaatgtttcacaaaatagtttatgaatttgattcagaaagaaaaattatatttttgactgactttcagatattgactataggaggcgttttctccacagacattcagccaaattctgcttcttggtagggaaaaaaatagtgcagagaagacataggatccccctcatctccccaccttgaggattttatggattttctttttttggagagagaaattcatctttctctggagaaagaacccaattacaggcctaagcagtgtctgagtatattttattcaattagatgaattgaaagggcatgattgatcacttggaccacagtggtctttgagaagccatttgatccagtctatgtctatggaaccttcctgtgccatccctgatggatgaaatcttcaaccctttgaaaacacagtatttcaagactcaagcatttcagaggcgatgctagcagattttctcagttcattgtctggacctggtgaattattgttgacggagaggcactttgtgagcaagtttcaggcttatacctgttgaaatttgctctttattcctcaccacgacctttgcaaaagggaatacctggaaagttaatgattgctcagaattatgcagccaatgtgcctccagcatctctctttgccttttcttttccattgtgctgtcagtttatgttcaggtgcatactaagcaatttatttctcacttgacatcacctacttataaaacatgtcatccttcctggctcaccacagccttatggtgacaaaaaattggaagtagtttatggactacttttggatgaaagactacgcaacagtcatactacttaaaatatttaatgacttgaggctgggcgcggtggctcacgcctgtaatcctagcactttgagaggctgaggcgggcagatcatgaggtcaggagatcgagaccatcctggctaacgcggtgaaaccccgtctctactaaaaatacaaaaaattagccgggcgtggtggcaggcgcctgtagtcccagctactcgggaggctgaggcaggagaatggtgtgaaccccggaggcggagctttcagtgaaccgagatcatgccactgcactccagcctgggcaacagagcaagactctgtctcaaaaaaaaaaaaattttaatgacttgaataatatgtaaggtattagtatcagatggctttaatagtaactttgctctctcttggctccctcttctaggaaaaattgtccttagggaagatacaacccaatgttttatgttttaagaatttccagaataatatgtaagataaattaagattggcatgggaagcaggttataaaacaatatggacagtatacttctgttttgcaaacaaaagaaagaaaaaatgtggaaaagattggaaatggaacaaaatggtaacagtggttgtctcaggtgacaagattatatttttctgataggtgataggcttattttcttctttggctttttgtttaatatttacctaaatttccacagtgaataagtatgatttctttttttttttttttattctggaacagtttcagaataaagaatagtgaaatgaaaccccatgtactcattgttcgtctttaatgattactaactcatgaccagtcttgttgcatttgtattcccaaccacacccatatttgaagcagatcttggctatcatttgtaagtcctaagtatcccttactttgtttactgaatgctgtgtctcctcctgatctggccagattaaaggcccttccactgaatcctgcaaacagtggaacagagggagaaggcctggaatcttgtgcagttggctctgtgcgtcataggggctggagttggccaggcaattccccggcagcgctgcacgctctacttcccctgaccctgtgccctggagatggagctgataacaggcctatctcccagcgccacagggagctctttgtcctggttttattctcactctggttttattctcattcttgtttccctgaatggactgttagttatcaacttgtgggatttaggggtatggaatattcacatgtctgactttaaatccacctctgtggcctgctcttgaaagatgttctttgcaaaaagaaggaaactacctgtttctatttaggattcattccatttatgataaggaccctgtttctatgaatggaggttttgagttgctttatttatcccctgcaggtcacattgctgtgagaggccatctaacagcatccacagctaagggatgcttctgtcgtcaaggcgggcattttttctaatgcactgttcctggctgggttggagttggagaatgccactgcctgtaatttcttatctttacccagagcctatgattgaacctgtttatacttttttatggtcagaataatggtttctctgccaggaccttctagaagttgactctaagttgtttgttctgaaattgtgcaggcggaagtgtgatgtgtggttcagactggaaatatggctgctttcctcttctctcaaaacagggcacgcccttggcctagggaggacagagggtgagcagttgcctggaagctctgggtcccaagttgtcagttatcactttgctcttcttcatggctctcaggttaaagaagttacttgtacatttgagcttggctgggtacatgctggctgcacagtattctatgtgctgctttttttcgtcagccagaaaataaatcagtgcaacccaatgcgtttccctgtttgtctccactgctagagccctggcacttatcctttgtattctttagacagagtttctgttttaatcctgattcttttaattttgcctgtgttcaatttttaaagcatttatttcctctcaaaaatagttggatgagtaagtcttaaagcaaacaaggtaaatttatgtattgaataaaatttttttggcaggaattgagacctttattcttccctggccagaatatcttatctaaaatgaagaccacagcctcagaggagccgtgattcttgttggaggatccttaccagaatcctacagtatattggtaggactctgataagggttgttcccattttacaggggtggaaactgagtatcacagggactaattgcatttagtaaggagtagaaccagaatgtgaaccagttctgttgatttgaaattctgtgccctttttattactcagtgactgtgtgctctgggaagtaacaataatgcactattgagtaaggggcactgcatttatttatttaaaacaatttttttttctttttcttttttttttgaaaggagatctcattctatcgcccaggctggagtgctgtggtgttatcatggctcactgcaaccttgcccagctaatttttttgtatttttagtaaagacatggtttgtccatgttggccaggctggtcttgaacttctgggctcaagtgatctgcccacctcagcctcccaaaatgctgggattataggtgtgagccactgcacacagcctgttgaattttttttttttttaataatacattccaaacctaggaaggcactgaatttagagtcatgttttccttactcaagctctgcctcttctgttatcggctgcctccatggaagccagttgacttctccaggcctcagagagcacatctgggagatgcagggaggcatgggactggagggaggtgctccaggttgccttccatctgtgccagccagtgccacttctcgcagaggacttggtcacagccctgtctcctttgctcaaggcctttgattttgcttttttgtctcttctggctcaggcttaagcctcagacccagtagaggctgctgcagacacctgtaaaatgtggaaaattccccagtcccagagtcaggcacaactttgtcagggtttcctcttgctccctcccagctcccagttcctgcagaattgactcgctttcttttgacttattgcctgatttcttttagacctcagacttgtgtcacttttccaagcatgagttgagaaatacaggaaattgcctttctttcctcaaggaaggcatccccccactcctcaaacctctgcaccacctgaagagagggacccgccacatgttctgcttcccagctgtctgcgttgtctgtctcagcatgtgtgagctgcttctgctagcagatcgcaccacaggtttccggggcttgatccagcgccaggctgcctgctcttcctgtgctgccgtgtctttggggaagcaccattaaagtattggatttctctgggcattgcgcatgcaggtgtgcagaccctctgccctgtagggttgttgtcagacaggtgtggcgcagcttccccttggctttctatgtggcagacggcagtggtttcatgtgcacttctgaatccttctactgttttggtctctgaggcgacatcccaagtgcaggactccgtggtttccttgctctgccttctgctgtgagctgtgttgtgggctccgcagccccaccgacagctgctgttctgggttgagcggtgggaactggctgagtcataactcagtatcgtgaacagggcacgtgggagagtttgcgtttctttttgccctctagtgtaaacaagtcacgtgcctgccttgcacctgtgcttaggaggtgtctacacgtgctggtggctcccttcactgaccaaggcagggaataatcatcctggggaaagggtaggaggcccctttgatggctggggctctgttttcataccaggtgagaatgtcaattttttattttaagtcagaggctccttcttgcttggaatgtccactgagcaaagatgaaaggagacaggaatttgctcttgggctcctgttgcaaggctctctgcctgtggcctctacctgtggcctctgcattccagccacagtgacctggagtgcgttactctgactcaggcaaggcctttgcatgtgttgtttcctctgtttggatactccattcctgtattcctggttttctttgatactacttccctgtattcctggtttgcttgcttgcttccttccttccttctttcctccctcccctccctccccttcctcctgtccgtccttccctccctccctccctccccatccttcccttctctctctctctttccttccttctttccttccttccttcctccctccctccccccgctccctcccctccctccccttcctcgcctccctccttccttccctcctctccctccctcccttcccatccttcccttctttctctctctctttccttccttccttccttctttctttctttgtttccttctttctttctttctttcagtagattttattttttatagcagttttaggttcatagcaaaaatgaatagaaaataaagaattcccacaacttccctctgaccactgcgcacacaacctcccccaccatcagcattccacatcagtgtggtatatttgttacaatcagtgacccagtcagtgttgacacatcattatcaaccagagtccatagttcacattagggttcactcttggtttgtacagttctgtgggttttaacaaatgtacgacaacaggtagccaccattaaatatcacacagagtagcttccctgccccggaagtccctgtgctccacttgtccattcctgcttcctcccccggaatctgttttccttttaatgtctaacctgtgcctgtttgtgtttcagatttcagcttcactgtctgtttgtcagagaagccctccctggtggacttccctgagtaggtcaggatgccctggctccaggcaagcccttaatcacttctgtcctagttatcatcttatttttatttatttgaagcattcctggaatgcctgcctccctttgagatagtaaactccctgaaggcagggactatgtcttttttcttatgactatattcccagcaccagacactgctgggcacataacagatgcttgttaaacatctgggaacaaaggcttcattctcacaggtgcctttatgcttctgaagttcaggaataccaggttcttctggccccaagcttgtcccgtcctggatgggacttccaccctcccatccaccaggctgcctccatggaatttacagtgcttcatgcaaattcattaaagcagaaccagaagtactattacttggtaatacttttccattcagaaagcatttattggctgtccaataaatgctcagtggcaggtatggtggagaaaattaaagatagatgagaagtctctatcctctgggatttgatttgagcctgcagatccattagaagggaaataaaacaacctgtttggaaacattagattgaaccatataaaattattgatatttattgatgatatttgttatttgcctattgatgtttttcctgcaaaaatggaaaattcatatggttcaaccttcttcattccaaaatgttctataattcagattggactgtgtcacagagtacagattagaaatgtcatcctgcacattgctgggatttgagctcaagaggaatgtctgtatcctgagtcataggccaagatttctttttcccaaggaaagaaatgctacacttttggcctcattaaatttagccacagaacagatttttttaaaaaagatatttcattgcaaacagtggatggaagtaggaaaaacaaactaaaaagaatgtgtatattgttttaaagggatggaaatatgcctgaatgtcaacatgattcgggaaaccaatcacagagaccctctaaccttgttttcccttatgtgctgtggagactcctctgtccccaagctcagatctactgtgggagctgcccactggctgcccaggtcagtcccctttccttcctcattcctgccttgaaacctgtcccctcttcctcagtgcttgcctgaaaggttaatggacagtgttttgttattacatttgaaaacgtcttgagtacttactgtgtacaagacgtcctgttaggtgctgtggggaatgcagagttgaagtagccgtgatgcctgtctccatgagcatcactctagttgtaggactgatgtatgtgtaggatctaaggcacagccagagaacagactctgtggaaggactggctccttcagacccgtggttcagttagagtattcttctctctcaaggggtcatcctggtctcttgcttcctggtgaggtgctggtgctaatgatgctgttgatcaccactggctgagtgcttttgagagccaggctctgtaccaggcatttaacagggtttctttcacatactcctttgaaggtggctttactatctcctttgatgaggaaacaagcctagaaaggtgaagtaacttccccaaagttttacagccacaaaaggcagcaccagaattggaaaccttatctacctgctggtatggcttaaccttgacattagagtatctgccatcttttgaagtcacacaggaacacagaagtgggaagagtgtgcttccaaagagagcacagtcccagtctatggaaccatcacaatttacccacatgacccagtttgccaactgtagaatggtactgaaacagtcccaggggaagaaagttgcatgtgccactcttttctggagctaagagtttcctctctatcagaaacagttatcatgtgactctatcagccctcaggattttccagggaggccactggtactgtcccaaggttagcatgctgatggatatgtgaaatgcttatctttgcctctggcttccctgtctgtaaaatggaaactctgatatctgccttctcattcctaatttggagggtgtctcagacccatcggctcttctcccttgggcttgctcagatagcactgaggcacaatgctgcttttcacgtggtggatcttttccagcagagagagtacatgtgcctggtgactcttctgtgataactggggcccctgggctgcgttgataacagtcttgagggcctcttcatttggacaattgttaattttaattaggcagattgacctcgggatcagagaacctagaaatttaaagctacagtctctgggatggcatctttattccagaactcccttgtgtttgaactagcaagccaagctcagtgagccagcccatgttcaggcaggccccacttgtgttttccgacagctgagtgggacgttggctttcctcagattcccaagaattgatggtctgggccttcccctgcaccttcccacggggcgtccttgaatctgcctgtctcacttgtcatgctctgccattgtccatttgcgtaaataagttactatgaaatggacctggggatccccaggcttaacatgagccagtaggaagattcagctgccaaacacaggcctcatgctccaggtccaattcagagcccacaggccacttttccagcctagttcctctgtgcaggtcagaccacatccagggaaccatgcctggcctgcctctgggagctgtgtttaagacagacattgacagcgagagagcagaggggataagtgggtggtgccgggcatgggaaccacatcctcagaggagagacaccataggaagtagcatggtaactgacctcagatatcattataaaagagggaatagacccttttggctattccaggggatgtactagggtagccacaggaaagcaggttggagtccaatgtaaggaagaattttcttgtttttttgttgttgttgttgttgttcgtttgagatggagttgtgctctgtcacccaggctggagttcagtggtgtgatctcagctcactgcaacctctgcctcctgggttcaagcaattctcttgcctcagcctcccaagtagctaggattacaggcacgtgccaccacgcctggctaacttttgtgtttttagtagagacgggatttcatcatgttggccaggccggtctcaaactcctgacctcaggtaatgcatctgccttggcctcccaaagggctaggattacaggcatgagccaccgtgcccggccaaggaagaattttctatcaaggagagctgcttagcagtgtggcagtgagtatgtgtgtgggccccatacccaggtggcagatgctggaggaaagatccctgcactggatgggaggctgtacaagaacctctgaggttccttccagaattcaggtgctacatgttttctctgtttttctacacagtcatccattggtgcttttgtcctgttgtagccccttggagcctgtcttctctggttctcagcagtgcaccctctaagctgcccctgtatttggccacagtgaccatgaactctgctatacatgttcattttatttgccaagtgcagctgactttgagctgacttcttcctggctcctgttggcttcccatggagccaccttaccatatgggtgaaagtcaggtgggacagagaccagggaaaaactgtggagggtggggcagagaaggatggaagctgttcttggttctctgtgtgagcttccttttttgtcagacctgtagccagagtgtgactcctttcagccttaagaagccaaattgctccacaggctggaagcttgcgtcctcaaactagtgaaaccaggtcctttactccctaaccatttgtttctctctctgccagtccctgttctctggggccagatgttggaagtgaacaagccagcgagtctgtcttcactcctgggaggagtccatttttgttaattttctcagtgactgggaagggctggtcttccatctcattcctgcttccccttttcatggatgactgagagtgaggtcagattttaaggaactgagaggaggaaataggtctgctggtcttaaaagagagaggcgagtgatgagagtttggtggcgtcgcagggtgaagagaaggcttgttattagtgggccatgaacatatttgtaggcacatggaagggaccagaggagacagtgacaatggaataaattctccaaagagggtggggtttgcagggctgtgtttcctcaaggagggaggagcacttcttcccttgggatggtgagatcagagcgaggctgggaggacatgccagtttgtttcagacggagaggagagcactggctgaaaggcatcctagggcctaggaccagaactgtgagatcctgggaataggtgaagggagaagtccttttacctatctctgtgggtgacgaaacaagtgaggtcgttccctcgcatgagtgtggaagcaggagttggaaatagacctcgtggtgaatttgacagtgaacaaagaaaagtgacaggactcgcagccctgaccggatgcctggcttcatgcatctgcgtccagtgcgtttccgccccacgcgctcctaacgctttcatctgaggctgacctctgtcatgtttagcgaaattggttttgtttacattttggctttacttaaagacatagagaaaagttcagctaaataaataggtcttctccttcttttaaaaactatttataaaaagagaatatattcaacataaaaaattagaaaatgtagataagcagaaaggaaataagcatcacccataattctattaatataaagataagatgatgtttttctgaattatagatataagtgacagtttttcaactccgtggaaatactatgatgataactattaattactattgatcccataccagatactgaatggggtgctcaatgtgtatcatcttctttaattctctcaacaaccctattttatcaatactattattacctccctcttataaacaaggaagctgagatagggaaagattaagtaagttgtctaagatcacaaaaacaagataagggagacatgggaccgaaatcagattagccagatacctgagcccatgcacctaaattctgtgtgaatactgctattaaataaaaaagtatttgggcccagtgtggtggcgcatgcgtgtaatcccagcactttgggaggccagcactgcgatggcttgagcctaggagttcaagaccagcctgagcatcgaagtataattgatgtacaatgagctacacatattgaaagtgtacagtttaacaaattttgacatttatgtacactcacgaaagcaactctgcgatcaaggtaacaaacatatccttcacccctaaaagtgtatttgtgcccctttatcatcatttcttcctcttctccctcctgcctcccttaccccaggcaatgaatttgctttctgtcactacacactagactgcatttactcaaatttcatatgcctagtatacactctttttttgcctgccttatttcccttagcagttattttgagattcattcacgccgttagtgtatccattcattccttttgttgctgagtagtattccatcgcatagatatgcaacagtttatgtatccattcatctgttaatggacattagtttttgcctgttatgagagagctgctgtaaatgttcatgttcatgtctttgtatggacgtatgctttcatttcccttgggtcagtacccaggagtgggatggttgggtcatatggtaggtctttaactttttaagaaactgccaaactgttttccaaagtttcacgcacgtccctgtgaagagaccaccaaacaggctttgcgcgaacaataaagctttttaatcacctgggtgcaggcaggctgagtctgaaaagagagtcagcgaagggagctggcggcgggggcgttgggggggtgctgttttataagatttgggtaggtagtggaaaattacagtcaaagggggttgttctctggctggcaggggtgggggtcacaaggtgctcagtgggggagcttttgagccaggatgagcgaggagaaggaatttcacaaggtaatgtcatcagttaaggcagggaccggccattttcacttttgtggtggaatgtcatcagttcaggcaggaacaggccattttcacttcttttgtgattcttcacttgctgcgggccatctggatgtatacgtgcaggtcacaggggatacgatggcttagcttgggctcagaggcctgacacaaagaacatttatcattttacattcctaccagcagggcgtgagggttccggtctctacatatctttatcaacatttgatgtggtcagtcttaaattttagatactgtaaaggcatgtggtaggatcttattgtagttttgaattaatacaaggcttttaaattgtttagcatgcaataatttatattccctgtaacagttatatagcttcacatatcaattagtaaaaggagaagagaagaaatgtaaaaattattactggtcctggaataataattacaagttccctttatagtcccttttgtgtgttaactataatactttttaatacatcctgtctaaacctagcagcagctctgcaaagcaggcttatttccattttacagatgaagaactgaggctgaggaggtgaagtgactgactgaggggcccacagttagaacagagcaaagatttgacctcagaatctgttccaaagctgatgtactctggccctcatgctatattccatttgtagttcattgtttttttttgttttgttttgttgttttgtgtttcaatccactttcccacttttgcttccttccccaaacgtggaatacagaactcaagccttcaaaacagctagctctgccagccaacccaacaataagggaaattatttttaatgtaaatactctgtggagtcaccacttgtaaagcctccaagcctgaaagcctgggtgatgaacgagcatgtcctgactcattcgcagcagcccaacctctgggccaagtttgttaacaccatttacataacaagagcccacttcacagaaaacagaattattattcttatgctgagccatccttcacttgtggagctatttccattttagatgcaaccttccattcaacaaacatttattttggatccagcagccacaagttgagagcccatcatgaaccaggcacgtttatgaattatcccatttattacatgcacagttcttctctgtatacgaatgtgggcaagagtttggtcatctgaatctggcttctctggcccttgctagttgatgggctggtcacttcatctctctgaacaccagtttccttacctatgagattgcaatatattacctatgtcacaaaggttgcagtgaagattaagtggaataatggaagtgcacaatacatgttttatattattattcctgttctactgataagaaaaaagcttttgaggtgttgaatagttggctgaaactgcacaggtaagtaggggcagcaagaaaattcacatgctcatcagaaggcacccgaattccacattgttctgtcttcttactgccaccccactttgtgtccccacaagaccctcaagaagctggcgtggaggaactggagactgaagaagttaaatgacagagccacattcagagcccagttttgcagaagttgtgcccgcctattaaagacaacttggaaaataatgggaaaacaaaaaattgtctataactttaaccccagtcccaaccacaaccacattatggggtattttgttctcttaatggagagttatgcttgtttcttaagtagtttgtaatcacactataactatagtgctgaattctttgttttcatcttatattgtagatatttacatataattttatcctttctatgaataatttctgatggctgtagaggagatatctgagtttatttaccttttccagcacagtaggatattcatgcctttccctttttctcactattaataaaaatactgttgcatatatttcagaatacttcttgtggatagattcccctgaagtagaatcactgagtcaaggataatttacacagagtaaaattgaccctttttaggtataaagtcttatagccacccccacaattgagatatggattatttccatcaccccggaaagtttcccagcatgcctttgtcatccatctcctcccatgaccctaagccactttggcgactactgatctgttttctgtacctgtatttttttctttttctggataccatatgaatggaattagccttttgagtctggctttttgcccttaacgtaatgctttgagattcatccatgttgtggtgtgttatcagtagtttgttcctttttattgcagtgtagtatttaattgtatggatgtattatgatgtgtctgttgattactgatggacatttgggttgtttctagtttatgatgattgcaaataacatttttataaatacttgcatataggtttttatttgagcataaagtttaatttcttttgggtaaataccaaagagtggaattgctggattgatagtaagtgtatatgtaactttgtaagaatctgtcaaactgttttccagagttggtgaaacattttgtattctcttaggcaattatgagagttctaatctttccactttttttttttttttttttgagacggagtctcgctctgttgcccaggctggagtgcagtggcatgatcttggctcactgcaaactgtgcctcccaggttcacgccattctcctgccttagcctcccgagtagctgggattacaggcacccaccaccacgcccagctaattttttgtattttagtagagacggggtttcaccgtgttagccaggatggtctcgatcttctgacctcgtgatccacccacctcggcctcccaaagtgctgggattacaggcatgagccaccgcgccaggcctcgttccacatttttatcagcacttgatactgtcagagtttgtttgttggtttgctattcaaatacggatctaatggctatctcgctgtggttcaaatttgcatttccttaatgactaatgatgttgagaacccttttgtgtgcttgtttccacccatatctcttctttggtgaattgtctgtgcaaatcttttgaccactttttaaattcagttgtttgggttttttcttagtgactaatgacagttctttatatattctgtaaacaaatcctttatcagattttaattttttcaaatattttctcccagtctgtgccctgtcatttcattttctccacagtatttttcaaagaaggttttgaacaaataagtttttgttttgatgaagcccagttcatcaactttttatcctatgaatcatcttatctaagaaatctttgcctatgtcacagtcacaaagattttctcctaggtttccttcagaagttttatagctttaggtctacgtttaggtcaatgatccactttgagttaatttttgtgtgtgatgagacatatgggttgaacttcattttttttgcatatgaatatccagttccagtatttgctgctgaattgactagatatgtgtggatctatttttgctctatctatcccagtccactgatctatgcattctgtcattgcatatattttgtcatgaccatagccttgattactgtagctttgtaataagtcttgacctaagatacgaagtcctccaactttgttctttttcaaaattgttttgctagtttccattgcttacaatttcatataaatattataatcagcttgtcattttctcaaaaaggccttctaggcttttgattgtgattgtgtcaaatctataaaccaatttgcagagagatggcgtctcaacaccatcggctcttccaatcctgaaatgatatctctgtccatttatttaggtttctgattttccttaaggttcttaatacaatttgtcaaattaaaagttggttttctgcttccttgctagggtgttgagcacatggctgtgcccttttggataacagattcacatgtttcctgcaaaaaactctactagtttatactttctctctattgtattttatttcccaagcatctggctccctcttttccacaatccatggcttataatgcattgccttatttatttaataggttttaactctttatcaaaatgtacacatcaaaaactatagttatatatatagtttatatatatttatatatagtttatatatatactatacatctcgataaatgctcataaggtcaagaaacagaacatcaccagcaccttgaaagcctctttgtgaccccttccaatcctgacagcaaggagaaccactattccaactcctacccataagtagttttgttatggcttagcatttcattgcagtaagggaccttctaggcttctcactccaggttcctaaaatgtgtctggcctcttcactgtgctcctttcccctctgagcttctgttagcgcctagaatgcccacttcctcttctgccttctcccttcttattccttctttcagcttcctttaatttttttaaaattatttgtttttatttttatttatttatttttttacagacaggatcttgctctgttgcccaggctggagcacagtggcatgatcatagctcactgcagtctcaaactcctgggctcaagtgatcctcctgccttggccacctgaatagttgggatgacaggtgcacatctccatggctggctaattttttaatattttttgtagagatggggtctccctatgttgcctaggctggtcttgaactcctggcctcatgccgtcctctcacctcagcctcccaaagtgttgggattctaggtgtgagccatcccaccctctttcagcttccttgaagtgtcctcctcattttttccagctcagtttaagtttcgtctgcgctgggaagcctctccctcctcctcctctccctggcttccattagcattggactttccttcattaacactcctgtcatggtgtattgaagttgctgtttccatttgactataagctctttgaggtctggaactagcttttctgtggacccagtgccttctgtggggcctggcatgcagtaagagatcagtgattgaatgctggatgaatattgagtgtctaggaaactgattctccaaaaggctaatccctttgttcactgtaggtctcctggctgtcagtcctcactggcttcttttcaaacttcttttcctcctcatgttggcgggctcttttgtgatttatttattttttatttccatgccgcctctggagcaagtgagaaaatatcatagctcttttggctgttttatccaccattatgatgataagtaagagaggatgataccctctactcttcatctgtcgtaagagagcaatagcttttaacctgtaaggtctgtgaatccagtctcctatttcagtagcaagtgtgcaggtatagaagactctcagcagtgtttaaatccttcatttattcatgctgctaccgacgcatttggggatgcccgttcaccattactatgaaggcgaccatatcccagtgtttcttgctctgtatcaaggtctagctgctcctaaaaatgatgactgggagtgtttttgtgtagagttggcaccacagtggcagagtatgaaaaatgtagagtccttcctttccaatacagactgtattcagctgtgcctccatctgaattctggataaatttcagatagtggagcagaaagggagaaaagggatctgattgactttaactaccaatgtggctcaaataacaattggaatggtttatatctaccagaatagacggcaggttttacaaaccctcaaaagacagacccatctattggtcatttgagtgctctgttctgattgactcaggtctaatggggggacttaacaatcttaaccatcatcttagactagctagcccagccaaccaggggatgttgttgggggaaaggttaaaagttgttctggggaaggaagaatagctgaggccaaaaggggaagcatccaggaggagcagctctcaggggtcatcagtgaaaggagcagagaagagtatgatgagctggagggagggggtttcaggtgcattggccaaagtgggcaaagacttggacatttgtctgtgtgcatctgggcttccccagtccaggctgcgtctcttcggagcctctgtggaatccctccccagtggttttgtgagtgtgccccaggtacacatggcaaggggaatgcctctgattcaggccgtgactcctggagaggggccagtgccctgcatgaccagggcaggactgggcagaaagactggtgtacccatccaccttctgtccttcaggagaagattggctggcgaaaggatgcactgcatttgctggtgttcacaacagatgatgtgccccacatcgcattggatggaaaattgggaggcctggtgcagccacacgatggccagtgccacctgaacgaggccaacgagtacactgcatccaaccagatggtgagtgccgggaaccagatcccccctccctgttgcctctcttgtgaccctgcccgtggtcttagtacttgcccagccttgaaaccttcctctggccctcagtattcactggctttctgatcccttcttggggttgggtttcattattcagtcttctccaactgggtttccggaactcctaattgacttacaacatttctcagggatttctgtagctggttcatctttctgtcaatgtgcgtctaaatgggaagtgtttggttgggatacgggtggcccaggggaaacaggatagatctcatagtggggagggtgtcttaaaggagggtgggtgctgtgcccctgcagaagtcacaactggtatagaagttatggggcaggacttcctgacttctagacgtgggctcccagaggtggtgagttgcctgtcagtgttagtggtggtgggcagaagtgttctgcatggaatgagaggtcccaaggaccatctactcccaacagtctataaccacaactatgcaatttgaaagaatttgtgcaaaatttcaaagatatataataatagaccagtaaaatgaaccctacatgcccatcacccagacccaacaatgatcaagatcttgcatactcactgtgcaattttcctgccaaaatctgcatccttttctttctcaaatccattctggtggccaaagaggaattcttcccaattttcttccttagagaagcccattttctccagtttcaagaggtggtcagtgcccaagccttccatcttgtttaagaataatggaatctgaaaaaaggactataactgtaggacctcaccagatgcgggcccctgtacccatcattagtcctcaaaatccctcaggacactgttaaactgcctcttagcttcctctcttcttcctctttctgcacccctgccccatggcccaacttttagtccagagctcggcaccctcctctgcccgtctgagccacaagcaggatgaagcaggacctgtgggggatgttggcagacctaagctttaggcataggagaaggaaaatagggcaaggaggcagggaggaaaagtcttagaggagagaggacaggtaagaggcactgatgacagagggtaggatgtggtggctgttctctagggcgtccccactagtccccctccctgctgaaaggatggagacacagacaagatatggaaaacctccactcatcacctctccactctggggtgagaggagtgaatctagtttggtgaatgccagagggtcctttccttgagggtctcctctactcagttccttagttcaggagctaccaagaaggcttagttattaagggactctaaggggccacctaaggaaaaggtgcttccctggcaaatgctggctgctgactgtgcattggagccaggtgctggtatctacacctgttaggaatgtcatagccttgacttttgccttggccctaggactatccatcccttgccttgcttggagagaaattggcagagaacaacatcaacctcatctttgcagtgacaaaaaaccattatatgctgtacaaggtatgctgggagggagggaggctagtgatttgtggggtgaagtgggtggtgaggagtgtttacaactctgcctatctgggggaaattcaaaggaggggtggaatatagcccagtcttgatctaatggaaaataataggaggaaacaattaagcattcgcatagcagtgaataccttacaagaaatttgaacatatagtatctaatttgattctgagaaaaaccttgaaaatagcatgaattcccatttttttgggtgatgaattggaaacagagaggcacactctactagagaaggaaaatataaaatgaaatgaagatacacacaaagaaaagtaaggcatctcatcaggctacgtcactaatctctgtattccagagctttatgcctgagcctgcagactataggagaccagtgggctagtctggcgcagaaattcccaaagaaaccaataaatgtcctgagtgaatacagcagtctgcatatggatctgttccatttaaagaaactgttcctgggtcaccctggactgccgcatttagtctggggcaggaattcccaaagaaaccaataagtgtcctgagtgaatagagcagtctgggtatggatctgttccgtctaaagaaactgttcctgggtcaccctggaccatcttcaaaaactccccacatgaacgtgctccttctcacaatcacagatgagccaagtttgaattacagatctcctcggtgtgctcatgtaagctaaatgtaaactcgtctctgagattcttttacgtgatgaagcaatgagaacttaatctggaatccctctccaccctccacccccagaacagctggccatagttccctctccttcttgctcttgaatgtccacaaaagaacctttgtctgattgtgtttttctattgctcctgcctgagattatcactgataaaatgccacttatattttcttgagttctttatcctcctttagttcaaatcaatgttagaagatgaaacaagggaaaaggattgtttttctttttttgtttagtggaagatagcaggataaagcctattcagggcgtggtggtgtgtgcctacaatcccagctaccggggaggctgaggcaggagaatctcttgaacccagggggcagaggttgccgtgaaccaagattgcacaattgcactccagcctgggggacagagtgagattctgtcgcaaaaaaaaaaaaaaaaaaaaaaaaaaagcctatgcacttacaaataacgttttatgtttttagagggctcaattgcacagactgtattgggtttccagatatttccagagggaagaagtccatactggcttaagcatccttcctcagagctaaatacaccttgcttgggggaggaagcccatccagtcccaaggcaggcagagggtgggagatgtctctgtcactgttagaagtggaagactcaggagttagtacagatgaaagaggaaaggtgggtacttcaaggctgcccctttgccacaggacctcagaggtccgtgggagggcgccattcgttctctcagcttcctattaaagaaagggtctatacttgagacccttggaaaagttgcccttttcacgccttctgaacagattgagcagatcctgaaagctgaacctgtgaatacctcagagaccgggggagaaatggcaagaaactgtcaggagctgtcgaccttagaagatgggcttttacagagctgtctgttaccgtgggaggggcggggtctcaagacattatcttttagagaaagatcttgtgagcccctttcctatggatctatagggctggatattccacggcgtactgtagcaactcttcttctgtgccatttcttcttgcttttccctgtgggatcttctttagttcatggtgggagaaggtggcaggatatggttctaggagcctttactgttctagcccagtatagcaatgctcactctgatggttggcagggcaaaatgaacttatttcttttctttactttttttcccaagaattttacagccctgatacctggaacaacggtggagattttagatggagactccaaaaatattattcaactgattattaatgcatacaatgtaagtcatcagtttcttcccccactgccacctcccttccaccctctcccactgaggccctgcagctgccgcgggctcaggtgggcagttctccgtgctgctcttcttggctctgctcccccatccccttgagtttggtatcttcttcctgcttcactcagggtcagggtggagaaacccatccttgcttgatgagtctccctctcacctctgccatcttgactctcatctgcagatctcagtgagccaaggagtggctcagactcaggctggtggcctgggaagtgcttaggttctgacacctcgcataggcaggcagtggtattctccacctacccagtgcccaggctaacgctgccaccgtattctctgcctgagggagcagagcatccaccagccacaggaccacactgcaagaagtgaaaagttcgcatgctgagctcacctcacagtggcagggcgggaatccctcaggctcatggagctcagggtagagctgcagactaacatgggagaatcgacaatccatttttttatttttgtttttaatttaaaaatatatatagagagatgaggtctcactatgttgccctggttggtctgatcttgaactcctggaagcagtcctcccacctcagcttcccaaagtgctggctttacaggcatgagccatcatgcctggccaaagaatcaatgtttttgcctacctacttaagatgtgattgtaatgaagtcctttcagagggttcgtgaatggggctattaaattctgtgctattgtaacatatcatgtgaaattggccctaatataataagtgtaagttcttatagaggtggtttaggaatcactttcacattccaagccacgcatccacagactcacctcccaagcctttctctttcctaccctcctttccctcgattcataacaccccaaaagtacttgactcagacctaccttctgtcaggcaaacggcaggcagagctcttgtgttgggaagtgtggaccttctgctatcccttctcttgtgggtcccaagatggttatggcatccattgcctacccacctgctcaaggcgccaggtaatttctaaattggcattcagagtgcatcttcctgttaaaactaagttatacacagactaagtgtggcttaagtaacattattaatcctaaacttaggtaaaacaggtttttctggctaacctgggaacctaacgaatcagtacggcatcacacatctgtgagaaaagtcatcttgccttcccagcagtgactgattacaaatgagtgtttggagctgggcctttcccaatgttggccttgtccatcttccaatgtggccctgttttgagttgcaaagtactgcccagctagggggaaccctggggcttggggtgtagccagccctgcgcttagttccctggagcctcagtgtcctgaaggcaaccgggtgggcagcagtgaggatttttggcttgtttttaccccctttcttcccccttcccactgctcccatctcctgttgtagccaagggtcctcttgctctcacagattcagatactcctggaacttcctattgtgagaaactgaagacttccttctctcctaccccattgcccacatactaacatcctcttttctgttctctggcccttagagcctcaccagatcccataggcacttcagaacccagagtgcagtgagacagggtttcctaattaactttacaccgtagtgcctttcagattccacggtgagtgatttgctttacacttcaggaagagggggaacacgtaagctggttatgtgggcacaataggtctgctgaagtgcgacacccagagagggtttgggatgtgagcctgcatgggaaggaggggcaggcctgtgaatgtcaccctctttcctggggtgagctggtgtgagctgtgagccgcttgggtctcaatctctggacactgaactaagagaaccaaatcaagagccagaacccctgccttgccactctccccttccctctgaggatgccagagctgggagaccccacagggcagaaggtgcactgctgctggacccactctcacaggcagggaggccaccgcttgcctcctgctgagtcagggcctttgggaagaaatggctgaagagcagctcatctgggctctgttgagtggggtgaggtccctctttaaggcttctgcggaggggccacttgtcagcatttcattgtcagccacctcctgaattcagagctctggagctccccaagagcattggctggtgaaggcccaggccccctgctcctggcggctttgatatcagagggcatcatggcgcacagctccatagacctggctgggcagccttgcagcagcagggaaggcacactggtcagccagcttctatgtgactggtgggttctgcgtgtctgtgcttctgctgggaccgctgaaaaccagggagcaggaggctttcttattggttccatgcatgggatctcataagtgcttagccctgagcaggatttctcatatatctacattcattttcctagtggaaatccaggtacccagggtcaaggagtgacaagggaaagcattccctgtgtggtaggcagaggccaggagaggagtgtggatccctccctgctgatggggagtggggagcaggggtgagtacagggaacagttgttctgggctggagctgcttttggaacctggcacgaattcccagaggaactgtgggaacctagcactgtcgcttgattctgcgagttaaactggttcctgtaagtaaacatgttgtgaaatgaagctgatgacttatgaatgaactttgaaactcagcacttttaaaaatgagtgattatgaccaggcgtggtggctcacacctgtaattccggtgctttgggaggctaagctgggaggatcacttgaggccaggagtttgaaatcagcttggtcaacatagcgagaccaaaaattttgtgaaaattagctgggcatgctacttgggaggctggggcaggaggatcgcctgagcccgggagttcaaggctgcagtgagctatgattgtatcactgtgctctagcctgggtgacagagtgagactctgtctcttttttttttttttttaaattggaaaagaattgtaaagccttattgacatataattaacatacagcaaactgtactgatttaaagtgtataatatgagtgttggcacaggtatacacctgtgaaaccgtcgccaccatagagatactgaacatgttcattactccaaaaagtgacccttgataattcccttcttccacccctcccttcaggtgaaatttaaaatatatatattaaatatagaaatgtaaaactgcaagatatttgaagcaagttcagttggtcaaagccatgtcaggggtatgttggtttcctgtgttgattagaacctgtgatactgtggtacgataagatatatatataggtctctgcccctagttcctaatataaagcccctaaaacctttatagataaggacactaggagaatcttttgttattatatttggtctttaacgctggttcccgacacagagtttccaagaccattgtagtttcctgggtaataggaacatcttttgttctaatgaggtgactcttggggggtgctcctggacagcctcaggatggtggctggttgccaggggaaccagccatgtgattagagggttggaactttcagccccactccatgacctctggggaggtagagaggggctgaaggttgagtggatcaccagtagccagagatgtgaccagtcatgcccatgtaacaatgcctccatgaaaacccagaaggcctggatttggagggccttgggaaagctgtgggacaggttcctggagagtggcaccagagaggacagggaagttctgcaccctcctcacacaccttgccctgtttctcttcatctagctgttcatctgcagcctttatctcttattcatatgtgggtaagtgtaaacaaactgtgtccctgagttctgtgagccattctagcaaattgatgaaagaaggagaggggtcatgggaatttgaatttatagccgatcagttggaagtatagatgacaacctagtacttgtgattggcatctgcggtgggggcagtcttgtgggctgagcccttcacctgtgggacctgacactatgtccaggtagatagtgtcagaattgtgctgaattagaagataaccaaccagtgtccagtagagaattgcatggtgtgtgggggaaaaatcctcacatctggtgtcagaagtgttgtgttgagtggtgtgtgagagtagagtaggaaaaacagtttgggtttttccttccaagtactcatcttacttgctcctgtcctggccaacgggaaaggctgggctgggcttcaagctccttgcacttggacttttcccaactttgagccccagcacgggcccctggtccatgtggggtgtgccggggcagcaggagaggttttcgtcagctctgctctcctttcacctgctccgcatccggccagagtccagtcacagctctctccagaccgcttgtgtttttgtcacctcaccgtccgagtggtttgtgttggatttcatgagtcatgcaacacatgactaagtgtgggtgttggcttttacctcccctagagtgctggcagaccatctgtggggacattctgagcagatttgggttggaacatatgtaacagatgcaatggctgtggtatttggccaggctgaggagggagcaaaatggaaagggtatgtttaatttcatgtcttgtagaatcaagtctggtgtacacatctctccgagtgtgaaatcaagttggatttatacattttttcttgctgtgccaaattcttcactgtgagaaatcaccaagtcttcccaagggagtttggcaatgtggtgctttgctctgtaataagtgctggtgagagaatcccctcctgagctcagccgtggagccctgggtccacacgtgcagagggggctggcctcatgttgcacccagaaaggcctcttttcagtgtgggagcgaacagaatgagttggaaagcactggagctgcatgtggagggtgacttcagaagctgtggtgtatttttctctagcagagcacatgtttctctttttgttgttgccataaagtctgctcccacccactccacagctggcccgacttaaagcaattgcagatgtgacctaacctgaccgagtatttaatagcctttacacttctgacattcccaacatcatcttgtttcctactggagaactaaggagtgcaccttgaggggcgaatctggtaggagttaatggaattttaggagtcacacataaaagtcttcatgtgtaagaactgcactttgactccatccattcacttattcaacagatatataccaacagcctaatgtgtgacagggatcatgctgcaccttggaaataaaatagtgagcaaaacacagtcctgccctccagcactcatagttttgggggcagagacccttacaaccacgatacaacctgatgatctctttccaaagtcacagagccaaattcctttttatttttttatttttgttttttaccttatctgtggacagagagccaatttccaaagaaagaagtgcatatcaggtgtggggattagaaagagccctggggtgggtcaagaaagcctgcacccggtcctgtgcagcagagtggtcccaggccaccttttccttgccctgacctccagcttccatacatgagaggtttgggctgcatcatctccacggttcctgctgcctgaaatgtcttaagagtttctgattccagagactctgtgggtagcaggaataatacaaactttatatcagaacatggggcttatggcctgagtagaacataagagtccatttccatctaattcttagttgctgactcacagagtaggagtccaagtccctcttgctttttcccagatcctcccttggggctttcgagtggcggcttgggcagatcttgctggggagcactggtgtttccttccaaagttttatttgtgaacgacagggcccccatatttcaagttatcgttcccaagtaatttttttacatgccttcactcttcagctcttttacaatactgttttatttcctccactacttattcacggttataaatttattttttaatatttgtcttaagaaatattttcatctacttggcctgagaccttagcatagctgttaaatcattcatctgtctacccatccatgcgtttattcattcaacgacagattgtactaagtcacagagagatctatgatacagcccttggacttcacaacatggtagggaagacagatctgcaaatagctaatcacaggcagcaggagagtgctctgtgtattgagtggcgcttttgtgacccttggccagttaaggctggcaagttgcaaagggaagtggatttaagacggatcatatttttagagttgtagaagcacttagataatttgttgcaaagggagagactattttttacagaaagtattttcaacaagctgttaatttgctggaaaactacatatttcacttattcaactttagcactatatgctcagcaaaaaagagaaagaaagaaagaaagaaagaaagaaaacccacaagagcaagaggcaagtctgtctgctgttctctccaacagccacactccctagagtgtacccgaggagggagagggaatccgcagggccgtctgcggatgttggggtccttgtctctcatatgggtacatcatgctatactctgtgttgagtgtataaacagacagttgttttaaattttctggtaaaatatgacctctgaataaaagctacttacttcatttggcctcagtctccaaagtggaatcttccttagagattttcaaagaaattattattattattattattattcttaatttttttaagaaacaatctcactctgtctcccaggctggagtgcactggcatgatcatagctcattgcagccttgaactcctgggctcaagcgatcctcctgcctcagccccctgagtagctacaggcatgtgtcacaaggacaattttttaaactaacagacgtatagaaaatttcacacacttttcacaaattaaataaacctgagtatccagcaccaaggccaaacacacagaacattagccaggcccagaagtccctattctgccctcttccatcgcaatccctcaagggcaaccattaattttgcctgtttttgaatttcatataaatagagttatacaatatatatgcctttgtctctgccttctttctagtaatgttatatttgtcagatttatccatattattacatgtagtcatattttattatttctcattactgtatggtattccactatatgaacatactacaattttaaaaaatccattctactcttgctaggcacctgaggaatttccagtttctagctattacaagcagtattgctgtaaacattcttgtccatgtctttttggtgacgcatacacttctgttggatataatcctgggtgaatgctaggtctgaggttggcctaagctttagtagatatagcctaatggctttctataggattgcacgaattttcactcccaccagcagggttggggagccctagttgctctacatcctttcccaacacttgatgttcttagtgttgggaaataatagaaaaaaactttactttttttctattctgataggtaattttgacttgatttttgtttgattcactgtcttaagaatataatccacacataagattggagtctctcattatgtagtttcaaactcaggcatatggacctcatctgatggggataggtatggatgtgaatgacagggtgtattcctggagaaagtgcctgctgagctgattttgaaggatgataaggagccagccaggaggaggagagagaggagccattgtgcaaaggatcattgccctgggcacatggaaaggctcaaagcctggagtacacactgcaagattgaggaactgcgtgtctgaagccgaggatggggatgagaggtggctctggagaagcaagcaggggatggggcataacccgtttgaagcagataatatcatatggcaggtcaaccactatcaacttctccaaactcacagagggagacctcaggctgggtctagcaagatgttgtgtgagtgcagagagaagggaaaggatgagggagggccagggaaccaagctcactggctcttcctttggcttgggattcctgagttagaggaagccacgtgggcctcagaaaaccagtgtgggagcacctcagccacagcctttattaaatggttgggcttcattttctctctccattcagagtatccggtctaaagtggagttgtcagtctgggatcagcctgaggatcttaatctcttctttactgctacctgccaagatggggtatcctatcctggtcagaggaagtgtgagggtctgaagattggggacacggtaagtctcaccccaagtttgtatgaactcttgttagcattggtcatcagtctttgggttctaataacttttgtgacttattaagagtcctttcggaatttatattctgttttccaattcagcatcccagaggagtctcctaagcctgttttgcatgatgtgttcagagtctcaggtgaacttgttaaagagcccagtcaatagacagccctcagcgcattgctacctgaggctttcttaagttggcatcgtgactttggtgttttaaaccattatcctcttagcttgacacagttgtaatcaggagaaagagtacaggtaggaatccaggagacctgtctttcattcctagtcttctgcaaatagctctgttccttggataatctgaccctcacttttccgttctgtgaaatgtaaagaaagccactccccccattctgttttggtgaaatagaatggatgactctacagcagtggaggacacagatgccttgtccagattaagtttattcaaatgatgtgtgaagatgtgtgcctctgcgctaaaccaaggacttgcgtgagggagcagggaggaggatatgtgggcaacaagaacacagacacagacacgggcacagaggccgcgagtggtgatggagagctagccacacatcttctggaggtcctgctgctagaagcagatcatgagctccattcctgacttgctttgttgacaggtccagtgctcagaaaacagaaagccagtgagggataattctcttctacacttaaaagaatctagttagaaacaaaaaaattatagagaccttacaaataggtggctatatcctcttggcattcatagcactcatgacggccaaggcggatataagctgactcatccccctggcttcagggaaagagcttgcggagacagggacagtctcgtggctggtagcagtggtctcctcgggtttctccatattccactgtagatcctctcccatccctgccttcacacttgtccctcacccacttcacaacacacagacatacctcttttttttttttttttttttttttttttttttggagatgaagtctcgctctgtcgcccaggctggagtgcagtggcacgatctcggctcactgcaagctctgcctcccgggttcacgccattctcctgcctcagcctcctgagtagctgggactacaggcgcccgccagcccggctaatttttttgtatttttagtagagacggggtttcaccatggtagccaggatggtctcgatctcctgacctcatgatccacccgcctcggcctccgaaagtgctgggattacaggcatgagccaccgtgcccagccacagacatacctcttacccttctcaaatctttctgcagtgcctcgctcccccaaataaagggacagttcaaaatatcatatggaagttgagaaaatgaaagcctcttatgactggctaccaaggccttttctaagacacgttgtttccaagtttcttttgcttttaacaagattgaaagaaggcctaatcaagctgtctgatgataagtcattacaaatgataatttatttatttatttatttatttggagagagagtcttgctctgtcacccaggctggagtgccgtggcacgatctcggctcactgcaacctccgcttcccaggttcgaacgattctcatgcctccgcctcccaagtagctgggattataggcatgcaccaccacacctggctaatttatgtatttttagtagagacggagtttcaccatgttgctcaggctggtcttgaacttctgggctcaagggatccttccactgcagcctcccaaagtgctggcattataggtgtgagccaccatgcctgcccacaaatgattatttatggcttttaactcagaagacattcatagaacaaggtgacattgctgttacaaaactcttgttcccatcttcctatttatgtgaactttttttgtgcttaaatctctacaaatgaaaaatagaaatataattgatgtggatccctgtcttgtttagcaataattaatattattttacatcggggggaaagcctcatctcattaaagaggtacttccaataacattttactgtttatttttaataattgtaggaagttgcaatgtatttatgttgttttcatccattataatgattgctcaatccagatgattaaaaaaaaaaacactaatgctttacagtgacaggacaggatttaaagagatagttataaaaaatggaatgaggccaggcgcagtggcttacacctgtaatcccagcactttggaaggcctaggcgggtggatcatgaagttaggagatcgagaccatcctggctaacacggtgaaaccccgtctctactaaaaaatacaaaaaaaaattagctgggagtgatggcgggtacctgtagtcccagctactcgggaggctgaggcaggagaatggcatgaacccgggaggcggagcttgcagtgagccgagatcgcgccactgcactccagcctgggcgacagagtgagactcagtctcaaaaaaaaaaaaaaaaaaaaaaaaaaatggaatgaggcagaaataccaaaaaaccccaacaacatgtaagtgaattctatagatctgtgggtggaatgtttggtgtagcatgtcaggaaagctgaaggataatgtgggaaatatacccaaacaaggaaccctttacttggagaaataggtatgatggaaaagagatgggagagggatggactgtctaatctagcatatgccaggtttcaggaaggctcttgacaatttctaatgacatccttataaataaggcaaatatttaataatatgggttgacaacagcacagtcatgcggatttgtagctgggtgaacatgttttctgagagtgttgataatgcagccagagggaggacttgactgaggttccaatgtctcttgtctgttgtgtttatcattggcttgggttgaactcataggagaccttatcaaatgtgggaaggctgcagagctggagaaaacagcttatgttataaagcaggaaagccaagatttaaaaatatttttcgaaattgagatggattgaaatcatgaagattaatgtcttatgttttagttcagaatgttactaggatataggaaacttggtttgatagtaaaagaaaaacatctggcagactataatggctcaaaggctcaatgcaaataaacagtgattaaaaaaaaaaagtccgccaggcgcagtggctcatgcctgtaatctcaatactttgggaactcaaggcgggaggatcacttgaagccaggagtttaaaaccagcctggacaatgaaatgagacccccatctctacagaaaataaaaaattagccgggcatggtagcgcacacctgtggtcccagctgctcaggaggctgaggccagaggatggcttaagcctagaagttcaaggcagcagtgagctatgatcacaccactgtattctagcatagataacagagtgagacctcgtctcttaaaaaaaaaaagtaatggcagtaatggctaggcacagtgactcacacctataatcctagcattttgggagactgagacttgttaattgcttgagctcaggagttcgagaccagcctgggcaacatggcaaaacccagtctcccccaaaaatacaaaaatcatctgggcgtggtggagagcacctgtggtcccacctagttgagaagctgaggtgggaggatcgctggagtgtgagaagttgaggctgcagtgagccatgactgggacactgcactccagcctgggtgacagagtgagaccctgtcagaaagaaagaaagagagagagagagagaaagggagaaaggaagggaaaggaaggagagagagagagagaaagaaagaaacggaaaggaagggcagggcagggcagggagggagggcagggcagggcagggcaaaagaaaggaaggaaggaagaagaaagaaaaagaaagaaggaaggaaggaaggaaagaaagaaaggcgggcacggtggctcacgcctgtaattccagcactttgggaggctgagacgggtggatcacctgaggtcaggagttcgagaccaacctggccaacatggtgaaaccctgtctctactaaaaatacaaaaattagcggggcgtggtgatgtgcacctgtattcccagctactcaggaggctgaggcaggagaatcgctcaaacctggaaggcagaggttgcagtgagccaagattgcaccactgcactctagcctgggtgacagaacaagactccttctcaaaaacaaacaaacaaaaaagataagtgaataaaaagtaatgccagttgaagctgtgtttaatagagatattttgaaacctcacacctggagttctgtattttgttctttattttattttattttattttatttttagagacagggtcttgctcttgttaccaggctgcagtacagtggcttgatcatagtggactgtaacctctaactccaaggctcaggcaatcctcccgcctcagcctcccaagtagctgggaccacagacctgcaccaccatgcccagctaatttctttgtggttgttttttttgttttgttttgttttttaagaaacagagtcttgctatgttgcccagaatggttttgaactcctggcctcaagtgatcctcctgcctcgacctcccaaactactgggactacaggcatgagccactgtgcccagcccggttcttttttgaaaaagaaaagtgacaagcaactatcatgatgaattgtttagaagctagaaaggtcaaaggaactaatgtttgtcagcagaaagattgtaaagtcagaactctttccagatgcaaaaaaaactgaagccactttatgctgcccaaagtgaaaaggagagtcattctaaatatattggggttccttatggaaagcaggaatacagttagtcttgggaaggaccagaaacaacctagacaatgagtggtctgtggtcactaattgcctgtgaggaagacattgtttttcatgctgacagatggggaagactgaggcacaaagcatacaggtacatagcctgaagtgtcgacatgaaaattcaaagccagggctttctgttctgaagccagctccctcaccacctttatccggcttcttggtgcccacgattctattctaccaaacctatttcaaaggactctaccagcacaaagtacaatcctgaggaacaggagcctccacgggagagtgccgctgactgagcccccctgcaccatgtggggagcccagcgctcgcgcactgctgacaggcagcctgggatttgaggatgagcgtgacttgccccagctcacccagctaagagacagtgaactcacaagccaaaccaaggccgttccccctccacaccaggtcatctcgctcatcactgcctccccattacagagcaaattgtatttgtttgcatggaatggggacatccaatgtgccgtgtccaacgtgccccttactgtggtgggggcattactgctgctgtctgcctcttacagcagctttataagggagctgttccttcgccattttatgtatgaaaaactgagactcaaagtggggcctgagaagcgtgccagaagcctcaagcatcgggagccaagttgggggctgcttccgaggccacagtgcatgcgtttcccacacactttggggagtaacagcttttaggaagcatacagtggtgtcatggccacttatggatggacaccctagtgtacagattttgatttttgctgggatacctcagaaaaatggggaaattgtccagaacttgaaaaagattttacatgatttttcaaatgctctgaaaatctcagaggtattgaagtggtttttagagcattcgaagcgacactaaagaggaggggaacttctgctcaggccggcacctttgacagctcttcctgtgggattggatgggccgcagccctgtgggaacagcaggggtcctaggcaactgacccgagctggccctttgtttctactcactgtcccagtgttgttgtcttgctgtccgagggccatggtcacatggcccctgactccactgcgagggctgtggggtttttgttttctgtggatgaagacaggctggcacagggcagtggccactctgctcttcagagccagacatgattctgttcacaagagccacaccaggccatgcaggccaggagaggcagctctcttgagggccttggaggccatcgggggcagaactggctccatcatttgtaggtcccagtgcaaaatgaaaatatggggtccatgttcaaaaatcattaagaattccaacacagcaaccacagagcattagagtaagcgtgggcccttctgagtgggggcccttgtgactgcacaggcatacaccagggagccggccctggcacggggagttgaggggctttccctcttcgttgaaggagaggggtctgtcagttcctctgatccccaagacagaaggggtgcacttacagctgggaccagtctggttttcttaaccctggcccaagaaggcaaactttccatcccttctctcaggctgaactgtctccaaagcattgacagttgggctttggcaagcaggggtgctactgagtgtgtgagtatttccctctggacgtgtgtccccaagccatacatttcagaacttgccagtgactgtgctgacatccactcgtactcagtaagtgtttatgtaccaaatcccgtgctcactcaagatggacaaatgaggccacagatcaggggctcagagtctggtggaggaaataacatgcagaggagtcagccccgtagagggtgatgagtgctgtgggaaagccaggtgtggcactgcaggagcccaaggaagaagggcccagcactgcagagggagctgttggagctgaggctcagagcaccagtaggagtttcccagacagagaaagccggggtgggctggtcccatcagtgggcctcccatgtgcatattggcaagatgtgtctgctagggtgtgaagagcatcatcctttggccagtggaaagcagctgatggtgacggccatggaggcaagaggagtgggctggggagggaggggagagtggctggcttgggccacagtggtgaaatatacctgccaacctaaggggtctggccattctggccattgtttggcaagtgggttccattctttggtggcaggagttgggagggctatgggcaagtcagggaatggtggtgggggtagacaagagtatcaagcatagctggagggtctggggactcccctggagaagagggattaggaaaagcagacacagttcaggtgtcatcagggatctcagggtctggcctgtggacaaggacacggcccgtatgaggggcagccagatggacctcgcctcctcattatcacagcttcctgcagaggtggaagaggtgcaggctgtggttctgtgacaaccctgtgtgctctgggtcaagacagatgtctagcaagaagcaggagaggtggcagggcaggggctgaggggcagggatgtcctcaaagagaaatacggcttaaatcaaaccttgaaagccccaaatccagtgagattctctttcccagtgatttcaattgtttccctaattttcctccctttatcctacaccaaccatcgggagtcagtttactcaggaactggcttcaacaaatcagtatgcaagtggctggctgtgaggctagcacagacgcccagcacaaagcagccagtgaaccccgtcatgggcttcccacagcaccccctccccgctcccgtccactcctcgggactctgtagcctgtgcccatcccagctccttttttgttgagatctgagcagacttggcatctgcataggatagccctggatttggtgggttcagggtgggggctgggcagcccttttgaaagggtgcatcaggccagtcagctccacaggggaaccaggagaatcccaatgaagttctaataacaagaccgagtgggagggctgctgtgtctgtgaccttcctctggaatctcagagcgaatgaatggaaagtgtccaggaactggggagccttcagtatcagttgaagttctcaggaatcaggggagggactcgaagaggcctcattccagctgccttccagcctttctggattctttccaaatccagtagggaaaatggaccctctgaaaggaggggtaagcaaacagatttccttgctggtcctgaagtgctttttatagcacttcccgtgcccagcaggagctgagacccagtggctgaaatagacagaacattctctggttatcaggcatctggctacactccaggctgcacagggccagacagatagcacctcacttggaccgaaggcttggctggggaaggcctcaggacctgcttgaaagctgggccctccttgcttgcccagctgggcagacagtgcccaagtgtttctacatgctggtgattgagtgccagaactttaggggtgccctaacctcccactttctcccagacacatcagcaagattctggagacttaactctcactttcattgctttaaccccaaggcaggcaagtttccatgagacaaggttatactcacaggtgtgtactccccacagtctttcaataattaaatgcctttggctcttggtccaggtcattcctctgtagtttattcagtttctgacccgcagatgcctctgtggagcacaagtccagcaagttgtagccctagaagtacagggtttcagctgtaacttgaagcaagctacaggtagcttcaagcatgtcactgttgtgggagcttcaagcaaatagtaataggagatgcaagcaagtttctctctgggcctcagaagggagggatggcatctgcccctcaaagctccattcacctctgcattcttgatggccccacgggtggcttcgggcaggcatagtccccactcttatcctatctgcaggctcaaatcgttcccagcccacggcagaaagatgtggagatgcctctggccaccactttggggatcaccatcaaggggtccctttagtaagccaggctggctctccctgcgcaccccgatgaggtagacctcattcccccgtctaggaggtggatatgctaaggagagcgcgggccctgctctaggcctggccccactcatcagctgtgtgagcatgactaaatccaccaaccccgccaaccctgttttctctctggtaaaatgaggacacttccttctagggcatttaaaagagatgcttgtggaaaagtccagcacagtgcctggtacatagtaggcacttggcaactaataattattagtgttttgttttgctttttttttctttttgagacaagatctcactctgtcgtccaggctggagtgcagtgacacgatcacggctcactgcaacctccccctcccgggctcaagccatcctcccacctcagccttctgagtagctgggaccactggcatgtgccaaaatgcccggctaattttttgtacttttggtagagatggggttttgccatgttgtccaggttggtctcgaactcctggcctcaagtgatcctcccagtctgcccacctcagcctcccaaagggctggaattacaggtgtgagccactacgcccatcctattcgtgttatcctttaaccaatttcagtgtccaagtggattgaatctttactcaccttgagagactccctgtacctcgagaccttggaacttagccttggagttgtttttgtcaatctctcccctttgtctcttcctactcttcctaccccacagagatggaaggtaaggtggagctagcccaagctgtctgcagctggcctggtcccccgagtgtcttctgatcctgctcccctagctatcctcagctcacctatccagaagcctctcctgttgagcctcttggctaatgctgagtcctgggtgtctgttgtcaagtcctttgaaacagcagtttgctgccacgcaggactttctgcaggacttatagagcaggatctatcctcctgctcagtcccataccctctcccctctccccgtgtccctagatgtcacagcatctgaggggaggccttttagaaccagtaaaaatctcaaagtaatagggatctgtatgtttagaaacagatatttataatgttctcaaaaaatgaacatcgtgggccgggcgcagtggctcacgcctgtaatcccaacattttgggaagccaaggcgggtggatcacttcaggtcagcagtttgagaccagcctggccaacacagtgaaaccccatctccgtctctaccaaaactacaaaaattagccaggcatggtgacaggcacctgtaatcccagctatttgagaggctgagatgggaaaatcgcttgcacctgggaggcagaggctgcagtgagccgagatggtgccactgcactccagcctgggtgacagagagactctgtctcaaacaacaacaacaacaacaaaaacattgttacctgaagattgtccagtaaatcaagtgaatgatgacattttaaaaattagctttaatgactgggcgcagtagctcacacctgtaatcccagcactttgggaggccgaagtgggcagatcacgaggtcaggagatggagaccatcctggccaacatggtgaaaccccatctctactaaaaatacaaaaattagctgcgtgtggtggcgcgcacctgtaatcccagctactctggaggctgaggcaggagaatggcttgaacccgggaggtggagattgcagtgagctgagtgcatgccaccgcactccagcctggcaacagagcgagactccacctcaaaaaaaaaaaaaaaagctttattctagccgaaagaatagaattaagaatagtaatagctgaaagtggtttttaacccattctgagcttcagaatgatctgaggagccttttgaaaaataaagacatttggacccagatccagtgagtctgtttgtggggtgggccgggcctctgtctgttcagggagtaagggagaacccacccctgagtaaaactttacaacggcatttcatcagggcacactggccacctgtctgtgcgttttcatagaatccacagtgacttgctctcagggccctgatgggtgattcagaccccacatggctctcctcaggggggtgaggaggagagggtgggggagtcaggctctagttcctgaatcagaccaagcctcattcttgctttccttccatcccagccctgtgggcagctgacaggcatccctcccgcaccatctgccacccatccaggcccaccttgagcctgttttcaaggcaatctgtgagaagctcctgagtgagaaacacttccttacatattctgtttaaaaagaaaaggtctgtccatgtgcatggtgcatttcatcagttggagactcttctttaagacctcaggggcatggggggattgtgaaagatgcagctatgacaagcactcacagaggaggaattggggcacgggggactcgggggtgtctggagagcaagctctggagtcagctgagccctttgccagcaggcacagagccctctctatggcgggccaggtgggtgcccttcacccggcaccctgtgagagtgccattgtgcctggcacagaggcagcgcccaggaaatgtttttccaccaaatgactttttaagtgagcagagaagaggcatctgcagcggggctgggaagaggataggacagaagagaaaagaaagggagaataagaactgtgtgaactcaaggaagccctatagctttccgcaggggcccatttcctcagggtcatggggatgcaaagagataatgaatgttaaagaattcacctgtcaaatgtgagctcacctgtgcattctcttctccatgaagcatgggagcttgctggttctgaggtctcttcctactccggccatcttggtggttctacctgagtgcgtggagagggctggagttcgcagctgctcttcatcaagggccctgcccctgggtgaatgggagaccctggcttgccgcagccatgatatcccttctcttccttctgcccaggcatcttttgaagtatcattggaggcccgaagctgtcccagcagacacacggagcatgtgtttgccctgcggccggtgggattccgggacagcctggaggtgggggtcacctacaactgcacgtgcggctgcagcgtggggctggaacccaacagcgccaggtgcaacgggagcgggacctatgtctgcggcctgtgtgagtgcagccccggctacctgggcaccaggtgcgagtgccaggatggggagaaccagagcgtgtaccagaacctgtgccgggaggcagagggcaagccactgtgcagcgggcgtggggactgcagctgcaaccagtgctcctgcttcgagagcgagtttggcaagatctatgggcctttctgtgagtgcgacaacttctcctgtgccaggaacaagggagtcctctgctcaggtaagtgtccccagcaagcactttagctctgagccaggccaagatgccgttaggacaccctcccaaagcctgccttttactcagtggtggtagaaagtgtcactaccatggctctccttggagaagacagtgggcaagccttgctacccgtaggcaggaggtggggatctgtgtgcagaatacgaaagcagaaggtattgccataaattgtggactctcagaattcgaggggcctgcgtgggtcatccaccttacttcccaattcatgcaggactggcctgcacagcattcctgacaggtagagatgttcagcctcttcttgattgcctcctgggacggggaactcactggggctggcagtggccatctgtcccttagccaatgaactcatatcttattgctgctcccataactcaccacaaacctgttggcttaaaataatacacatttaatccattacagttctggaggccagaagtctgaaatggatcttatttggctagaatcaaggtgccagcagggctgcatacctcctagaagctccaggggagaatctgtgtcccggccttttccagttcctagaggccacctgtattctttggcttgcagctccttcttccattttcaaaaccagcagagtaacatcctcagatctctctgactctgacctctgcttctgttgtcaaatccttctccctctcctacagacccttgtggttacaagggaccctcagtcgaaccctggaaagtctccccatccccaggtcctcagcttactcacatctgcacagtccctttcaccacgtaaggccacacagtcacaggttccagggattaggatgtggacatctctgggggctcttatttttcctgccagaattcctcttttttttttttctgagatggagtctcactctgttgcccaggctggagtgcaatggcaggatctcgactcactgcaacctctgcctcccaggttcaagcaattctcctgcctcagactcccgagtagctgggattataggcgcccgccaccacactcggctaatttttgtatttttagtagagacggggtttcaccatgttggccaggctggtcttgaactcgtgatctcaagtgatccatccacctcagcctcccaaagtactgggattatagacgtgagccactgtgcccggcccagaattcctctttatactgaagagaaacttgtttctcaataacttcctcccaatggttaacattctagagtcccccttccacgtgacaacctgtcaaacatctaaaagctgctttatgtttctctgttctctcttctgatctaggctagacaccccaagtctcttccttgtccgagggtgctatcatttgtgaagcatgcttcacataatcaagtgcgttacttgtcatgctggatgatgagggcttggtccagggttcagtgaagcatgcgtttcctgtgatttggacattctgcttacatggatgcaccctgacaatacattcacctttttttattttcttcttcttcttctccttctcctcctccttctcctcccttctcccttcctctctctctctctttctttcttgtttctttttttttttgagatgaagtctcgctctgttgcctaggctggagtgcagtggcacaatctcagctcactgcaacctgtgcctcctgggttcaagtgattctcctgtctcagcctcctgactggctgggattacaagcacccaccaccacgcctggcaaatttttttttttttaaatagatatggggtttccccatgttggccaggctggtctcgaagtcctgacctcaggtgatccacccacctcagcctcccaatgtgctgggattacaggtgtgagccactgcgcccagcccaccttttcgttctgttaaacagtcacagtatactcttgagctggtttttaacttcactaccaaaagtttgaggcttttaatttattttattttttagaactgtggttcagaaggagaggtacttttttagtgtgttgtgttggagcccttaattttctgaatctaaacacaggagtttacactgattccagttaaatgacaagttggcagttcccactctggtattgcgttctgattaaatgcttcaaaattgtatctcaaagtttatctaacaccatgccacctgtaaaggtagtaagtaaaacagttttaggcagggctgtggtttcttctacacatcatgtattctgtggtttccagggctccctccttaagaatggtcttccaattgggatgggtggatttgaaaggaactaagggatcagctgggaaagaaagcacaaggtgcatctgaagcaaaccaggaacgtgcagatactccgtcctatgggaggaggaattgtactgccacacagggttgcacagacgtgggttaacaagggaagcttcctggagcggaccttgccgtgacacaagcgtgagtacacccatgggcgtcgtgggaccagcatgtctaaaactggagttgccctggagagtgcaggacttagcagtgtcattgcagagtaaagtaggtggaaaaatcaggattcaacatgccaagcatgcaacagggatcaacgctttcctcagcagagtgatgataggttggtgttagctagatggttctgtctggttagtagaaaaagtttgggctccatagcaggaggcctgggcctaagtcccatcataccatatctgctagtgtgacttgggcatagagttgttatgaggaataagagatgtgtgtgaagcacccagtattttgcctggcacaaaaggaaaacacacccaatgctggctcctctatgagtcagtgccacacccctctgggggggccacacctggttccccatgtgcaggagggccccgccttcccccagacagtccccaggctttgcctaaaaaattccagggtggtggaatggagtttccattcctcttagtagccataataaaagctctaagcagcctggcaggctttttagcagtttttcttttaaagagatattagcaaacgtgacagaaccatccctccttccccttcaggatcctgaaataaccctctggtatgtcttcaccctagaagcctgcgtgtgtccatgcagcctgggagcaagggcgtttgagtcagatgctgtgtgcacgtttcatctccacagttcatcaggctgtgaccttggttgtcttggactttggcttttcctgtctcctaagatgggccaacaccatttgtttctgcattattttgagaattgaaggagaagacagagatgaaggccctggcctggtactcggtagggaacaggacccagtggatgttagatgcctcctctgtcttgctgagactgggcatttctctgagtacagagcctgggagacagggcaagtgggagatggggtatgagaggccctcagtggggaatactggtcattttggaaacaggaatattccatagctgcgtgaaaatgcagctttttttttgcttaatcatcagaacccacaatcctaagttaatcctgcattacagaattctgccagacttcatatccaaaaacccctggtgctctatctctttctcttcccttcaccccatacaatcctgcgggatcgggaaatgctcatgtcatggggtagagaaaccggaggtttgccaagcccttgaggctcctagatcaacgatgcctaaagtcactaacttccctgaggttgcagaatgaatgtcttttttcttccccactggaaaagccatagacaaccattaaagaaaacttgaaaaatacagggaagttgatggatgtgtggccagttggtgctgtctgtcttcttggtgaccaggagtaatttggaccatctgggaaaccagacctcttttcacccaggctgtttcgtgtgcatcacttctgaggctgtgtgctcagtcaagaccttgccagagagttgggggattagccttaggtcgagaatattctgagcagtagtaagaaatttaaaaatcatccataatttcatcactcttattttaagagattagtttatttccttctaaaccttcctctaagttagtgtatgtgtgtttatagctgcatacaattttgtatgatgctttttttcctataatattatatcctaaggagcacttgaagtcgaatgactttagtaaatcattgatgagaacattttgagtgtctttccattgcactcccaactagccttctccacctcttcactttaaaagcaacaactagttgaaacgtgacgctatccaagtctttccggagaaaatagtttctggagtgagatcattgttgtttgacaatttgggaaggacttaaactgagtccagctccaggcaggacttgataacatgttcatgcagtggcttctttcacagcgttatagcaccagcccttccttgtctctcaaaccttacagctcaggaggggctgtgaatggatgggtaaggaattccagtccctgggtccttggcacctgtggtcagcatggggctcccactccagaattgcgtgcggtggttttgagctcttgggtcacggctacatctggagttgttgtggcagagaagcctggttcccagccaccactctgctcttgaaggtgctgactcagagactcccaagcagctgacttcagcattctctcacagctttacaccccctcttccctgcagcctgtcttggaaggaaatcgtgtggttgtggtctgtcttcagagtggggttgaggggtgcacttgaagaagtggctgaggcagagccagggccagaataggtagggtcaccccagagaaactccttccacttcactggactctctatcagtaggaggcttacagtccttgtccctgccaagacagggctaggggcaaagcgcaagacattacaggtttgcaatatgttatccatcatcaaaatgagcagtgaacaaatccgactaaggtctggaagcaattgaacaactctgttattacttttgtgacacattgtcatgggaatgtgtgtgagcttggggctcttgtgtctctctgcggtttctagaggcagcttgacttagagaatggttctgtccacagactgtttctgtgtgtgcgaggggagcttcctggggccatcatgaggatttcttttcttttgagtcttgtaaagtattgacccatagaatatgagaagcaggacatgttctgttcagttgtttttcatgtaataaaagattcttgctcaaactttgagtttctttgttagtttctgtgtccaaacggtgcattttctgggatttgagctactcccttgtggtacattgctgaggtcagtttcaacccagatgctttcaaccttctctacacttaaaatgactgcactggagtacattgaatcctttgctaatggtcagcctcattcttggattccacataatgaggaaatttaaatcaaataggatatagaattttgaacacagcccttttggtctcgtggctgtaagatctcaaaagcacctctgagtaaggtctcatgtatacgtctcacctttattttacccaaagtttgagcaagaatcttttattactatgtggcaggcaattagaagtcaaggggcatcctccgttctctcccaaacaaaaaaaaaaagaacaagaagaagcatggtactagtagcatcattcctagcaggccagggccagcatccaagcatgggttctgggtctgggctaacagttcccggccgatttagcaaagttctgataaccctgtctagttaaaggcaattctgttaaccctgtctagtcaaaggcagttctgttaaccatgtctagtcaaaggcggttctgataaccctgtctagtcaaaggcggttctgataaccctgtctagtcaaaggcggttctgataaccctgtctagtcaaaggcggttctgataaccctgtctagtcaaaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgataaccctgtctagtcagaggcggttctgttaaccctgtctagttaaaggcagttctgataaccctgtctagttaaagccactcctgagattaaggccacatcctaggcttcttgactcttgtcaaacaaaacacctgccatggcaacagttatccagatacagttttaaaagtgtttctcaccatatttatattgttttctttagtaatgtaattttcacactcagaatcagtagcctggcagccgtccttggggctcaggttgctgctgtatctctgtcattgcaattggcatatttcacaaatggcttgttacagtactgtcttgaaggtgacttccatgacagaggtctccaaaagtaccttttgtttgttttacaatagagacagggtctccctatgtttcccaggctggtcttgaactcctgggctcaagggatcctcccacctcagcatcccaaagtgctaggattacaggtctgagctaaaagtaccttttgaatgaacctaggctggacatatttaatctccaggaaagggacctcttggcaggatcaccaccactgtgtgcttctggtaggagcacctagaaattcttcgggttttttcacatacattaatctctgctcagtttgatgttcacccagatgcttctagcaaatacaaggatgcaaaatatatcttccacaggaaggacccctctctcccaaaggaagcccccaggcagagcttcagaaaccagtgtagcaatttcccttacctggtatcatagaaatcctaaatatgtacatgacagtgagggccaggagagtccggttccattttggaacaggtggctctgagaacagaatttgttacaggattcttcagtaactcatcataaggaatgagacacctgtgagtggtagtaatacttctgcaggctaccacgtacagggtggctaaggacaatgcatgttccttaggcaatgataacacaggcagagctgccagaaaccatggcagtaaccagcacagagatgtttctccttgtcccctgccaggaatactgcaaaagcctttagaggcctccttatataatggaaaggaaatggctctggaatttcctaccccagaagggagttgtgaggaaccaacaggacagtgtctataaagctccttgcaggggccctaccaccaggggcactgagtatatttttctcccccggggctgggtgcagtggctcacacctgtaaccctagcactttgggaggccaaggtggtgggtggattgcttgagctcaggagttcaaaaccagcctgggtaacatagcaaggccccgtctctacaaaaaattatccaggcatggtggcgtgtgcctgtggtcccagctacttgggaggctgaggtaggaggaccactggagcccagaaggtggaggttgcagtgagcagagatcatgccactgcactccagcctgggcaacagagcaagaccctatctcaaaaaaaaaaaaaaaagagctatctgtttctagccactactcaagttcacttgaaaagcaaaaaggtaccaaattgtagggcttgtgatcctataatgaaataatacatcttttaaactagtcacatgagccagctgggctgctcatctctggagtcagccagcctcttgcagcttgtggttggagaaaccagagctttggaaaaaccagagcttagtaagtatctgatctgagacaatgcagctacaaatatagaaacaacaatctctcattgaaggtcattttgtgttaggcaggttgctgcattcatctcattcaacaaaagttcattgagcgttcttcataagccaagtgttgtactggctgccagggatatacagctggagtttcagtcttgaattaatttctaaatttttattgcccctggaattttccacttctttcttgaaactttctggaaataaggaatgggaacatgaatcatcttatgcttctacctttaccattaagacttctttgagatcttgaaagacaaaaaacagagtgttgggaagcattttgagaacctgccttctcggtgctctgagcttagctcagtaaatggagctttttcactgcttttgcttaccgctcagatcctgtgtccagaaacatcttaagcaacaattcacctgtgattctgaaaatctaagcgttgggcctcccctcaccgtcccactccctctacttaggaagagaagtttgccaacagaaccccgtggcgaggattctgtgtgtgcctttgaacttcaggcctggtgcttaaggtcacgaggtttggcttgtgaaggaaataatgacatttaaaaagcaaaggaaagtactaggaagacctaagaatgccaaagataagatcttagtcatgtaggcttgaggtgtgcgtggtattagccttttgatattataggataacatgctggaaacttttccatgtttaaatttaaaactgtgagagacctctggtggctgaaatggttattcttaaggattcttttgttccatttcttaggggttgagctgacactttgagtttggtcttggttttagatacttcaacatagttggttatttacaggcttctgctgctcagtgcctctggtgaggtggggcaggtctggatggagctatgttgatctttggggtgagtgtctgtcatgctcagaacactgacctaagagctccacccagatccaaaagctcccttgagtctggaagttgctccaagtctgatctgctcaaaggtttccttcctctttccagggctccctcctgggctctgactgttgttctctgacccagaggagggaacctgctgtcactccaccccatagccaccactcccaaagtctatcaggtgagtccagatgtccctaagctaaagaaatatgcaacccaggttggtatgttatttgacgtcatgaagttggcctttagcaacaggcaaaactatagtaacacaaggagaatcttttttttttttttaagagacagggtcttgccctgttgactaggctggagtgcagtggtacactcagtagcctactgcagcctcaaactcctgggctcaagcaatcctcccttctcagccttccaaagtgttgggattacagatgtgagccactgcacccagctgagaatctgttttaatggccttttcactatattgagatcatttccttggaaacaaacaggctcgtttgttagtgttttgcactcatcatgagcaagccctaactgggaggatttttttgcatctcatgcctttcctagcagagcctgtcacacacggtgtgtctacagtgcattgcctgcttcgactatttacattggggaaaattgaagcccagaatctgaactagggctccttgtgatttttgattatagagtcagacagggagaaccttgcactgccttttgcaggtaaacaattagctcatttctacctaaatttactttttttggttaacttaagacccttcccaccaccctggcacttagcctacattttccaagtcctaccttataagcgttctttatctctgtcaaaattttaggaaatatttagcccgttttcctaagtgagtttctctaggttacataaggatatgtcagacacagtgaaccaggcctggaggatacacatggaccaagcaactgcctgaggtactcatcgtttcgtgactataatttgatgaaagacatagagctcttcttagtattcagtgggtatctggctgttgttattggtgatgctgaacctacaagtgcacctttgtttttttggggttttttttttttttttgagatggagtctcgttctgttccccaggctggagtgcagtggcacgatcttggctcactgcaacctctgcctcccgggttcacgcaattctcctgcatcagccacctgagtagctgggattacaggcgcctgccaccacacctggctaattttttgtgtatttttagtagagacagagtttcactatgttggccagactggtctcgaactcctgacctcgtgatctgcccaccttggcctcccaaagtgctgggattataggcgtgagccaccgcgcccggacacaagtgcacctttgttagtctcttctaatttataaaacgcccttgacgtgaatgatctcatttacttgttattactgtgccaggagattggtgtgctgtcactcaccctgcccttgtgggaggctacggctgagaagactggcatgtaggccacactccccactgaaattttgggccaaaagtcttgacccaaacaacgtctacctcccctaaccctagggggctgctcttctgctgagcagctgcttccctgccgcctcatggcttgactggggtcccggcagccaggcttcagtgtggcctacacatgggacattccaaaccacctccgtcctttgagaaggcagctagtctctgaacagtggccagcctggggtggaatatgggaactgttaaccaaccacaacaccatgacagtttccagtttgaaaatagtaaccctcgcatcctgttgcggtgaccaagagggtggcgagttcacactttccagatgtgattggcatttccccagaagtgcctgccaggcggattgggcaggttaagccaaacctaaggtgttgacctgaagtacctctgtttcttttggctacagccttctgtttttctttctgaatcagcattctcagggtcctagaagaggactatggttgatttcactcagctggttttagacttctttgaaactggaaaggtgaattcattaaagaacacaggatttgtccatcttccctccactgccttaatctccctgtgacatggcagctgggcatcggcattgattttgtttgttgttgttgttgtttgagatagggtctcactgtctctcctagactggcgtgtgaatcacagctcattgcaggcttgaactcctgggctcaagctatcctcccacctcagccttccaagtagctgggactacaggcatgtgccaccatgcctggctaatttttaattttttcgtagagatggggtctcactgttttgcccaggctggtctacaactcaagggatcctcccacctcagcctcccaaactgctgggattacaggcataagccactgcacccagctggcatcagcattgagaaatcaggtggctaagaccagaaaggcaaagatagcctttgagacggttctgttgctttttacaatggagtcttagatttctagccagtaccatcatctcagaaagttaatgctgaggtttggagaaccttggcttaaagcaatatcaccttatttttttttatagcagtggtattttgctactcagatacagaatgccccatgtagtccagccgatgaaggacaaagggtgaggggcttgtcagggcattgcctgttgggaaacaccatcagctgactgatggggctggtttgttaacaatatgccgcggacagaggagcagctgtccctgagactaaagatgtgtcattgtttgtatctctaaagagctttttgctggagaaacccaaacaatgtgcaagaaaagtgggagatgcaaggctgcgatttcagtgtgaccacaaccatgttcttccagagaaaagagaattcttaattgtctttttctcatgttactctgaagtctctgggtttcttggacatttgttaagaatctgaaatatctcaagaatcacatttaagttcttcaggtatcaataatacttctgttccttttcttatgtccagcattggatgtcttcccccagggtttgaggtttgtcctggtgatattgtcaaccacaaccaaaggacagcatgttctgagcatcttctacacgcctgacaccatgctaggtgtggggcacagaaacataaaacagaggctttgattgcgtgtgggtttgtaggctaatgagatgaggcagaccagcaaacaaacaagtccatcagtgtgccaagtgattctatacctacgtctcttaactaagtcttctggtcagcttttgaacatgctcaggtctgtttaatctctctctctctctttttttttttttttttttttttgagacggagtctcgctctgttgcccagggtggagtgcagtggtgcaatcttggcccattgcaacctccgcctgcctggttcaagcaattatcatgtctcagcctctggagtagctggaattacaggcgcctgccaccacgcccggctaatttttgtatttttagtagagatggggttttatcatgttgcccaggtttgtctcgaactcctgacctcaagtgatccacccacctcagcctcccagagtgttgggattacaggcgtgagccaccatgcccggcctgtttaatcttaaaatattaaaaaagaaaaaaaagaaagaaagggaaaataatagaaaataaaaaccctgtcatcagtctgcaccacactcactgcaagctcccctttcctccatattcacaaccacattttttttttcttttttttgagacggagtttcactcttgtcgcccaagctagagtgcaatggcacaatctcagctcactgcaacctcctccacctcctgggttcaagcaatttttctgcctcagccttctgagtagctgggattacaagcgtgtgccaccacacccagctaatttttgtatttttagtggagacagggtttcaccatgttggtcaggctggtctcaaattcctgacctcaggtgattctcccgcctcggcctcccaaagtgctgggattacagccgtgagccaccgtgcccagcccacaaccacatccttaaaacagttgtctacacttgctgccttccttcactgactccctctcagtccttaactcagtctaatttggattcagtcctgtgactccactaaaatagtcttcccatgtccccagtgaccttgtcttgataaatctatgggctctcagccctcatcgtacttgacttctcggctgtagtggactctgttggccatgccctccttgaaatgctctcttcccatagtggtaaggagtatgggcttctggtcaaacagatatgggtgaaattccagccctgccacctacctgctgtgtggttttggatcagttacttggcttctctgtgcctcatttccatatctgtaaaaattagagtaataattgtaccacaacatagggttattattgggaggactaatgaatgagataatccatgtaaaatgcttagaaccatgcctcgcctattgtaagaattccataaagttttactattattaagagattttaatggcttgttatctcagtggaattacaacttcccagaaggcagtaaacattgaagtacaacatacatttctctattgcacattgactaagaatatcccatgtcctataagatagacaaggcactattcctctcctactggtgaggaacctggaccgctgcccacagccagcaggtaggtgggtgaggttgcacggcagcactgctcagagaggacttccccagcaagtctgaggagttgcacagtggagggacagggataggacctaggagagcaggggagacgttccaccaaagctgagttctaggggtggttttaagcaagggagagctgtgctttctttgtgaaagaaacagcccttagttggcaagttctccaatgcataactcccccaggcatggtaatgctgtttacaagcgcaggaaacccatggtgagaacaaaacttttcaagagcaacttctctcttgcccttggagatttatttagttgctactgaggtgcctggacccaagctgagatcccttgtgaggaagttgggaacacgtcctgtgcgtttcagaaatctctgttctttactttttctacaatcaacaccagcacatggaggggagagggaaaatagtgggatgggcatattgctgtggggaccaggcttggagacaccctgagaacaccaggcagcacaggtcaggtggggacacacgagggcatgggaggacaaggggtctgttacgtaatcccaacctgcttgtcagcagagccaggaatagcgcttcttaggagggatttccccccaggaaatcttcaaagccccagacagaggccgcagtccttggaagcttatgtatgtgtttggccacagtgagcccatcccgggtctggctctggtgctccagagaggactgtggttggcccagcatgtgagcgccaagcaggtctgtcaccgagctctccccagccactgcgcattccgcactttgtaatctcatcccaggctgccctggctcggcagtgtcacacggccctcagccacacagacaccagcgaactgaagcacacagctgctgacttggcttcctgctctgcctacgacagttgatggagagttccagaaactgggcccagagtctcacacagagctggctagaacacacatgaaatctgactttgggtgatgatagggaaattacctcccatgtgtaaaggcttccagccacactccctctatgtctttgagccacttcctgtttacatggccaccttttcggaggagaggggaagagggaggaggaggggacactgccggggagaggggagggttccctgggggatgtgaggaaagtggggaaacacggggggggggacactaaggcagaactgagatgagacgatgagaggaggtgagtgtatgtgcaggagacactgaccgtgggcatgggggtgggggacagggccgtgagaagagagaaggggacggccctcctgtctcaggcgctgagcccagtcctccctcttcagccttctgtgagccagaatggactcccggaggggatggagctgtgctgagggaagccaaggaagccacagtgcattccagagctagtggaaactatttttgagccagctatggagagatgatttgtaccctgagggcctgacgtctgcctggttataacactgagctgggtgaggatgggaagaagagaacccctcctcatttctgccccatcccaagctggctccttccttcctgcagccccactgcggtcctgctagccctctgcggtcacccatggctgccttgggcctctgcagacccagagtggcgtttgggggtgaatggagcagtggctttgttcctgggccagagttgagggtccccgtgccctgcctcagaggccctgctgagggtccccatggtccctgtgccctgcctcagaggcctccctgagggtccccgtgccctgcctcagaggcctcgctgagggccactgtgccctgctctggcatgcctcagggagctccccacgcagggcagaagggggcctctgtggtgtgagcctccccgccaaggctcagactggccgagcagctccctcaggctctgggtgttgtcagtcctggctgttcttgcttccgactgggcatggcctcggtcacctcatgaggccctttaactgtggaagtctgtgatttaagctgacaaaaagggtacccctgaacatcctccaaaaagacctgtgccaagctccccccacaccccgccatgataaggcagtgatgtttaatgagccaacactattctaagtggtttatagaggttaagcgagctaactcacacaacaaccctacccgcaaggcatttttactggccccatttaaatatacaaaggggtgaaacggcagccactgctggtaaatagcagattcaggaggccagcccgggcagcctgattccagaatccctgtgttaaccaccgcactccactgcccccttttccaggtggttcttcatagcccagctctgttctccactgcccatgtttcatggtgaacaggctcctcttcatcctcagccttatgcacaacttcccacctgctccttctcctgggtctgttggtgcctgagaccacagggtagggggaggttggggaggctggtggtgggaggcctcccacacccaggtcacacgtttctcgccccccagtactgcctttggctcattgccttccatcccctttgctccctcttttgagattgtctcatccctccacttttcctgtcacatacctcctggttaccccctacattccccaaagacctgatcctgcctcacactctcgccctctgccccgagttctgctgttctgggtgccttgcctttccctgtggacaagctgtactacacgtgggtctccgagttcctagagtgtcaactccagtggcacccacggcaatgccagctcccgtgtcctgatgccccatgtgtcagagatcacttggaagagcactgatgtttctgacagcattcctgcaagggaggcattatcctcatcaacacaggaggaaacggatcatcagagaagtttagggacctgcccaaggtgacccagggatctgaactgagctccagcccacaccctcagcttgtcacacagctggtcaccctgtttccctgaactcctctgctgttggaacttaaggcttcagcatctccccatggccacaccctcgccctcagcccagcctctccttcctcccactccatctctactgtgatctcttcagagtttgccattcccttgattccttcatttccccatcctgcacgactttcttctgaatggttctctttaatctgaagaatgctcaaatgtatcccatctgcaaaatcccccatcctccttgtcccccatctccgcctgtccccacacaactaggttacctgtgggagtcccctacgctcactgtcaccacctccttacaccctgcaggctggattctgtcctcactgctttgtggtgcagcctggtagctgctttaggatttgcctgccttgacctccacagagcgtcgatgctggggcttcctctcacgtcttcctgggctgacagggccactggctccccttctgcctcccagcctgccccttcctctgaatagccaggattcaattttataagaggaggcaagaggctgtgtcttggcccatagcccacacaagcacttttgctgatggaaagctgttgaattctatacagctgaaaatctgtataaatagacacatttacaacttcctgtccatttggctatcaatcattgtaacaaaggtactaataataacaacttgcatgtgtagcagttcacagcttgcacagggatttcacatgtccttcagtatccctatctatgtgtaatgaaaatattttttccgcaggcactattaaattcaactcactttgccaaggtagcattagatgttagctttgttttgatgaagagtcctgacttaggtcctctgagcactgtccgccaggatgttgttcccaatccccatgatggtgattgataggttattgatccttgggacagggccaaatgacgctggtccttttgatgacatgtgttcctcctagggcagtaggagggtctggggctgaccagaagatgcaggcaatctctgagcacgcaggctgagggaaaggcaggttgaggctcaactgcaggagctgagacatttggattgggataaaatgtgaccaggcctatgtagcttttgactgtctgtgtgggtcacgctttctgaaggagtcttggaagtcttggtttcaaccaaggtggcccagtagttgtgacttgtgtgccagctcccaccacttggtagaacctacttggaggactgcattgaggattctgagggcaagcccaggccccttggagaagactcctatgaggagacagcgatgcctgccacaagtgtggagaaggagatgtgcagcgtctgctgtcactgctttaggctgtctctgaaaggcagggaactacccaaggtaaactcaactgggactattatcagagtcacaaaggacaagcattctggtggcttcagtgatttcatcaagtgtgaagcctggggcttattttctggtttggctggctagggctttgctttgaagtcatcaaatattggaggccaaaaagccatgcagatgaaggttttctgatgtcccacagcccctccgtggctcccactggctcacccccagaaacgggctgggctccacacaccactgctttcctggcagcttctggctgggctcaagggtggtaggaagcttttaggaatggccagcagctctggccttgggtcttgtccctctccaaggaacggtggtgacctctggtgagccaccagctctcaccctctcctacccttgactcctgactcctcttcttataccctaggtcaggggcacactcaaccgccctgaccttgggctaggctgtggaactctcgggcctgcaaggtatcagacatacttaaagcagctaggcttccctgccccccagccatcccaggggaaatgaagagcagcaggcaccttgcctggctcccctctgcagcgaacaggccttttcacaaggaaggcccgttcccttaacacacatgcctcaccccaagcccaggcccttcagcaaaagaataggctacctccaaacctttgacacttcggcatattgtgccacattgtatttggataattttatggtgcagccagcaacaattagagtaggaaagaaaacaacacccgcctggcctctgtgccatctttgttgcttagcgctgagcatgccttttactttttatatgtttgtgttgtggggatcgtgtgatggacaagccatcagagagtgccagagccgtattaagtctacccttggagtgcatcagtgtctgcaactcactttgtaatgcatctttaaaaatacgggttgatggaagggcagacaggtggatagataagcagtcaagcagcatgtcacatgtgaaggtaggatctgggtggggaggatatgtatgtgcactgcacaatcctttcaactttgctgcaggtttggaagttttcctaacaaaatgttgggggggtggggaataatcccctcacagtgagccattttaattgaaaccaggctcttgaccagtgtgctccctgaggccagagggtgagggagttgtgtggattggatccatttcacctgtgaaggctccccgtggggagttcctgctgccaaggctcaaaagtggtgctggtcccagactggtggagaggaggggcaggaccgccctctcccttccagggatgagctcatgctgcccattgccccagcctctgctatggaacccttgagctgcgagacactgccctttccagtggcttacccctcacacgcccgcatctacacagttaagactgcattccacagcggactccgggcccgagtctggctttccttccctctcctggagggcttgccatctgcttcagcgctgcctgtgacatgggagggcacctgctcagcacacatttgctgtggctctgagacccctgggtaagcagagaggctgtctgagcacaggagggttgggaggcttggctgtccagatggtccccctgccgcctacaggttctgggcaccagagagtggacggagccaggggaagcaggggcaggaagttaagtggcgggtgaagaggctttctggagttgagttctgacctatattatattgtgggtcacacacattggtcgtccagggaaggtgctgggatccagttaacaagccaggtaactgactcagatgtggaagtaaaatgaaaggtctccccaccctgcctctccagtcacccactagttgatgagtggtgctcagcaaatgaaactcttggttgtattaatatcagccttcacataatggcattagggaaaaaaataatacaaagttgattttttaaaaaataccaattgtagcactgcgttctgcctctgattgtgtagaaaatggagactccactgtcaggcccttggtccccttggaagacggtgctatctagtcttttcacagtccagcacgctcacactccagaacaaacactcacactccaacacaccctcacacacacactccaacacacacagatgctcgcactcacacacatcctccctcacacttgcactccaacacacatacactcacacttgtacacactcatgcacacttgcacccactcacaaacatacacttaaatacttcctcacacacacttgcactcacacactcatacacactcacactcgctttctcacaagcacacacattcctctgagccgagtgatattcctgcccctcacacctgctgagtgggggcagcccccgcctctccacccttgcaggcgatggagaggaccccctgcaaggaagggccagggcatccccctgcaggttctagtcctggctgcctgtgctcataggaggcagtagactttggcactgagatcatggactctggagccagactctctgggtttgagtcctggctctgctgccactagctgtgtgaccatcaaccattgcttcacctttctgggtcttggtttcaccccttatataacaaggacaataatgcctgccccataagtcactgtgcggattcatcccatttctacgtgtaaggtgctcatataggaagcactggtgagtgttagctgctgctgctgctgctgctgttctcagcatctgctcctaaatcatccatttctgggtttcgggtccctgggcaggaattcagcttctaactaggactcagggagaacaaccgtgttttctgctatggctgtaacagatgaccgcagatttagtgacataaagcaacacggatttattttcttacagctctggaggtcagaagcctgaaatcattttcactgggctaacatggaggtgtcggcagggctgcattccctctgaggctcccagggagcatcggcttcctggcctttccagcctccagagctgcattcctcgcattccttggctcttggcatcctccccatcttcagagcagcagccagcatcctggcttctgttgtcccactgccaccttcctctgtagtccagtctcccttgctccctctcagaagaaccttggtgattacatttagggcccacagagacaatccaggagaatccctcatctcaaaatccttaacttaatctcatctgtgaaagctcttttgctgtagaaagtaacagtgatactctggggattggagtgggaacatatttgggggccattattcacacaactgaagcaggaggaagcttccctgggtcctggccctgtggcccaacttggccaagttctggaccaacttggagcaccagtctagacccaacccagccacacccgctgccagggtcccctgctgtcccttcatgctggctctaggccctctgtctatctccccaaacaggctctgagggcagagttggtgttccattctctgctgaatcccagtcctggcatgtggggcaccagatggttatgtgctcatgtgtaaaggtgagcaggtgctgatgtgccacatgtatccttttaggccatggcgagtgtcactgcggggaatgcaagtgccatgcaggttacatcggggacaactgtaactgctcgacagacatcagcacatgccggggcagagatggccagatctgcagcgagcgtgggcactgtctctgtgggcagtgccaatgcacggagccgggggcctttggggagatgtgtgagaagtgccccacctgcccggatgcatgcagcaccaagaggtactggttccactgacagccccaccttacttctcacccaggccaggcctgtggtccagccaggcagccctcagggccggctagcctccactcctcacctcctgcatctcccacccagcaagcctcgctggggagccgcattcttaccaaccgtaactgaaactgtggctttcaaatgctggttccataagggttttgtaagaaaacaaaaacagaacaagaaatacaaaactgctactctgttcctaaacacgtttagaaatcacgaaatcacagagttaaatgaaattaaattggtgttggtaccaaaaatagcaccttctcagagccttgagtgtactattgtgtgctttcacaggagaatacagtgtgcatcttttttcaaatgaattaaatcccccacactgatatctcccaaacagtgtttcacagaacccttatgggaaatgctgacaaacatcatcagaaggtaaattggaaagaggccgggcatggtggctcacacctgtaatcccagctctttgggaggccaagacgggtggatcacttgaggtcaggagtttgagaccagcctggccaacatggtgaaacacccgtctctactaaaaatacaaaaattagcggggtgtggtggcacgtgcctgtaatctcagctgctccggaggctgaggcaggagaatggcttgaacctgggaggcggagattgcaagatcgcaccactgcaccccagcctgggcaacaaagtgagactccgtctcaaaaaaaaaaaaaaaaaaaagtaaattggagagaaaggcacccgacctagataaggcatgccagaaaccactgcaaatggcttttgaattttctgctccatttatacagataatagaacacgggctctgtgctgctgctgaatgcagagattgtctagacctgggccccagccttcgctgactcggccatggcctcccatagccgtgctgacctcctcctgctcagccccgcatgctccaccagagtgcaaatgagagggaattacagaatgatgcccctggaaagcaggagtgacatttgctcttggagtttgctggagaaacagctgtgtcatcattacccatgctaaggaggaagggacacagaggatcagaaacaaatcataatacaaacgtcgcttctctttggctgaggaacgcatctgtgattttctcttggcagatttcccttccaaatgtctggctcgggctgataatgaaatgagttcatgctccctgcgcctgcagcggctgctggtcagtctgtgctcggaaacgttctgggtggcagaacccctggttggacatttgccataaataacccaggcgtgggtaattgaaagctggctgcagatggagagacaagatagacagggctgggttttaatgtgtttaattggaggagatgggggagagtaaggaagaagaaaaacagattcactttagacctgctaagagcagagaaaaaacagatccaagtagaaacagcccggggaaggttaggatcctggatctggagcccagatagctgtggccatcccagcacagagtcagccattatccacgttttgtatccgagggaggtgcccccaacctccagctcccagcagcagaacctttttgagcctatgcttctagtccttggggcacactaggtaaatggggagttggggtcaagctaggacaatacacatggagctcatcaaatgagtcttgccttcctatggagcagcaggcaatggaggattggctttaagtcaaaggcccaggggaaaacagctctagctttaaatgtttaaagcatttatttcttagaagacatagacttaataatttattattcattacacaatatgaagggagcaaggagagcaaagagatgccacaagggaatatcacgattcctttttttttttttttttttgagacagggtctcactcccgccacccaggctggagtgcaatggcaccatcacagctcactgcagccttgaactcctgggctcaagtgatcctcctgcctcagcctcccaggtagctaggactattggcttgtaccaccacacctggctaatttttatttttttgtagagacagggtcttgctatgttgaccaggctggtctcaaacgtctgaactcaagcaattctcccacctcagcctcccaaagtgttgggattacaggtgtgagccattacacccagcccactattccttcttatttgtctctgggccacactgaccctctgtctctttcacagcctaggtggaacttttttttctttttaaacgaagtccttttgatggtgacttacatcagagtctgttttttctacttgctgcttgttaggaggcaccaggttttgaatgtcctacatccttttttttctgggggtttcagggcagccagtcttcgttttctggatctaactaaccacacttttcactttgggtgagttcacactcaacacccagctgatttcagttaacaggctctcaagagcaaagtgtctctaaacaacttaatttttttaaaaggcagacttattttagtacatgactacaatatattacaagtttcaaccagtacatggggcatatgagttagactgatatgtccacatggatacttagggagtgtttcctggaagcagcctggagctatggtttaacaacagagaatcagatggcagggacagagaatcctggccgggagagaaagcagccctcttagccctgtgctaatctgggaggctggtgcagggggagggtgggggatcgggggcagctgggtcagcatgaatgactgaagctggaaccaccccttcctggcccccagccaggtctcagctgcccgccttccggggctgtgactgtggggagagttaccatcttgtttctaacttcagaatatttccataaagtcagtcccaggagagtgggattttgtagccatttcagggatggttgagctcctaagcatgttagaacctcttaggaagcctagtctgagaggtggggcacctggctgcagaacctcaagttctcctccgtaaaataaaggggacttagtgaaatggtctcagagctcccgtccagttctgctcctccacttcgcagtttctgcactggaaatgttttagtagctggcctcttaatcccgaggagttaagaaacagatgatgataaaggctctacattgcagttgcacatccctctgtatttttgccagagagctttctggacacccagcccctttggtccccacaggcctgtgggggcacagcggctgtccctcgtgtagctgaggtcaccccctgcactctgatggcctccctggcacacctggctcttgagtcctgacccggtttcctaggggcctctcctggtgtctcaccctcctcgaaggccaccaggcagcactgcatcacaaagtccctgagagcaacatgccccagcccactcctccctggagcttcgagctcaccatcttatagccccatcccccagccaccagaggagcctgggacctctccccttgaacatcagctttacagcccggcagccagagcttagctccccaccctgtgacctcaggaatcctgttctcccagatgtctccgaagacagacaaagaatgtgtgcaacttggttttgatgatataaagtataataatgaccatttaattgaacgttgtagttaagcattttcacccactatctgagccaccacctgctgttagcctgaggtgggaggagagaggctcaaggtgtcactttttggctgctcatccattttctagaggaggcccctgttaaagaacaagggttccctgggaggagccatcaccctagagcctgtgccagagcctagtgtagactgattcgtgggtaagtgggcagcaggccacgggggacctggcagatgggctctatctgagagggagaagggggctggagcccgagattctccgggacagtggatctcagccctcgacatgcatcagaattgcccaggaagcccagtccccggaggtgtggttgggcccaggtactgggagtttctcttgaaagctccctggagagttgaacgtgcaggagggttgagatccccgccctgggtgatgaccagggcgtgatgtggggaactaggacaatgttggggcattgagctctgaccatgggagtgtgaggagctctgggaggccaggaatactgttttatcacccagaaacctctggcttggagcagactcctcaccaggcattagatggaccagagtgcagatggatttgtctcctggtgtcagaatttgaaaggtctgcaacctgacatgtagacaagacatgccactaaactcacacaggctcctccaagaacccttgggcttcctcccataacaagaagaaaggcagagcagaaacattccctgaggctgaacatctgcagctggaaagaagtgaaagccttcccaggtcctgcactgtcaggagctcagggacaggtgtgggactgttctacattatctgacacccacctttatctcctcttttccaaagagattgcgtcgagtgcctgctgctccactctgggaaacctgacaaccagacctgccacagcctatgcagggatgaggtgatcacatgggtggacaccatcggtgagtgtgctgccaccacccgggcagtcacggtttttctccttcctggggaggagggtagttttagccttgagtcaggaggcactgcccaggcttcctgggcataactgtgggctccccatgaggacccggtgctggaaccatcatccacagctgatgggaatgtagaatggtacggactttggaaagcagcttggcagtttcctaaaaagtcaaacgtagaatcaccatacaatgtgccaattccactcccaggtatacagcctagaggattaggtccatatgtccatgtaaaaatacgtacaaaaatgttcacagcagcattattcgctatagccaaaggtggaaatgaaccacatgtccatcaacggataaatagaaaagaaaacaaagtgtggtccatctatacagtggacactattgagccactaagaggtgtgaagcactgaaacacgctacggcacggtgaggcctgaccacagtgcggagcaaaagaagccatgtattatatggttctgttcatatgaaatgtccaacacagagaaagccatggagacagaaagtacattagtggtgtcctgatgctagggagaagggaaaattggcattgactactaacaggtgtggatttctttctgtggtgatggaaatattcagaattagtgggaatggttacacaacattgtgagttgagtaaaacgactgattgtacactttaaaatggtttaaatggtgagggggaaattatgcaccttgaaagggaatctgtgtctcaggctcccctcactggcaggcttcccctctatcttcacctctggcttctgcaaactcctggcccccagctgcctgtctgtcttggtcctaacttacatcttttgtagacttccttgttcccacctgcctattttgactgactacagtcacggcttctgagggttttttgtctcgagacagggtctctgtcacccaggctggagtgcagtggcaccatcatagctcactggaagtctcgacctcctgggctcaggcaaacctctttcctcagcctcccaagtagctgggaccacaggcatgtgccaccatgcctggcaaatttttgtttttgtagagacggagtttcaccatgttgcccaggctggtctcaaactcctggggtcaagcagtccacctgcctcagcctcctaaagtgctgccattacaggtgtgagccaccatgcccagctccttcttaatatttgagctatatatgcatccagcacatattcgttgagcgcctactgtgtgccaggtgctgtctatctccttaggagactgtggggagtggaccacagtctggttcctcacatgcctgtcttcctgcccctgcttctatcttgcagctcagggcctggccgacctcaggttctgccagcagacctgggctggttgcccctaactaggcacacatggtcagagaaggaaacaatgccttcctgtggcccaaggactggttcgcttggtttatagcagtgacagccgttcatgcacagctgcttcccaacccagtcctctgagagagcagcagagaaagcttatgttccaatccatcatttaccctttttcttctttcttccaagcttttttcatacacacactcacatgctcactcatactcacccagcccagaagggagctgagacagaaagtccaggctttcgtgtctgataaccacactaattcatctgcttccaggttacagctccgtctagcagcaaggttgaaaaggttaaaaaggcaagagctggaaagcatttaccgccctagtgttcaccttctgttcctccccaggacccattgccattgccactgcatttcctcaccccttgcctcactttgcacttcccctagttcctttctctccaaaaaacagcccgctaaccctctcccagggaagccttggaatgtaggtaatgcctggacaggggactgtgacacccccaccttggggaatggcagcaagggggcagggagttgctgaggcagcttgaggaaggggcttcttaatatggaggagggaggccgggccacgttcagggccaggctggggacagcctgagttccacactgtctcactttatctccaggcatggccaccacggtgggcaccagcctctcacccagtgtcctcactgccctgtggttctttttgattttgcatcccaggaaggagttgctgcctcttggcctctgtggccagctctcagccccaagtggcctgggctgtttctcaaatatgaagccccactcaagcctcaaagggggctgggatggtttttctttctttctttatccctttaatttccgtggccaatcccttcacccgtccccaccccgaaaccattaaaaccttctgttatttcacatcacccccgactaacacttcagaggcttggagatcctctaatgtgttccacgtgtccccaaagccatctaaattcagccctgggcctgcattcttggtgtgagaaaactgaactcatcttcaaaggcccagcctccccttaagattttctgcccacaccccccatgccctttcctttttcaaggcactcggctccctgccccgaccatcagtggctgtgggctgctcagagagactcaggccattcccgcttggttttcttccagtgaaagatgaccaggaggctgtgctatgtttctacaaaaccgccaaggactgcgtcatgatgttcacctatgtggagctccccagtgggaagtccaacctgaccgtcctcagggagccaggtaggtgagggctgcaagggctcggcccactcagccagccctcagttctgatttctgatgccattctctgctctgggaccactgccctttctgtcctcatcggccttttgaaactgcagggagaggagggatacaatttcttctttttctttttttttttttttttgacacaggctgtcactgtgtcatccaggctagagtgcagtggtgccatcacagctcactgcagccttgacctcctcgggttcaggtgatcctcccgcttcagcctcccgagcagctggcactacaggcatgcaccaccacaccgggctaatttttgtatgtttttggtagagacaggttttcaccatgttgcccaggctggtctcgaactcctgggctcaaacaatccacctgtcttggcctcacaaagtgctaggattacaggtttgagccactgcacctaaccagtacaatttctcatgaagaccagatctgaggtcactgctgctccactcctagagtttagaagaaagatgaatgtgcagctgggggcccattcttggggcaagcgctagtgggagcgtgagtcagggcaatgggagttatagaaggatagggccctgtccctggggagggtctcatcttggaggagcacagacgtgaaagtaaccacagaacatacctaccctgcacagccaaaggcagcaaggagctgctgtgttctgcagggagggtgcagggcatctagaccaccagggctgggcagggtatcactcaagtcagggagcatccagctccacacacagcctgggcggggccactgctgcttcccagcatggattccaaggacaacggagcactgggttcaacattcctgctgctcccatgctcagctcccagcaccactgaagaggtcaagctttaatccaaataccaacattctgcctctgcttggacccagggaccaatagcctttgccttggagtaactggaatatctgatatcaccccttacattcttcttgggggtagggaggcaggggtggagcagaaaaagatttgctctcttcaatcgacagcactgcaaactatttttccaaattgagcccaaccacataatgtgccttcctgaggccagaggcagagagaagtgtggtaccagcctaggatgcacgcctgtaagaatgaggctttgtttccaatgctgtgtctgaggttctttgaaaacaagcacatttactccaagggacaccacgctaaaggcttacaaatgttggcccccagcccagaccttgtggaagtggcttcatgtggcttcatggtacctcctgcctgcccagtctgctcctgaaaccatgtacacgaaagctgagcgggtccagcatcctgcaatggagactgggccaggcgggatgtgggtgctgcccatgaggggaaaggcagccctgccccagggccctcatctagactttgccacacttgctgtgtgactttagaacagtcactgtcccttttgaatctttcattttttgtacattggggaaaccctcctgaggatctaagggagagccgaggagaaggcctttggaaggggtgcaactttcatctcagaaatgcctgcagttgcgtgagaggggcatggtgatgctagtggctttgcttaccatgcttctggtccccccagagtgtggaaacacccccaacgccatgaccatcctcctggctgtggtcggtagcatcctccttgttgggcttgcactcctggctatctggaagctgcttgtcaccatccacgaccggagggagtttgcaaagtttcagagcgagcgatccagggcccgctatgaaatggtaagcacgtgggaaatgggaagcagaggagacttcaagctcagaggcgtggttgagttcagcggtatgttagcaatagaggctcactaatgtctttggcattaaaaacaaaagaatcaacaccagaaacgctgtgcccagttctggagagagagaattgcacagccccagtgcagagtgagctgcacagatccctgttccagacccaggtcaggaaggtcatgggggcagaggcgctgggcgtgcctcaggaagagtctgaccagtctcagagagagcacagaccaacaggaaagctcagattcttatggtccattacaacactcacacctgcagtctggtcaccccaggcagactgcaaatgcccagaggactgagcgcagtcagtttctgctgaacctgggcttggtttctgttaaagctggaagggacttcagagaccttctgacccaactcctccttccagaggtggatagtgaaagcttagagaaggcgatggctttcctggggaacacagagctgtcctagagcccacggccgtctcctcctgagtgctctgcctgctgctgtcgcagggggctgacctgggaagggatcctagggcctgcgtctgtcggtttgagtgtgtgagctaacatgtgtcctcatcctcttccccgccgtgttctgtaggcttcaaatccattatacagaaagcctatctccacgcacactgtggacttcaccttcaacaagttcaacaaatcctacaatggcactgtggactgatgtttccttctccgaggggctggagcggggatctgatgaaaaggtcagactgaaacgccttgcacggctgctcggcttgatcacagctccctaggtaggcaccacagagaagaccttctagtgagcctgggccaggagcccacagtgcctgtacaggaaggtgcctggccatgtcacctggctgctaggccagagccatgccaggctgcgtccctccgagcttgggataaagcaaggggaccttggcgctctcagctttccctgccacatccagcttgttgtcccaatgaaatactgagatgctgggctgtctctcccttccaggaatgctgggcccccagcctggccagacaagaagactgtcaggaagggtcggagtctgtaaaaccagcatacagtttggcttttttcacattgatcatttttatatgaaataaaaagatcctgcatttatggtgtagttctgagtcctgagacttttctgcgtgatggctatgccttgcacacaggtgttggtgatggggctgttgagatgcctgttgaaggtacatcgtttgcaaatgtcagtttcctctcctgtccgtgtttgtttagtacttttataatgaaaagaaacaagattgtttgggattggaagtaaagattaaaaccaaaagaatttgtgtttgtctgatactctctgtgtgtttctttctttctgagcggacttaaaatggtgcccccagtggggattgaagcggccgtgtacttcctcagggatgggacacaggctggtctgatactccagactgcagcttgtcaagtaagcatgaggtgctcggggcagtgagggctgtgcaagggggaacactgagcagatacctttggccccttccagcttttactgacagagagttccaggctagacaccataaaaaccaccccttggtctccctcccttgttctgaggggctgaggctggaaatagattgtacagacaagcaagggttgagtggtggttcccacacgaagtcatctcttaaacatcattagcaatagcagttcccttccaaggcctcccctcactcccgaaacacttacgtcccatgcaggcccaatgcaaaaaaacacatttgagcttttttcccgcagggccatgaagtccccttaagttcccatatctaagatggttgactgaccctctccccttatgtacagaagaggaaactgattctcagagaggggaagtggcttgcccgagtgtttgttaggaggttactgaatgacaaactgttcctaagaccccatctcatgctggccagagggccagcctcctcattcctgcttgctcttagaaaatctttcactgatcattttttgtcactggaataacttcaaggttattatgctttcattccaaatggatctgtcctcagctctggacccaattccccttacttcattttggcaaacactaagtcaaatagtgaaatgcctgtcactacatagaacctattacctggggcaaatacgaacagattgagtttccttcatcttgtgtaaatatgatgaaacagagacctggtaacttggtgacactgttaaaccctttttgggataaagccaaatgtaaatgaaaacattaaacagataaattgtggtgttgagacttttctgaattgagaaaaataaatgtaattttggaagaaactttgggtttctctcatgtttaattttgggtttcctggagacaaatcattaactggctcagaatctcattttctctaagggcacgacattctttttttttttttttaagagaggatctcactgggtcactcaggctggagtgcagaggtgcgatctcagttctctgcagcctcaatctcctggtctcccgtgatcctcccaactcagcctcctaagtagctgggactacaggtgtgcaccatcacacccagataatactttattttttgcagagacaaggtctcactatgttgcccaggctggttggtctacaactcccaagctcaagcgatcctcccaccttggcctcccaaagtgttaggattacatacgtcagccaccgcgcctggcctgggcacaacattcttgagccacagatagcaaaggaggatttgttctagttccacttgacgtggaaagtgagggtgttttcgtctgacgccgagggatgttacggaaccagtgctcacggtgccttgctgccccctgctggaagctcttggcatgagctgtttggagatctgactcccgagattccgacccaatgtataattttaaaggttatccagcgagctgcaagtgaccacaaagataatctattccaaacgcttcatttcacaacccacccccagatgggtcattttgtaattttaagatatttttatcaaaatgggcctttggccgagcatggtgtctcacgcctgtaatctcaacactttgggagaccaaggtgggaggattgccaaagcccaggagttcgagaccagcctgggcaacacaatgagaccctggctctacaaaaaagaaaaaaaaaaaaccagggaattctcattcagcttgattgactagtactttattaaactaaccaatcgctacctcttccagggaagaaatgtgatttttaaatttgtttaattaggatcaaagcttgaggtgattatcatga

SEQ ID NO: 625 - DNA, 16677 bp, Human
tatctacaaccatctgatctttgacaaatctgacaaaaacgagaaatggggaaaggattccctatttaataaatggtgctgggaaaactggctagccatatatagaaagctgaaactggatcccttccttacaccttataaaaaattaattcaagatggattaaaaacttaaatgttagatctaaaaccataaaaaccctagaagaaaacctaggcaataccattcaggcaacaggcatgggaaggacttcatgactaaaacaccaataacaatggcaacaaaagccaaaattgaccaatgggatctaactaaattaaagagcttctgcacagcaaaagaaactaccatcagagtgaacagacaacctacagaatgggagaaaatttttacaatctacccatctgacaaacggctaatatccagaatctacaaagaacttacataaatttacaagaaaaaatcaaccaaccccatcaaaaaatgggcaaaggatatgaacagacacttctcaaaagaaaacatttatgcaggcaacagacacatgaaaaaatgctcatcatcactggccatcagagaaatgcaaatctaaaccacaatgagataccatctcacaccagttagaatgacagtcattaaaaagtcaggaaaaaacaggtgctggagaggatgtggagaaataggaacacttttacactgttggtgggactctaaactagttcaaccattgtggaagacagtgtggcgattcctcgagggactagaactagaatttgacccagccatctcattactgggtatatacccaaaggattataaatcacgctgctataaagacacatgcacacatatgtttattgtggcactattcacaatagcaaagactcgtgaaccatcccaaatgtctatcaatgatagactggattaagaatatatggcacatatgcaccatggaatagtatgcagccataaaaaaggatgagttcatgtcctttgtagggacatggatgaagctggaaaccatcattctgagcaaactattgcaaggacagaaaaccaaacaccgcatgttctcactcataggttggaattgaacaatgagaatatttggacacagggaggggaacaccacacaccggggcctgtcgtggggtggggggaggggggagggatagcattaggagatatacctaatgtaaatgacaagttaacgggtgcagcacaccaacatggcacatgtatacatatgtaacaaacctgtacattgtgaacttaaagtataataataataaaaaaaggtaaaaaaaaaaaaagtagacacatactataatcaccttgaaaaaaaaagaaagtctttcaaagagataaaaaattccatatactccacttcctacaattctggcagtttccaaatacttttacttatgtgaaaatgctatcatatccaagagtgcctttagagctaagctaacagtaggctactgatctttagcacattgctttttctgttgtgttattcagggggctttctcacatttatgtttccatttttcacatttcacaactttctttggagcacagatatttcaggaagattttagagcctttgaatagcattatggacttttttgcattaatttttacttttacaaaattgtgctaaatattatttctgttaattagtgagttttgttgggggccccttaaattggaaccccaggctatgcctcatttgcttcactctggtcctggccctgagagaggaacacaaaagggatggttagaaaaacaagaacaaatgagcctcccagaattttctcaaacaacaggccagttaattaaggaaagtagatattacatagctaggtataatgaacatgcagtcagtggattgtctcagtaatttatggagataaccaccaacaaaaagtgtatgtgggtggggacaaaagagagacaacaaagtactgcaggcagaaagcttccttttgctgattttgcctcacagaattgagagtttgttcttacacacaagtttaatgccaccttcctctgtctgccatggaccaacaagcaatatatgctgagttaaacttacccacagactcaggcccagaaagttcttcaccttcatctcttcctcggggtaagtggctttaattttcctttcggcatttgtatgtcttccagaattagatcttcctgttacatttatggctttaaatcattgctttaaagatgagcagtagttttatattaatgtttaacgggtgttgcatggcttgcctgtagataatcacaactttgggaaaaaaaatttaaacctcatacatttatttttttcaatcaagttagcatgaaaagcaaacatcacttgtcttactgagccttggttaaaagactctgaacactttaggctaccctgggcacactgcctattggttacccctgctctacagggatggaaaaaaggaagaaagaaagacaaaagaaaagaaaagaaagaaagaaagaaagaaagaaagaaagaaagaaagaaagaaagaaagaaagaaagaaagaaagaaagaaaggaaggaaggaaggaaggaaggaaagaaagagaaagaaaagaagaaagagagagaaagaaaggagagaaagaaaaagaaagagagaaaggaaaggaaagaaagaaaaagaaagaaagaaaaagagaaggaggaaggaaggaaggatggaaggaaggaaggaaaaatattttacatgtatgaactaaggaatatttaagacacattgcaaacttgctgtaataacaacctacgttattccaaattcctctacaaaatatcaatactatgattaagtcccagtgcattttcatccataatattcctttcagaatacaacgtgtaggccagttgcagtggctcatgcctgtaatcccaacactttggtaggctaaggtgatttgcttgagttcaggagtttaaggccagcctgggcaatgtggcaaaacctcatctctacaaacaatacaaaaaaatagccaagtgtggggcacgtgcctgtggtcctagctactcgggaggctgaggtgagaggattgcttgagcccaagagatcaaggctgcagtgagctgtaattgtgccactgtactccagcctgggtgacacagcaagactatctcaaaaaaaaaaaaaaaatatatatatatatatatatatatatactttttatacatatattttatatattttatatatatatatatatactttttatacatatattttatatattttatatatatatatataaagtgtaggcttaatgagtaacatacttcactctctcaagagaggggaacactttctggaaaaaaaatcatattcaagatcaaagatttgaatatcattactacctgatagtttctagtttgaaaagtatcacagcttagaaagagacaagccacaaaaatactcgagcatatcagtaacgaacctacttaccatttgttgaaactggcactttcctgtgtctctgaagagttagcattctgagtgaaagaagcggggaacaccaatgtgaggtaacacatgatggatagcatggcctgtggatggatgggaagaaactagaaactgaggcagaaaatcagcatgaaattattatgacacattattattttctgatatctaactgaatttactatcattgataatattacaattgtttaccaatctgatattcattccatgtcatgccaagcatttgacttgtgctgttttaagactgtttaagttttaaactattgaattctcaaagttttaagtcaagaagaaagtcttagagccgtcaattaagtttcagtataattttcacataagagtagaggaaatcagagggttctaataactatagggaggatttggttgagtaacatttttttttaaagaaaagactaagtctttcttttcctctattcatatctagcaaaaggtggaaagtgggcttttgtcagaaaatgaatatagaggtagtgagactcttcccaaatgttgctatgatcccaaaccaatggatgcagaaattttttctacttggattgtaataattatcctataaaatgtcattctgagagtaaacctgaagaaaaaataagagtagaataaagccagagcaaaatatgtgactgtagaacactggtctgatattgaatgatagtaaaaccactattggtctctggctaaactgctgaggctgtggtcactctgtagcaagcacggtgattgtgtctaaggcagtcaacaaaaccagaaggagagatgtgagtgataaccgatcttgcttatggccaaatggccaagggtttggtctgttagaaaagtggataaggtgtttgcaaaaatgcccctagagtttattcattcattaaaaaataatctcctactctgcaccaggcatgctgtgaatacagcagtgaacaaaatagagaaaattattttccttcatagagtttatagtaaaatagaggcacacttgtggaagacagtatggcgattccttaaggatctagagctagaaatacaatttgacccagtgatcccactactgggtatatactcaaaggataataaatcatgctgctataaagacacatgcacacgtatgtttattgcggcagcattcacaatagcaaagacttggaaccaacccaaatgtccatcattgatagactggattgagaaaatgtggcacatatacaccatggaatactgtgcagccataaaaaaggatgatttcatgtcctttgtagggacatggatgaggctggaaaccatcattctgagcaaactatcacaaggacagaaaaccaaacaccgcatattctcactcatagtgggaattgaacaatgagaacacatggacacagggcagggaacatcacacaccagggcctgttgtggggtgggggtagggagaagggatagcactaggagaaatacctaatgtaaatgacgagttaacgggtgcaacaaaccaacatggcacatgtatacatatgtaacaaacctgcacattgtgcccatgtaccctagaacttaaagtataataaaaaataaaaattaaaaaaatggaggcacaccatcaataaaataaacaaataactaagtcagtataaaagatgagacggtgttaatgttattgagaaagatttgaatataggatttaactttcggggagggtagcatatcaaacagaataatcaaggaaggcctccctgagaagatgacattgagtcaaaacctgacagaagtgagggacaaagacataagcccctgagagagaagccttctaggaaggtgaccaacaagtgcaaacacatcgaaatgaaaacacgcctgtggtattgtaggaggcatctgcgtggagagtgagcgtatggaggccagatggggtgagggcaaaatgtgaaaccactattggactctggctaaactgttgaggctgtggtcactctgtagcatggtgattgtgtctaaggcagtcaacaaaaccagagagatgtgagtgataacatccaacagaagtgggcgccagcttaaatagggacatatgagccattctacagactcagatttgcctgatgaaaagccattggaaggtttagaataatgaaatgagatgatttcacatactttttaaactcaaatggagaacagccataggtaggtatttccagatagctaacgtccgccggacccctgtagtgattcattgtaacttcattaattctaatgtcacgtggtgccacagaaacacagtacaggagtacattcctcccagacacagtacactccactcaactccttacattttagcatgaatgaataacgatttttaaaagtcaccaagttgccttttacctatagttaaaaaaaaaaaacaacttttagaaaaaaagaactgctgttcattgaacagttaccatgtgccagacactgtgcccagcatttagaagaattgtttcatataatcctctccaaaatattatgacatagataatattccacatttcacagatgaggaaatctgtgggttatgaaggttgaacgtattttccaaaataacatgttcacattcagatttgctagatcggaaagactgttcttaatcaatgttagcctttagtaatgaaaattactaaattcatgttagtaatagaattaggctgggtgcggtggctcacgtatgtaatcccagcactttgggaggctgaggcgggtggatcacctgaggttgggagttcgagaccagcctgaccaacatggagaaacccgtctctactaaaaaaaaaaaaaaaaatacaaaattagccgggcgtggtggcgcatgcctgtaatcccagctactcgggaggttgaggcaagagaattgcttgaacctgggaggcggaggttgcggtgagctgagattgcaccatgagcctgggcaacaagagtgaaactccgtctcaaaaataaataaataaataaatagaattaagttaacacttaaaatagtgactatacagagctttctccactagacaaacaaacttagagtttcaaggaagaaaacggtggggaagagaagagacagaaaggtgaaataacgtacatatataaaactggaaggaaagccatgccagtgctgtcttgggcttattgactgcatgtagacattcttgtatcacaccagctctcattagaagttctaggccaatattaccaagcttggtttcctcacattcagatatatccctggggccttggagtctcctctaggtatctactcctccctgcccccctccactgatacagcatgtcctaaatagtaccagacgataatccatatgttacaaccctgaccccagtgtattatggttcctcccataatctttgatcacatctaacgctactaaattctatctcctcagggccgttttagagagagctgattcacttatatcagtgtgagcatcctaatgtgagagattatcaggtctgcaaactggactgcacaacttaatcctcaaggatactgtaccattaaaagtagaaatggcttcatggccgttctgaaacatataaagagactaaaggataatattatagtatatctgatgctaaattttttaacatgtaactcatagcaagtaatcacttacatggaataatattagaaaaaataaaaaggaatagacaatacaaataaatcaatagcttcagataaattagaaagcctttattcataaaagctcctagctctaataatagaatttataaagtaatttataattataatatatctaatatgttaaaaaccaaatgagagcagagggagacttacaattaaatcagagataggggagctatttaggcacaacttctagcagtgtaactgagcaatatactaccagaataattccttatcagagttgatttaattttggaagctatatcccagtgtttctccaaaatatttttataaatctctctttattttttttctattaattcatgttttcaaagatacagagcaaaatacattgataaagttgcgattaatttataacatttcatcaatataatcataacttttgaagaacatgggagattcattatatagtaattgatgtgattacagagaaaagcagagatatctgacacttggtttagactatgcgatgttgtagacataagcgcatgttatgttatactagtgataatattgaaaaaggtatgcagtcacaaaaccttatcccttgatggcttgggatcccaagttggcttagacccaacttggagatgattgttctagacaacagcaaagcagaggattccatgtccaagaatagaatttctgtataccaccagcacctaacatggtacttggcacaaaatagagagagcctcaaaaaatatcttgactaaatgaaggtcttccttcttggacaaaatgctttgacttacttcatacattaagacatgcacttaatttttgtatagcacttggcaattttcaaaacatctttctatctatctcatttggttcttacaccaatcctttgtatacacacatgcataagcgttcatattttatcaatgagcaaactctgttggatctgagaacccatcttgcaggactctacttttagaatgatggatagaggttgttccctgcccccatcccccaagctgaatctaattgtccctatgttatcccaagtacatttttgtgccagatgtactccactgagttaaccaaggttttttgtttcgtttgtttgtttgtttgtttttgtgtttttctttttaacttttcagatgtctgtcagggttcaccttggcatcaatttgccctgaaacttagctgtgctgggattattctccttgtcttggttgttactgggttgagtgtttcaggtaagtggggcaccatcatctgtttcataatacttactctacttccattacgtatcttagagcatctctgtaggggtgggttgcccctacacacctgtgggtgtttctcgtaaggtgggacgagagatttggaaaagaaaaagacacagagacaaagtatagagaaagaaataaggggacccggggaaccagcgttcagcatatggaggatcccgccagcctctgagttcccttagtatttattgatcatttgtgggtgtttctcgagagggggatgtgtcagggtcacaagacaattgtggggagagggtcagcagacaaacacgtgaacaaaggtctttgcatcatagacaatgtaaaggattaagtgctgtgcttttagatatgcatacacataaacatctcaatgctttacaaagcagtattgctgcccgcaggtcccacctccagccctaaggcagtttttccctatctcagtagatggagcatacaatcgggttttataccgagacattccattgcccagggacaggcaggagacagatgccttcctcttgtctcaactgaaagaggcattccttcctcttttactaatcctcctcagcacagaacctttacgggtgtcgggctgggggacggtcaggtctttcccttcccacgaggccatatttcagactatcacatggggagaaaccttggacaatacctggctttcctaggcagaggtccctgcggccttccgcagtttttgtgtccctgggtacttcagattagggagtggtgatgactcttaaggagcatgctgccttcaagcatctgtttaacaaagcacatcttgcaccgcccttaatccattcaactcttgagttgacacagcacatgtttcagagagcaaggggttgggggtaaggttatagattaacagaatctcaaggcagaagaatttttcttagtacataacaaaaaggagtctcctatgtctacttctttctacacagacacagtaacaatctgatctctcttgcttttccccacaatctcaacataatttggctaccccaatcttagtgtaaaatcaatgaataaaaagtcatgaaacaatgtttctaacagtcagtccatatccactttggataccagcctttcatatttgtcttcctaactgccctgagagtcatcacggggtattatatatgtggcccaagaacttttgaaaaaaatcacaattgatgataacaaagaaaagaaaaatttccagttatttatggtttataatgtacttactaaaattccagattgcagtagacaatctctcccttggaacaggcacaattagactcattttgaagatgataaagttcaggtgagactgtaggcaatttaagagcttaagtaatccccttagattgacttacctagtagatacaggcaacctaatgcctgtgtgagtccacctgttttgttttttcttatttgtttctgtatgcttcctgtaggtgagatcttttttttttttttaccacttcgctaatacttttattttctgtccatattcaagcgtgttgagattatctagtttcctaaagtaacaaatataatatatccactccaccacacatttcagcatttaatactcttgtttttccttatgtactagtgacatccttaatacagaaatcatcaatagaaaaatgcagtgtggacattcaacagagcaggaataaaacaacaggtaattgtgtggcttcaatttcctaagaataactgttaatatttggtagatttcatgtgttaccttaggcacaattcataacaatccatatgttaagatattcttatcattctgcttttctggattagaaaattgagacataaaaagattcaacaacttgctgagggtcacataagcaccaagtgatgaggctgggaattatatgtaagtggtctgacttatgagcctaaggttttaaccagcaaggcatgctgcctcatgaggagcctctgctaggatactccactgttgataggaaatatgtgaaatatctgattattttagtgagctgttaagtttggtctgaagttaattgatagaacttaaacatagaatgaattctttactatttattatatttcctcaccatgcagccacattagtcttgttccagtgtgtgttaataaaaaaaggtgactactgttgagtgactatagtggaatatgatctgtgtgcacattctcacagaatggaagttttaagaaaacctgaaagtccttctggaaaattctatccaatagatcacattaagtaggtaaatacatcgtttagcaattggaaattttcttataattttttctccatggtatttcttattaatttagtgaaaataattatttgctatgcattttgtgcatcatttaaagtcagtactttttacatgagttttatattgttgcctgtgcagtgaaacaggcactggtgatgaatttaaggaaactgagaagtagtgggaaatatttcatctgactggctggacttaagttattctgtctctcactgtcttaaaatgtaagatgtggcagtttaaattattctgatggtgttttcctattttaatattttatgattccatttatgctcaagataactggtcactaattcccaattcttggtactagaatgaacagtaggtctcaaaaatctcaactttataacaaattcattgttctcacagtgataatcaaaaactttgagcatttataatgacctgtgtgtgtgtgattggttgtggtgtgtcagggataggttagaaatataacatttatttcttatttctgttttttactttagagagaccgggtctcttaaactgcccaatatattggcagcaactccgagagaaatgcttgttattttctcacactgtcaacccttggaataacagtctagctgattgttccaccaaagaatccagcctgctgcttattcgagataaggatgaattggtaaatcattaaataaaataccttaataaaacttaacactttctttaaaccatattaatatgtctgtgcattagcccaggggttttatgcaatggaagtgatgactttgacttcacaatttgaatgactacgtggatatgtaaacaaataattaaatataaggtgatgaatacaataatagaaataaaaacatagacagaaatatcacaaagaaggaataattaatgctgacgacgagttaggaaagacttcagagatgaggtgatgcttgaactaggttttaggggatcaaaccaggaatagataagcagattcaatatttttctgttccatttatagatacacacacagaacctgatacgtgacaaagcaattctgttttggattggattaaatttttcattatcagaaaagaactggaagtggataaacggctcttttttaaattctaatgagtgagtattagatgagctaactttaatattcaatttatatcaggtttacactgcaaggtagtaacactgaagattgagttttgtagttttaatttggtttaaaaactcaagaagttctgaataggctaagaacatggatgatttcaaagttggttggaaagttctatatatgaaaagatatcagctctttatgagaaaatatatttttatctgcaatggagttttaggggacaggaaatagactaacttatttgaaacgggcacattaaattaaaaatagtgattatctggagaccactggcacacagaatgtcttacgttgtatttttcaaactgtgggaaaatatacattagtaggtaaagagaccaatttagtgggtcacagctggcattaaaagaaaagaaaaaatagtaaatatcagagtgtggaacccagacacccacgttgtgacaaaaattgcagtatatttgaaccactggtgtgaaagacagaggtacttgagacgatgtgatgaaaacatgtctaacccacaaaagagctatttgctgttttctcttcagtgtgacatgcttttgtcttgtgtaagatggtcaaaattaccatcaacgtactatgagggttgatgcgacacaggcaaatttcatgttttagcagaattcatggataattttgcagaaaaaggcagggtgttttcttccctcacaagcgaaaatgtataggccttcaaccacatttctgtaaagaacttttaatgagtttttcaaaagagataatataaacagttatatttaatgagtctgtaaatgatttagtcaaattggcagaatttacatttaaaatgtattttccgtcactcaaaaaacaagaggttaaaatctaaaacataggagaatgttttaagtttgtctacattatactaagataatttattaagtatggaaagtattaaacactgaaaggaatgttggctcaatcagcaaagttttgacattatatgagccacattctaaaatattttataaagtgtaagattttaaaataaagatgatttaaaataagtgttctggactagaataaatttatgaaaagccaaacatacacattatgtttaaaaacatctctcttgatttttatattgctttctgggggttattttcaatattttatttacaaataaatgaaagtaggtttgctattaatttatttttatctttccacacatggtattggtgaattagcatttattaagtatagtttgtgtgtgtgtttcttaatggggtcataatgcaaaatgtttattttattgtggttcacagtaaaaaataaaatttgaaaacattgaaatgtgaacataaatatgtgtaaagtggatggaggaaattcagttgaacttttcattttattctgaggagaaagatgatgctttaagataatagtgatcaggtaaacctggaaggtatcacgttatagtagaaaaagcaccagttagactctgcttttatttgcaaggcaaggaaagaaagggaagaatcataatttttttacaggattattttgggggctacaggagacaatgttcaagagctagccagatgtctcatcaaggaaggcctgtaaaaccactgagggccttttggaaaaggaattgttgacttggccagattggcatttaaaaaaattaccctgataattgaagaaacaattaaaagggtggaagagataaaatatagggaacttttgcaatagcccagttgaaagaagttcttggtttgactagaaggttgggcagtaggaagaaatcagacaagcagccccaagaggctacatgagaaaatggaacaaaggactaaagaaaagctgtgatggagcccagcatgctgccaccacctcatccgtttgagacaaataggagagtcttgaactcacaccgtccttgcaactcaaccccaatacagcctgtccctttgtttgaattatatcatcacctcctacctgcagtgagccacaggactcatgtctgtttgaaactaatattatgtttctgcagacacctgttcacctctgtttggaatgagaatgaaaggaacctctgactacataaccatgaactgagccactttttctcactgcttccaaattctatagaccctgaatatccatcatgcctctagatatttatcatatttactcagcacatatttttgaagtattgccacattttcatatttcatctccatgcctcccctaaatattaggtggctatagcctaaatatttaataaaactgtggctcagtaaagttaggaaacatttttaatgtgacctgttagtagaacaataagaagactgaatccccagtttccaaagtttctttctttttttaatgtaattgtgaagtttcttgttagagggattcttttccaatgaagatgaacttggaagttccagaggtttacattagctctatcttaaaagttcataccattatatttgtgaccgtgtgccttctttgtttaatagtttatcattctactgcttcctgagagtcctaggaaataatggctaagtgagaatagctctgagaaaatcataaatgctaagacagacttttcttttgctccacagcttagaaattagaggtgatgctaaagaaaacagctgtatttccatctcacagacatctgtgtattctgagtactgtagtacagaaatcagatggatctgccaaaaagaactaacacctgtgagaaataaagtgtatcctgactcttgactatgaatcccatctcaatttatttgcttcccattactgatctctgtacttgtagctgcacatactattggtactacctaatagtgccacatttagtggcacaaagtgaacaattctgagaattgtacaactgttatgaatcttacagaagttcatgtttatcatattcattctattaaatgaggaaacagagacatagagaaaaacgtgcatcgttttaaagaaacagtgatattctatggtgaaggagtgaaggatgtccccgaatatgccagattggtatatgattgttttgtgtttaaaacagtggagaaattgtagattcagaaagggagagctgacctgtctcttcccgcagcggcaagccgtgaagattcctctgggagggctatccgagtcatacgagggcaagaaaatagctcttatcgccagagacctggaattggatgctgcaatgaacctgaataaagatacttaataaacacctatctttcacctattttacagccccccgcaaccaatatatctcctagtgactcctctagaaaatttattgcccctagccagcttttcttcatcctgtcatttcttttcaaatttatcattcttggtctaaaaagcataaaagcatcttgcttaggccacttctatggatttcactctcttgcgagttcctcatgtacatgcaaaacgaataaaatgtgtatacttttattttgttcatctgcccggtgccagtttagtttctagatccaatagaagagcccgctacgagctaacaaggggctttggaggtgatctgtggctccccttcaatggaaagaaccccagacctgctgaagagaattagattctaatcctgacgtgtatgtgtggacttcattgatcccttccatgtaatggctcatctccaggaaaattttagtaaataattgctaaatccctgtgcatccatcatagtctatcattttttaaaccagtacacaattgagttgtggcagaacattgattaaagttcattcttttaactctgacaccagaatcccataattaaaggagtttgggaagggaccttaactcttcttgccattccatcattcttcccattttaattttaatattacatcattttcttccatattgtcttctacccacggctcacacacacaagctatagaaaatatgtaattaaatctttagttattctgatggaaaataagttataccttttaactgtgaagttaaagttaaaaaacagaagtatttattatcataaatctcttgaatgtccacctttcttaaaaatatgccaaattatgcatggaaatcaaataaatgaaaatggtgaatgtacctgataagaagacttatcataataaaattctgaaaaatagacatctgcttaccctaataattcatcaccaaattgaattatataaattcaagtgcatatgacatggctaaaataatggctcaattcctatatcccatacatgaggagttataatacttgttaaaacaataacttttgaagagatcaaaaatcaaagcaaaattcattttgtgccaattacttagaaaatagattacttagggaaacattttaggcaaatgtgtcattacaaaataatacacaacgaaagtgaggtttggaagtatttgatactttcggggaaggacacgtaatgacaccagtagagtagaaatctgatgaaaattgtcccatgatggaaaacgcacattcccacctttttggaatgatgtcgatagcagtcttctaaagtgattcaggataaggctatatccacccagttagtccagaattcactccaaacattgaccttttcctccttctgtacttgttagatctgaaatcaagcagccttaaagcacacatccgaaagaaaattttgcagaaaacttaaccccgagaagttaggttatctgtcaccgtaatgtgctattgcaaaatcagataattaaataaatttactatgtat

SEQ ID NO: 626 - DNA, 14243 bp, Human
ggcatgcaccaccacacccggctagttttttgtatttttattagaagcggtgttttgccatgttgcccagggtggtctcagactcctaagctcaggcaatccgcccacctcagcctcctaaagtgctgggattataagtgtgagccacagcatgtggccccaataggttttattaagcaactactgtatcagcaaataccaatgattctcaaactttgtgacaaaaatcatctggaggatattttaaaacagatcactgggtcctaccaccagaagctgctgattcagtacatctggggtgaaacccaagaatctgcatttctaacaagttcccaggtaatactgatgctgatgttcagaacaaaccacacaaccacaatttgaagagcagtggcttaaagagactttgcaaggtaaattctgtgatctcatagtgtgatatctagtgttaagtagggcatagagaccagggtttttttgttttttgttttttttgagatggagtctcactctgtcacccaggctggagtgtagtggtgcaatctcggctcactgcaacctctgccttccaggttcaagcaattctctgcctcagcctcccaagtagctgggattacaggcacctgccaccacgcacggctaatttttgtatttttagtagagacggggtttcaccatcttagccaggctggtcttgaactcctgaccttgtgatccaccccacccccaccgtccccttggcctcccaaagtgctgggattacaggtgtaagccaccacgcctggctgagaccagactttttacaaaatcactgttctgtttacaccttgaattagactttaccaagtagctaactactataacttctcttttgaagtattttgtattaaacataggtctcagactttcaagttaggattttttttttttttttttttttgagatggggcgttgctcttgttgcccaggctggagtgcaatggtgcgatctcgtctctgcaacctctgcctcccaggttcaagccattctcctgcctcagcctccagagtagctgggattacaggcgtgcgctaccatgtgtgtctgattttgtatttttagtagagacgggattttgccatgatggtctagctagtctcgaactcctgacctcaggtgatctgcccgcctcagcctcccaaagtgctaggattacaggcatgaaccactgcacccggcaaatgatcatttaagcaaatgatcgaagactcaagacacaaaactacctgaagggagtggctcccacatttgtagggtaccttacagagcaatttcccttcatatgattttgcaggtggtggggaaactctccgggcagttgtggcctgtgctacatcacccattgaccagaggtgccagtactagtgctcaagatcaatcgatcgatcggtctacctacctatcatctattgaccttcagtgctactaaaaacactcggatcttctaacgtctggtccagtctttcaccccatcacagtgagaggctgtgcacaggggtaacacaggcaacggaattatatgaggcaaacacagagatccaggtttctgggagtagcaatgaggttcagccttgcagtcacaaaggcaccactaaaaggcacaagtaatggcaggtaatgaggccttacttggagcagtttagagtacttcccacgtgtggtgacgcatgccacacactcaccaccaccaccactgccacaaatgaagtgcacactccactgctcctgtcctcaggaacctggaagcccccacctggtgtccgaggtgtggctcccactttaagcgtggggcacctcctctccggcctcaaacctaccggagctcccagcaggctgcggcacatctgacggctggaaactagaacccctgggtggggactccttaaggctcctcccggaagcgtagggacctcgctgcccacacgcccctccctttcctcctctggcgtcctggggtctgaggtgggcgtggccagaccagctttaggtccggggagtgtctcgccagcggcagcacacccctgtaagtggtggccagggctgccgtggcaaaatgagctgtcaactttaggttgacaggggtgtggccgcgaccgcaagggcttttgttgccgggtggacccaacagggatgggctgctggggacagctgctggtgtggttcggagccgcgggtaagtgctatctggcggtcaggggaccgtccagcctgaggcactttcctaggcttgggggtggccggtcaacaggccaggtgtcagtggttcctccagaggcctcgaactctcacagccaaatttctccggtccgtgcttctggagtgcgggccgagaagcgccaagtgcgtgcgaatcccagagtctggatcacgcagcttgggaaggaggaacattctttggggtctcagcaccgccttggggcggggccaccaatctaagttgaggaaagcattggggaggctgcaggaccaaattcattgcggcccctaagttattcactgggaaaggcgctcgaggagagaaactggcagacctatcagcgcgcacccgcggggcttctgcgaccggagtcgggtagtggcttccaggctgagagcgcggctgggccgggtgacgggtgtggccgcgaccgcaagggcagctgttgcggggttctctctttctttcatatcctatttccacccgccttaacgtcctgcgccttctcccaacacctttcaggcgccattctctgctctagcccggggtcccaggagacttttctgcggtcctcgcccctgccgctggcaagtcccagcccccgggacccgaaagtcagcgccccgcctagtatcttggagccagcctccccgctgaattctccgggtgagctttagacgcctccttcctctttcgctcaccataccagacccctctggcccagctaggggctcgacgacccttgcctcgctccttgctctcaggcaccgaggggtcttggctgttttctacctgcggggccagcggccggcatgggcccacacagacacaatgtgacggggcgtacgcggggaccagcgtggtggtgaccgtgggggccgccgggcagctgagaggcgtgcagctgtggcgcgtgccgggccctggccagtatctgtaagtgcacggcggaggtagggtggacagtgacctgctagttggaggtttcaccctcagggtaacgaagtccacgtgcgcaccgacttgcgtcttggactattccgcggggaggtccaccttgagtgcccttcaaggtggcagtagtcgccaccgagttagcccttacccggaacctcttacaccgagcggaaggcccccaaccagggcagcgccaaggggtgcttgagcctccccacatttccacgaaccctcctgaaataagtgtaatatctgatttttcggtgtgcaaacctacccttcccatcccgtcagagtcgattgcagcctccaagtccctcagataaaaaataattctggagcctcctctgtcgccaacttctgcccggagcggccggcctgagcaccgaaggccggggactcaccgtccgttccccgcaggatctcagcctacggagccgcgggcggcaaaggcgccaagaaccacctgtcgcgggcgcatggcgtcttcgtctcagcaatcttctccctcggtctcggggagtcgctgtacatcctggtggggcagcagggagaggacgcctgtcccggagtgagcgcagccagtggggatggggcggcgccggcgccgggggcgagggctgcctgggggccgggggagcgtgctttcctcggtgccgggtcaccagcacagcgaggggaggctcccgggccccgccgattccctcccccgctgcccgcagggtagcccggagagccagctcgtctgcctcggggagtctcgagccgttgaagagcacgcggcgatggatgggagcgaaggggtcccggggtcgcggcgctgggcgggaggtggcgggggtggcgggggcgccacctacgttttccgggtacgtgctcccttcggcgctcagcgttggggtcccaatcctctccccaggggcgctcacgcaccggctctccgtccgtcccttggggtccccctatcccctgcgctgggctgggctggcctgggctgggctgggggcccctgcccttatccaggccccctgggcgggagccctctcccagtggcagtgcccctggacagctggagggcgcttcctggaacacgccgctggccccacaggtgcgcgctggcgagctggaaccgttgctggtggcggccggaggcggcggtcgggcctacctgaggccgcgggaccgaggccggactcaggcctcccccgagaaactggagaaccgctcggaggcgcccgggagcggcgggagaggcggggcggcaggtgagggcgcgggccgcggggagaggcgggcgtgctccccgtgtggctgccaaccttcctgctgtcgctctgcaggtggtgggggcggctggacgtcgcgggctccctctccgcaggccggccgctcactgcaggagggggcggagggcggccagggctgctccgaggcttgggcgacccttggctgggccgcggccggcggcttcgggggcggcggcggggcctgcactgcgggcggaggcggcggcggctacaggggtaggtgcaccgttggagagggcagctgagcaggcccgagggtgaggtgatgttagaacctaagtacaggccggagccctcgggaggataggtgtgggagaggcattaagccctgctcagcagctccaaacaaaaagcaggagctcttagaaaaggaggtcaaatacactgcaaatcagcatgcagacaggactccctagatttccgtttaatccaggatctttcccatcacagcaggtccctgccttgttctgcagcagtcttcagaacttagagctggccgagtgagcaagctgagcaaaggggcagaaaggcaggattgggttaagtcagtggttctcaaagtgtggtccaggaacaggtaatatccccacaacctaagttgttcgaaatgcacattatcagctgggcctggtggctcacgcctgtaattctagcactctgggaggccaaggcaggtggatcacctgaggtcaccagttcgagaccagtctggccaacctgtgaaaccctgtctgtactaaaaatacaaaaattagccgggcgtggtggcgggagcctgtaatcccagctactctggaggctgaggcaggagaattgcttgaacctgggaggcggaggttgcagtgagccgagatcactccattgcacttcagcctgggcgacgagggaaattctgtctcaaagattaaaaaaaaaacaatggaaattatcctgggagttgggggaaggttggggagatgctggtcaaaacaatgcaaaatggcagttaaataggaggaataccttccagaatctactgtactacatggtgactgtagttaatgacgatgtattcttgaaaattgctaagagaggcggggcgcggtggctcacgcctgtaatctcaacactttgggcggcggaggcgggtggatcttgaggtcaggagtttgaggccagcctggccaatatggtgaaacccccatctgtactaaaaatacaaaaattagccgggcgtggtggcatatgcctgtagtcccagctactcgggaagctgagacaggaaaatcgcttgaacccgggaggcggaggttgcagtgagccaagatcgtgccactgcactccagcctgggtgacagagcaagactctgtctcaaaaaaaaagaaaagaaaattggtaagagcgtagattataggtgttcttaccacagaaaataagcatgtgaggtggtgtatatattggtttgcattagccattgcacagtgtgtacatatttcaaaacatcatgctgtatacaataaatatatgaattttttttttagatggagtctggctctgttgcccaggctggagtgcagtagtacaaatctcagctcactgcaacctccgcctcccgggttcaagcaattctcctgcctcagcctcctgagtagctgggattataggcatgcgccaccatgcccggctaatttttgtatttttagtagagatggggtttcaccatgttggtcaggctagtctcggactcctgacctcgtaatccgcccatgtcggcctcccaaagtgctgggattacaggcgtgagccaccacacctggccctgaatttttatttttaattaaaaattaatttttaaaaagaaatgcgaattctcagcccttctctaacatactgaatcagaaactgtaagggagagtcccagtcatctgtgttttgatcaaataactagtgtaaatgcctttgtgcctgtctgggctgtactgctcatacatacacacatgatctacattctcacagaaagggactgtgaggacatgggacaggaggggctcaggcaggcaggaggcatcccagccagcctcagcgaggccttcaggctccagctgattaccccctcctcacctccttcactcccacttgtgaacagacagcatttgcatcatgatgctggagaagagagggccacactgggatttccaccgggagattccagcttctcccccatcccccatttttgtagtcaaactctccatcactctccacttccagggggcgacgcttcagagactgacaacctctgggctgatggggaagatggagtatccttcatacaccccagcagcgagctcttcctgcagcctctggcaggtattggccccaaccccacctctgagcctggcctggacttcttccgcagtccctgagcccactcctgcactgcactgaagagccacctgcactgtgaataaccttgcatagcacaggattcttgcatagcatagggtcatttgaaaaatgggctgtcatcatgccattgcactccagcctgggcgacaagagcaaaactctgtcttaaaaaaaaggaaagtgggctgccagtcgtgctggatggcaatgcagggcatgctgcgtgcttttcaagtacccccttgctatgaattcgcttcaaatacctgggagtgtgcaggcttgacagaagtcccccagcttctctcaccacccttgtaagcttggtgctgctctttgctctaaagtcctgggctagaattaaccatgtggctggaaaaggcatgtatttatttatttatttatttatttatttatttatttatttttatttttgagacagagtctcgctctgtcacccaggctggagtgcagtggtgcgatcttgggtcactgcaacctccgcctcccgggttcaagtgattctgcagcctcagtcgctggagtagctgggattgcaggcgtgcgccaccacacccggctaattttgtatttttagtagaggcggggttggccaggctggtcttgaacttctgacctccggtgatccgctcaccacggcctcccaaagtgcaatgattataggcgtgtgccactgtacccagccaaaggcatgtatttactatatcccagccctaccacaccatatcatatcagttcttttactcacagtcaccgagaaccacggagaggtagagatccgaaggcacctcaactgcagtcactgccctttgagagactgccaatggcaggcagagctccagctggctgaatgcctgtgcccagaaggcatggagctagctgtggataacgtcacctgcatgggtatgtcctacctttgcccaaggtctggactcctggggtcacagactgggaggagcagtaggccactgggaaagatggtatagagatttgctgtgtgccaggccctgtggtgggtgctgggcaggggattggagattcatcggtgcacagtgcctttcagaggcctgtcgtccagtgtgggaggatgtttagatatagctatgtaaatgtatatctcaagtgacgattgttgtgggaggtataaagtgctttaggggtgttcaagagggagaggttgcttttgcccaggataatgggggaaggcatcatggaaaaattaacacttgagctgagtcttgaagcgtgggtaaaacttgagggtaaaggaacagagaagaccttcccactggaggtgtctctctttctccctagacctgcacaagcccccaggccctctggttctgatggtggctgtggtggcaacctcaacactgagcctccttatggtgtgtggggtcctgattctgggtacgaagcgtctagcaggcacagttgattcaaggctgctcctctccagtgagctgggatgggtttctgcggggtcccggggctgacttcaagaccactcaccgcagcagagccgtggtagactcctctgggattctaagataggaaggagctggggaggcctggggaaaacgtttaccttaatgagcatctggaggggtgtcctgggcaggtgggggagggagagttgatgggcaggtggagggtgtgccgttattcttcccacccccagtgaagcagaagaagtggcagggcctgcaggagatgaggctgccgagccctgagcttgagctgagcaagcttcgaacctctgccatcaggacagcccccaatccctattattgccaggtggggcttggcccggcccagtcctggcctctgccaccaggtgtcaccgaggtttccccagccaatgttactctgctcaggtaagtcttctgcctccttctgagaacctatgcactctgaatccccacctctgattctctccctgctgtagtgaattataagtcccagaaaaaatctggcccacatcccttgtgtaagggagagggaggccctgagaagctccagaaggggaagtaacttgctcaatgtcacctctccgtcccagttcttagaatatgatctctcagctgggcgtggtggctcacacctgtaatcccagaactttgggaggtcgaggcaggcaggtcacctgaggtcgggagttcgagaccagcctgaccaacatggagaaaccccatctctactaaaaatacaaaattagctgggcatggtggcgcatgcctgtaatcccagctacgtgggaggctgaggcagaagaatcacttgaacctgggaggcggaggttgtggtgagccgagattgcgccattgcactccagccagggcgacagagtgagactctgtctcaataaaaaaagaatatgatctggcgcctgtaatctcagcactttgggaggccaaggcaggtggatcacctgaggtcaggggttcgagaccagcctggccaacatggtgaaaccctgtgtctactaaaaacacaaaaaatagctgggcgttgtggcgcttgcctgtagtcccagctactcgggagactgaggcaggagaatcacttgaacccgagaggcagaggttgcagtgagccgagatcgcgctattgcactccagcctgcatgacagagtgagacttcgtttaaaaaagaaaaaaaatcatgactcttggagcccagggattgcctcccgcccagggcgtctgcagggaccagggaagtcctcatcatgcactcccaccttgactctggcccgcatctgccctcttttttgccctggctctatgccagtgagcaccacccttgcagggcttctacctggggacatgccatggtatggagagagtctatatagggtcagctgggcatatggcaggggcaggggaggtaaagggggtactagactctctaggactcttctccaggccgcctgcccactcccttccaacgtgtcttcctgcagagccctgggccatggtgcctttggggaggtgtatgagggactggtaattggccttcctggggactccagtcccctgcaggtagctatcaaggtgagaggagtgggacttctggctgggggtaggagagcggaacaccctgaagggaaggacaatgactagagctagggttaaccccctctcctgaagcgtgcagggcagctcagaaactgtgcccttttcctccccagaccctgccagaactctgctcgcctcaggatgagctggatttcctcatggaggccctcatcatcaggtgcacctgggaccaggggcagggctggaaggcgggaggggaatgcccgggaacagtttctcttcaccctgaggctgaggtagcaagtcaggggacacagagggcctctccagctttgtggagcctaaaacatggtttccgtctccctcctggtaacgggatatgtcccccaccccactcagcaagtttcgccatcagaacattgtgcggtgtgtggggctcagcctcagggccacccctcgcctcattctgctggaactgatgtctggaggggacatgaagagtttcctgaggcacagtcggccacacctggtgagacccttgtcttagccccccccaggcccctctaaagaccctgtccatgtgtctgagacctacatggactgatgccccctctgcctgacccagggccagccatcacctctggtcatgcgggacctgctgcaactggcccaggacatagcccagggctgccactacctggaggaaaatcacttcatccacaggttaggagcagtcctggctcaggggacccccatcccaactccctccccaaggaacagcccttccacacagcttttaaggaaatagatcaggaagagcaagaacttctagattctggcagtgattttttttgcctactctgtagggatattgccgcccggaactgcctgctgagctgcgctggacccagccgagtggccaagattggggactttgggatggcacgagatatctaccggtgcgggacttgggaggtgggaaggctcttgctccaagggggttttccccgcaccttggtggtgaacaactcatcattcacctcctccctcctgtagggccagttattaccgcaggggggaccgggccttgctcccagtcaagtggatgcccccagaggccttcctggagggcatcttcacatccaagacagattcctggtgataacacccttcccctccccttccccactgttcccctcccctgaggctaatcctgtcctttccagcaacctcatgtgaggggaggctacacctgacgggcctcacttggttcccccacttgtgatgcaggtcttttggggtgctgctctgggagatcttctcactgggctacatgccctatcctgggcgcaccaaccaggaggtgctggacttcgtcgttggaggaggccggatggaccctcctaggggctgcccagggcctgtgtgagttgagtgctgcccgggaagggaggtccttcacaaccatgggtgggcatgaactcctgcctctccccaggtaccgcatcatgacccagtgttggcagcacgagcctgagctccgccctagctttgccagcatcttggagcgtctgcagtactgcactcaggtgtgcccccgacctaatctaacatcctggtcttgtgggtcaggagggagggccagaaaactctatgcccccctgctccctgactcttccattacaggacccggatgtgctgaattcactcctgccaatggagctggggcccaccccagaggaggaagggacttctgggctggggaacagatctttggagtgcctaagacccccacagccccaggaactgagtccagagaagttgaaaagctggggaggtagccctcttggcccctggctgtcctctggcctcaagcccctcaaatccaggggcctccaacctcagaacctttggaatcccacttatcgctcctgagccccaaggggccctgagggtaaggactgaggcactgagggtccctccctatactcctcaggctcctgggtggcctgttatgccagcggcctctgttccctgcagtctgtgctgtgtgtctgggcctgtctcggggctggcctggcagcgctgcacttgccatgctggaaaccagcccaggcctcccagggaagggcccagccacttccagcttttgatcttggggccagaggccgccttacacacaccccaggtgtccatggggagcactggattgctctcccattatgagcatccttcatctgggcagaccccccaccctgcagatgcttctaataaaaagctcttctcatcctccagcgatctgtggatgccagggaccggaactgaggaagagggggccggaggagggaggggctgaggcctgaggcacaggaagctgcatcttgtctttgagttttattaggaaggggagtccgtcgtggtgtgagacgttagaccggaaggtctgggcttgctaaataaaatccgcggtctggcacctctggagagggcagagcctcctcagaagagctggcctgaggaagaagccctttgccccctccccttctataagttagtgtcatttggctctgggaacgctggggcccgggtgggcaaaacccctggcatcggcggtgcccccccttagtggctggcacctggtcctgcaggacccggtgaactgccctgcaccgcggggctccagtctcaagccggcatgcacagtggggacaaagctgcaggtccacatgtcaggtgagcggcccgcggggacaggagtccagcctcatctctcagccaggctggccaggatgccaatgagattgtccagccccagcaaatagccgtcctcgcggttgccctcctcccagggccgccggtggtccaggatctggccatcggggaggggcgtggtcttgccgaagtcgatgagccacacgccggcgcgatggcagtgatcgtgcacaaagaggagcgagctgccgatcacctgcgagccccgcaccgtcaggccgcggccctgcccagagacgcccttgccgggttcccgccctagccctcgcggcccgggcacccgggcagccgccgcttacctcgtgcctcctgaagaactcggatacctccagggtgtcccggatctgctgcaggcggttcagataccgcctctgcagagggtggggtgggagaggagggcaaattaactaaacgccaaatgagcccctgctaacgatgaggagccgggacccacgctgtgcttggcaaatgccgccaggaggaggacccagggccccgcccagcgtggcccagaagggaaggagcgtagagcagttgcgagccagcgcggtgagggccatggtggggacacagccgagggcactgggccagatgacaggggcagtcctcggcttcaggctccccaacacctcagggtttgggatcccgctctcaccagcacttcctcatctccttgcacaaactcttcaaagacgcgaagcacctgctctcggcttcgcgtagtcttgaagtcggtgctgcaggagccgtccgctttctggatgtgggacaggagtgtcaggggccccgggcccgccagtggggaagaggacagcgtagagcagcggtacctcccagttgcaggggacggcgaggcggtgggagagggcggaggggcaggcggggcgggagcgggggatcgggaaagacagcgcgcagtggggctgcggcggtgccagcgaagcgcgcctgcctcaccttgatgccctcgatgcggaagccgagggtggtgctggagctgatgccttcccgccactgcatgtagcgcggcttggtgacggcgcgctgcgcgtgctcctcctccgtgggagcttcaggatccaccgccagcattttcttgtacatgtccttccgcagcttgggccgctcacgggccttggtcagctcctcctctaggtaagtcctgtgggggcgcaggcagcggccagggcatgagggggcgcacacggagaccccttcgagcactcgccccgggtccccctcaagcagctgtcccggccccggacccctacttgatccccccaaccgacctggcagggcacgcatacctgacgcccattttgcagtcgagcacacaaggtccgtcgaagccatcgagcaggtcctgcagctgcaggtagctttcgccgtcgcgctccaccacgccgtggaaggcaggcacgcagccgcgcagcgcgtcagccatcagccgcgccaggcagtagcgctccggctccgagcagcgcttcaggatcagcccgctggtgcccgccgccttaaaac

SEQ ID NO: 627 - DNA, 105001 bp, Human
  misc_feature (1)...(105001): n = A,T,C or G
caggtcagtggcaggttctcctactcagaacttcccaccatctgtgccttagaataaattcaaggcccttcacaaaacagacacaactcacctttctgctgtcatttccactggggcccccaccacaaccactttgatctctctcacagacacaccccccacagggcagctaccctggactctggactgtcttctgactctgcttgcattttctggcctctgccctgtcactggttttctcccaccagctgtgcctgctcaaattcctacccattctttaagacccagctaagatgttgccttccctcaacatttgtcagagtttccccattcattctgccctgtgtcactgagtgtgcctgtattagggttctctagagggacaggactaataggatacatgtatatatgaaagggagtttattaaggagtattgactcatatgatcacaaggtgaagtcccacaataggctgtctgcaagctgaggaacaaagaagccagtccgagttccaaaacctcagaagtagggaagccaacagtgcagccttcagtctgtggccgaaggccagagatcccctgacaaaccacttttataggtctaagagtccaaaagctgaagaacctggagtccgatgttcgagggtaggaagcatctagcacgggagaaaggtgaaggccaggagactcagccagtcaagtccttccaacttctgcctgcttttattctagccatgctggcagctgatgagatggtgcccacccagactgagggctggtccgcctctcccagtccactgttaatctccttggcaacaccctcacagacacacccaggaacaatactttgcattcgttcatatcaatcgagctgacaatattatccatcacagtgcctcagtctccccagtattcaggggagggcagagatgttgtctttttgtccttctgttccatggcgtgcccagatcctgtgatggcaggtgctcactatatctatggaactgaaaggccagaccctggggagaggacagagcaggtttgggagccaactgtgaaaccttggcagtgggagtcaggaagagcaacctaggtctttgcatcctcatgcaacaaggatggaggccacctcaagtacacattatgtgctcagcaaagacgagatttaaaagtataaaacattcacatttgagcaacttaggtcattaagaatttggcctctttataatgatagcagtgtccacaggaagagagtgagtgggacatgaaatttctggttctgcatgcagacttctacatttctaccagctaattattattatcattaaattattaagcaaagagcttactcgcaaaggtcaactttttataaagcataagtcatccttggaagtgtcgtttggtcattctagtaattcttgcttttaattctttaacaactatgggtagaactgcagtgtaccattattccacctttgtttgcactgtcaaaatacccaagacgttgccaaggacgactgaattcttaggcttggccgcagccacccacagggcaggtgctcacttcctcctccggggtagaagagatcatgggtccctttccagtccaggctggaatggagaagtcgtccctgaccacagtgcgccaggcagaggccaaggttctaaactgatagaacccacccaccagggcggtgccaagtcccagtaagggccgcatctccccagcttggctgatgaagaggcggggaccgaaccctccagtgcaggagcctgtctggtgcctggctctcccaccgatccgcacgtacctcttcctcgcgggtcctaccccacgcaggtatctagcgcccagccctgttcatttcccacacctggcccgctccgccccggggccgaggagacgcacgtctgattggccgagggcggcgggggcggggccggggcgcccccagaggcctagacagaggtgcgggcggggcaggccgcgctcagcaggcggggcgggagccgcgtgcgcccgaggacccggccggaaggcttgcgccagctcaggatgaggacaggctgggcgacccctcgccgcccggcggggctcctcatgctgctcttctggttcttcgatctcgcggagccctctggccgcgcaggtaaccgcgggcacgccagccccgcagtccgctgggtgcctcgacgccacagctctgctgccttccagcctggggcagggctgcgcccctggggcaggtcacggctgctttgctgttggggcgggggggctctggagccggaagagtgagtcgcaggggaggtctggcagaggaagcgccccagtgccctcgggggcccggaggagggcgcggtggatgtgggaggacagggcccttctggtgcagaggggacgcggtgcaccgtagagtaggcgcacggaggcttttttggccgggtgccctgctccatcgtcgcctctcttatataatgttgctggagtatggggttccccatctgccctcttgcgtcccgtccctcccgttctcgcttttccttcggcccttggtcaccttggccacagggccaagaggagcctccacccacagcgccaaggattccccacgattcccggatttcactgcgcctacggtgcgcatcaggaaggaagtcaggttaaataaaccatctcctccgaaagtgaccaagaccaagagtcagctatgatgccctcacccaccgcctagagcaacaaacctttcttctcattggtttatcagctccaaatgaccccgctcccccaaggctgacagcctcacggtgaagggcaggtctcctgcttggggacctgctgcctctcactgcggaagcaggaccagaaacagacagccttcattgatgttcagggtagtgccagccccaccacaccacaccccttggcagcaaccggttgcttttactttctctttttgcctgggcgaggggtgtgcagagaactttgtttcttggttggactgcatcatgggcactcaatgggccaccctccaccggccacttctgttatcgtgcctgtatgaggaaggaaaagattgtccaggcagtttgaaaaacattaaattgttggtggctcttattttctttgcagctaagctaagttaccatctggtttagacttccttcggagagcgatgggaagagatttctcagagtgtgaatggcatcatcctatctacagcaaggacctggaaatgaaccctgctctgagtcacacttctctattctcctttgaccctgtgtgctaggaactaccaaaagaatcctttaaaataagatcctttattgccttgataatttattctgcctgccccacaatccaaggtggaaaagttcactgcagcaactaactacagtgaaaatgcactaacttttcaatcactaacctcttggttcccatcgacatctgcttcagtcctgtttttatctccttcacaaatttcaggatttccctaattcttgcaatctctgcaatcactgccctttatcactgacccaaagcgaaaagcaccaggtttaactctgttccccctgtgctaggtccccacaggttttgttatcctgtatccttccttactcctagcagctactctgatcgattttctctcaccctcagagcagacttgtggccttgtttggggaagcactggaattttgaacccccagccatttgggtcaattgtttggcaagagtgtccgcttcatgatgctggtgacggcatgcacctcgtcacatgtgcacggctaggcttgtgcaggtggcctctattacccaaacactgaaggagcccctctgtgtccttggagagatgccaggtgcttagtttacatttttgcctgcttggagagctaacagcttgaagtaaaccaatccatcagggactcctgaggttttcaccagccaacaccacccaatcgtgcgtgaagactttctgactccctggacattgccatggactcaactgtcacttcaggacctgtttttgaactaacaaacctagacttctgattctctcttgctgcacctacctgtacattctgaacacatggtagagactctacaaaatgcttaatatgtgatctatggacggttcccctgaaattataaatgctgccatcttcatccttcttgttttcccaagctatttccctatccatttgtctgtggttataaatgtcaatatccagcttctctttggaatgtgtgaagctctttggtctagggaccaaaggcaggaattatttagtgatcagacaataagaaaacactgaaagagatgatttgcctttgatggatgtaaaaatactaaaaatttattttcaatttatggtaatgctacttagccattttctctcaaacaccactggagaatttatataacatgaagcatatacaaaatgcatctagggggtaatgaggcttctcttcatcaacttctgccttttagatttgccccaatattgtacttggaggtaaatattaaaactccattgaggactggtataaagttgtaaagtgaacaaaacccagtagaaagctattgataaagaatctattttataaaataagttttatacaataaaatctactctgtaattaccttttcaaagtatatttctaaaatagcttatatgcccttctgtaccaaattttctaaataagggattatgttcacactttctcagtcctccttccagctcttcaacctactatcccaataagggtcataagactgaggcagtttcaacagctcctgctaaggttaaagaaagatacggggaagcatcatgaaaggataggactctccctatctaatgtatgtttatacataccttatatatggaggctaataagtttcctttaagtatatcaataattaagatctgtactaagtgaccactataagtgtcacattgaaattgcatacttggttcaaacaagggattagtctgagaaaaacatctatattcagagatgtagcagtttgttaggaagtttggcagctccactttaacatagctactccacacctctcctgtagtgttttagtgtttcaatctcagactcctaactcctgctttttccactgtataaagaaatgtagctaatccattggattctacaaaaattttgaaaaatccagaactgcaaactgcaaaggaaggcaaagctgctgcttccccagttcacctgtttgggatccagcacacaaagcagaatgcccgggaaagacagcagcaagactacagggcaggagaggggctgtttccaacaagggtgatgggcacgtctcctgcaggagcagacttcttttttcttctgtaatttttgatactttggaatgcaagatttattttggagaggcaagagagaatactttggaaaagatgtagatcagagatctgagtagctattgaattgtgggagaaggccatgagagaaagtgtaagtagtaatcttatagcacattttccttttttgttgactgtcttcccagcctgtgtccatcaagtagaaaatggcagaggaatgtcaaagaagaaagtgtgagggatgtggctgggcacggtatctcatgcctataatcccagcattttgggaggccgaagtgggtggatcacctgaggtcaggagttcgagaccagcttggccaacatggtgaaaccccatctctactaaaaatacaaaaattacccgggtgtggtggcaggcacctgtaatctcagctacttgggaggctgaggcatgagaatcacttgaacctgggaggcggaggttgcagttagctgagattgtgccactgcactccagcctgggcaacagagcaagactccatctcaaaaaaaaaagtgtgaaggatgaaagctgctatggcaaacatccttagctgcaatcctgtggaatacttttaaaattcagatttaaaataactttaagctttaaaggattgttgttgctgttgttgtttctcttgtcgttgcttctgttatttaaaacaaaacaaaaaaatccttccaaagttcaagctgcagtgagacttaattttatagttattatttacatggtaaaattcccctcaagtcaccagtccctggtatgggaatttttaactctgaaagcctttgaattattactaggaaaagcatctggtgttagtgaaaccagtgactgtgaagctggtatcaaaatgaaagtgccttttgggaaccaaaattttacaggtctttctgctgaactctggttcactgacagtgattgcttaagcttgtctaaaatatttcagctttactcttatcaacatgatttgtgctgtaattgtttaaaattttcctttgtaaaataactaaccaaattatctgattatagtttgttgtaacagatgtgaatcttattccacaaactcaggtgtgcaagaaacaatgcattactttattttcagaaatccaaattaaatttgatgctgagctcccattccaccaggttgccagaacttcaataattgtccttactggggtctttgccagctcatgcaaagtgccaggggaacattcagggaggattcttctttagtcattggatcccgctggttacctctgggttttccattgtccaaacccacaggatcttgtatctggtggctcaagactcatcagccatcactttggtagttcctggagtttggggttcagccttcttaggtgatccacactgtcaatccccccaggctttccccaggccctgtcgccttcctgagggtgccacaagccagtgtatggctggatagttgcagacgactgtgatgaaactgaggacaatgaaactgccacagtggagctggccacaggttctaccctcagaacccagacctctgtttcttcttgtttctgtaccccactgttctgctgctccctcagaaatttccccatttcctctgagatacctcaatgaatttaggtctccaaaaaatatctagggggaagtggtctttaagaaaattgtccttaagttttcctttttagtggccccactaacttgccctaaggcagaggagcacagaggcctcactatgtacttggatctgaagaaaggaacatatatatagtgcacatgctgtgttaagcatcgacttttcatgtaataatttaccctgccgtagtagctaacatgtaagcaaggcagaattatggtcccaactagacttttcattgagatgaaaactaaagagcttcttttgtcttattaaatgagaagggaaaaatctttcatgaaatagcaacaacaaatatacatgctactctacacgctttacatggattagctcctttcatgctcacaaccatcatatgaaaactggagcacagaggttaaatgatttgccctgatcctatggctaacaagtagcaggagcaaaatatggacccaggcggactggctccagagcccgtgttctgaccctacacactgcactgcctctctgctcaccactgtcccaccttttgtagtcccctgcagcttaaaaagagtgggaacagactgaggatgggaacagtccagtagtgctcagactctcctcagcaggcagggagcaaggcgcttcaaccacataatctacaatctgtctgtccatttgactcagctaatgaccccttcaccatcgtccatggaaatacgggcaagtgcatcaagccagtgtatggctggatagtagcagacgactgtgatgaaactgaggacaagttatggaagtgggtgtcccagcatcggctctttcatttgcactcccaaaagtgccttggcctcgatattaccaaatcggtaaatgagctgagaatgttcagctgtgactccagtgccatgctgtggtggaaatgtgagcaccactctctgtacggagctgcccggtaccggctggctctgaaggatggacatggcacagcaatctcaaatgcatctgatgtctggaagaaaggaggctcagaggaaagcctttgtgaccagccttatcatggtgagtattagagagggactttgaccgatttgctgttgtgcttgtcacatgtggcattaaacatgcacaatttagtaaaaatagagtcgtacattagtaagggcagtgagtaagctcttcacttccaggcactgtgcagttactttgagcgacattcttacaagtccatggtatttgcctctactttgcaggtaaggctaagagagataaagtgccttgtctgaggtcacacagccatgttgtgataaacctgggatttcatcagatagatatgtacttcttatgatggtcttctaaaccctagaggaaaggaaaccctagaggaaaggaatcattagatttgtacaggctaaaagtcaaatgatctaataatgttgatcttattctaagttttaaaagaagaagaaaggtcaggcgtagtggtgcatggttgcggtcccagcttctcgagagactgaggcagcaggatcacttgagcacacaggagttcaaggctgtagtgtgtaatgatcacgcctgtgaatagccactgcacttcagcctgggcaacatagtgagacacccatccttaaaaaagaaaagaaggagaaggaggaaaaatatattttttcttgcctacggattttgaataaaatgggaaaattttgagtggattttcttatttattttcatttttgcatggcaaccaaattttgatgtttatatttatgattcagcattttaagagtggagtttttcagttgcttccgaaaataagtatattaatattgccttgcggggagcggaccatggacttagccctgagtctagggactggattgcaactaatttctaagttaaagaatgagtagatttatttttttaaccattaaatgtaattagctatctcccaagcaaatatttttcattatgttgctctaaattacaccaaatgtcgatatgcatataattatgtcctctaagtcctattatttccccttgcctttctttacaaatttccctagctttacagtggctttcttcttctcttaaagatcatttaagctaaatttggcctcaaagtcactatagcagcttgctcccatactttccattatccatctgcacaagtttttctttctagctttctatttcctagtgaggatgcaagaattattctgagaatgtcaagttctgttgtggagaaatattagagaattagagatagggtttccttttcatcattccctggcctttgaatagttgacagtctgtttctgcgagccagtttcctcctaaaagtaaagcagttgctttttggatatgacttaatggcaaatttaaattctgtgccacaaaagcccttctccaacttgccaactaagaggaaacacagagccaaacaaaatgccttttaattggatttaacttgtttcattgtatttgtccagggatcagaaaggataattttcttggcagggttcttttagtctcctgatctaattcttttgaggggcatagttgtaatcttaaactccctcagtccccagtgtcttcatttcaatataactggttttcctttttatcctatgtattttatgtatgcatttctaatgttcttctgagacagggactgtggatttcacccagctgccaaagagatcagtagcacaaaaaaggttaaggatctacccaggggaccacccagagagagctaagcaatgccaccagcataacccaaaggcatgaagtgtttcttgaccttttcaaatataatatttgaaacactaaagctttttttaaagcatatatagttgtgactagtcaaggcatacctcaagttttaatttgcacagaaaccagggccaaacttgccacctcttctctgtttctgtctgggtgactggtaccatctaagttctacatgtcagaaatcagcaagtcacctgagaggtttcaggctcgcctcttccaccactccaatataatcaaatatgaagtcctggcaattctacccttttcaatttatgtatatcccttcttgttcttaggttagggactgctgtcttaagttagggactttctctaggactccgctctcagactctcgatactgattgttgtccccaccttcttatctagcagtatataaacaaaacatacaagatacccaagtcccaacaaagtgaaatccaaggttacctggtttgttacagcaaagctagggcttaaaaccagtattccattccccaaacatagcttctttctttcccccttggctttagcagtataaaccaagttttcacttgtgatacaagaacattaatttatcactgtgccttgggttgcctctcaccccaactcctatcctgtgtgagtcgtgttcatctcagagaaaactgaagttgtataaattttatgagtgaactgcttttgactagcacccaggtgtacattaatatcattaagataccttgatctcactagcacttttcaaattttgaatgtttggtgaatcacgcagaggaaatggactttttgtggcagggtggctgcagaactatcagaagtctgggcaactcttagaagcctgccaacaacctctttatccattgaaactattttgtctcatgttactgatgacattaatttgctagttttctgcataatcacctcatctcacaaatttgtaactattgcataataaagctgttgttttaaggatgctatcatcataaatttgcacattcagagaagattcttcccaggaaagtctgtcttgctaaggaagcccatggtgtgtaagaggccagcatcagcaaagaatgtgtgggaacaaaatgcttagtgaatagttagcgtaatttagctgcttctggtgtggtggttgtatgcttatcattcttcaaagcatatattgtgacttagagagcttattaattgaagcccagctttgagctatgaaatttaacttgaaacttgagaaggcacccgctgatgtcacaagttgtccttataggtcaagagtctaatcagagagagcccattctcattcctgtcacttgcagctgagtgcctgaatgtatcacttgactactctgcaaaaatggggatttcccagacaagtataatacctcccctatgatctcacaggtttatgataaagaacaaatgacagaaatgtataccaaggcactttgtattccaaaaatcaaaggttttagaaaagaaaactgatggctctacaaggaacagtctttgtgttcagggactgtcctcttaggtttgtaatatgggaaaagaaactggtcatgagctattggggggttttgatgcggttaaactgaaacataggtaataagcagaatccttataaaatataaggtcaacacactctttaacagaagtacccttttgaaaactgtttctatgacacagcaaaacaaaaccagtgatctttaaaagactatttgccaagaaaagcatccagattattattaccttttgctataggtctgcttattacattctaagctgttaaatggcctcacactttagttagacggacactggaggaaaagaaagtagaatcaaatactgtcttaagcacacttttaagcaaatctgtgagacatttggaggaaccctaattgcctggtaaacggtgataagatctgattactatgatttacctaatggccattatttgatctgttaatgactgaggtttttagcaaattgtggaccgaggttttggcaaattgtgacagggatacagggatagctgttctataaaaacacctttccaagagaattagtattgatataagtatcaaacattctttccagcatttccaggcatatttgaggttggaatcacttttcagttcctccccatgtaccagggaaaatgattgaagtaaaagctatgtctactacctcactggccccccgccggtcacatgactgccccattgaagctgctgcttctttcacaccccaaattaccatgccttgtaccttcccaagaatctgctcagaaattcagcagctcttccttttacttcctcaaaaaccacagtctcaattctacctccagtctctgaacaatgggactatttgtccatctttctaatgccgcaggtggttccaaagtccacacccaccctcagtggttccaaggaatttttctggctccaacactttctaaagaaaagaaaatagaggtaaatgtaacctcagccagggcaccctttctggtgaagtgctctgcggcccacagcagagttagtagaccctcacctgatcaagccaggctctttcagcgcctcatcacaccacagtaagtgaagcttcacatggttgatcactgaacgctatccccagtttgcaaaagcagaaacagaggctactagaggttggatagctagcccacaggcaaacagtgggttagcagggagccagcattcatatccagacctgacagcacccatgctctgaattcctacactcggatattgtattctaaacaacgtttcttttaaaaacagttttagaaattagccacctgacgctgactacccagtttttaactctcttttccccaacttcctctccaacccagagatctataccagagatgggaactcttatgggagaccttgtgaatttccattcttaattgatgggacctggcatcatgattgcattcttgatgaagatcatagtgggccatggtgtgccaccaccttaaattatgaatatgaccgaaagtggggcatctgcttaaagcctggtatgtatgggctggtaaattttatgtggaaaggtagtacatttatatgaggcaatagggagaaggaagagttcaaagtgactcaaaagtgactgcaaaaatattatcccggataagaagtgtatgtttggaggagaagagagaggtaatgtgtagccatgaatttgccttcagaagcaggcccggaagtgaaccaaggcggatggtgtcatggaggaggaggagggagtgttccatagcaccccagggagaggaagtgtggaaaaggcatgcacaattaggaaattgctgctgacctttagtagtttcagaagactagagggggtagaagctggattgtagtggaatgaagcatgaacagaaggaagtaagcctcgtaagtttcacggagcagaagaagagacagttggcaaaggacaaaattgcaacaaatttatgtagttacaatcttatttggctttattgcaattctagaatcaggcaacacctcatttcataaaatagactactgtaagtgttccagttcgttgaacagaggggattggctttgtagacagaaaaagggctgaagaaagcaaaaacagaaaccgaagagtggattggtcatttcaacgtaactttccttgtaagagcaatagagaaataattgattggtcaacatcaggtgacttcaggttaagcattgaaacagagggaacttcattatcagtccaattaaagattgaaactggcctgttggggaaattaggcagttgtctctctctcctgatttctcaaaagaccagatgacaatctgtttcagtttggtgatgtggaactttggcatgggtgactccattttgatttttgagtcctagatcaggagcttagtccaaaacagtggcttttttttatttaaaaaagcaaagggtagtttaagaaagagatcagttgaaaaacacttttagaatggtgaaatcttaagtatgtttatggcctgaagcaaagagcgggaaagagaagagatagatcttcctggctcaaaattggtgacactgttccttccaccattcctgtgtgtttgtcagagtgctttttctcgttactttttaccagaagcaaactgttcaggatttgctaaagaatttgctgttctttagaaagacagagagagaccaaagtagcaatcacatcattatctggcacataactgagacacagtttctcaccaattaggtgagagttacaggggatcacggtacctgacatgtgataggtactcacaaaatattacttaatggacaataggttgaaagaatctatagcaaagagaaaggaaagagctccagacctaagtaataatagttaatacttaacagggctctgccaggtgtcagatactgtttcaggctctcaatatacattaactcattcagtcctcacagcaaccctgaaaggtaccatactttatccccattttacagatgatcacagtgaggcacaagggagatatgtaacttgcctaagatcacacagctaataaatatcagaactagaattcaaacccaggaagtctggctatgaagtccttgtcccaaacagctacactaggctgactcattgagtagctagccaggtggtattagtaatgctgatccctccttcgggaatgtgagcttcagaatgcagaagctcttggagagcttggagagattatactgggttaagacttaagatttcagggtgcaacagaatcacatggagagtttgttagaacacagatatctagggcccagagattctgattcagtagatttttggtgggccccccaaatttggcaagtttccaggtagtgctgataatgctggtctgggaaccacacttggaggattacatatctaattagaggcccaggcttctcaacacctgtaacctacctactaaaatagaaaaagccagtattttcttcagctataattgataataagcagagtttggtcagccaggtatcaacttcatttaactctccttatcatttggatcagaaatttagatgtgaaagtttgcttagaggtaatccaatgtaaacccctgtttctcaggtgagaggcagaaggcccagatcagtgaaatgacctgtcagggtcagaccacatttttgtggacactagtgaaggattctttatcctccttccccactgtacatatttacccccactgtaccttgctgccttgacaggaatgtatcttggtgcctttagcctcctgtgggtgttgtgtgtgtgctggggctttgggggtgtgacacatacagtggtgttaatgcatgcatatgcttcctagagttactttttatggaagaagcaagagaaagtttctcaaacctgagggctgctaaatcatggaggtcatgttgtatagcaaacacactgccatcccactcctggaagcttctggatttacaagtgtagggcctcagtggtaataatgaacctttagacaatgtgctttcaaatccaccctattttgtttttatcaaatgtcagaatctctgttgctatttatgctatagaaaaatggctgaagcagcaggatgtgccatcagaggatcaacaagaccagtgccctcattatagctctgtcacagtcacctctaggtctttgttcctgtctgtgaaataaggacattagacaagatgatctctaaaggcccttccagcttataggatcatgagtataacatctgatatgtaactggctataggaggccttttggaaagtcccccagttggagcctgggatgcacttgacacagcctgcattggacttcccctcttgtggggagtacacaggaggctctgaatatattttgaaccagttgttttgaaatttttatttctcattcaggaaacagcttgcagtttctttgtctgaaattatgcatactctacaaacacatatgtatatatgtttctatgcacatatatacacacaaatacatatataatgcatatgtaatgtgaattacatatcatatattctttattaaagtattaaggagaaatttggacatagtttcccaaataaggtagtcacttgggctcaatatcttggccatttaagcagcatgtctgtgcacacacataaacatacagtggtttttatgcaggctgtgggcaaaccctctgtcatctgccactatgttcaaatgagcttgttttccattagctcagtgttcacaacatgtgcacactgagacccatatctcaggcagagggcagtcagggacatgggcgaaaacacagcattgtaattgatagggataaaaggagaatggaaaataagaaagagtggaagcttcaaccagcctgagtcatttggtgtgtcatgattccaattttattgtgatcaaaatatggtctaaatgagtgatggcagtctccctttgggcatatcctaagagtatgcaaattgacttgcagtatttctaagcattctaagtaatagaaaacattatgtccttactttatgatcactaacgtgtctttatcaacagaaaacggttgtgaagataattgggaaaagaacgagcagtttggaagttgctaccaatttaatactcagacggctctttcttggaaagaagcttatgtttcatgtcagaatcaaggagctgatttactgagcatcaacagtgctgctgaattaacttaccttaaaggtagattttatttgcatgtgatagagcaaattggctaaaattgtaaaggtacttcttcttctgttttcatatccagatgtgtttctttgtatgtaacttttctgacctctcttgggatttaaacttctacactgaaacccataagcaaaaaagtactgaatgtaatcatatttcaccattgagaaatgtatcttgtgatggaaactaaagagagattgatgttcagaaaacaaggttgggtagcaagattaaactgctaccctaatcctaaatgaaaggattttcaaaaagcgaataattaaactctttgaacattgaaaaatagagaattaaaggaagggaaggaagatggttaagttacactagatggcctcagtaaacatccttacattgagtgaaagggtacagtcctcaggggcaaggagtgttttactaaatcttaaagtggatttaataacatggacacagaatgggtaggactttgttttgttttgtttgggggatggtagtggtaattttttaatttttaattatgaaaacttaatagataagaataaataaaaactttaaaagaccatttatcctatcataagaatttaagtatcaccttgttaatttcaataacaaaccctattggaactttgattggaattgtattgaatcatagattcattaaagaggaattggccgggtgcggtggctcacacctgcaatgccagcactttaaaaggtaaaggcaggaggattacttgaagccaggggtttgaaaccagcctgggcaaagtgagaccacgtctctacaaaaaaaaaaatttttttttaattggctgttggcatgtgcctgtagtcccagctgctctggagactgaggtagaaggattgcttgagcctgggagattgaagctgcagagagctatgatggcatcactgcactccagcctgagtgatagaggaagaccttgtcttaaaaaataaataaataaaaggtattgcagtttcaatattgtcttctcaaccatgaaaatgatatgcttttctatttatttaggacttcttttatgtactcagtaaaattctataactctttccatagtcttgtatatctttcaaaagaaactatataaacaaattttaatattatatttaaaaatcaaggaacctaagttactgagtccctgatgagttattctttgaatgaaagacaaataattgtaatatatgataatgatgatgtgccagacagactactaaatgctttttatacattatctcctttcatcccatctaactaccttatgaggtggacgttattgttatcctcattttgcagatgaggaatgcgaggctcagagaggaaacataacttgtccaaagtcacccacaagtatttagcagagcctaaatttgaagagtcagtttgacttgaaaacaaattgtatcacacatataaatggattcaccttttataagactgtaagttctttgcaggcagaaatgggtctcatgggttgtttttcacttttgcacaaagctgtaagctttattgctatatattaagcaaacatgtattgtctaagtaattcagatgcattctgtcacactattttataataactggaaatatttgataaatgcttactgtaagcaagccctactttctccagataaatccattaatcattactacaacctcatcaaacaaatgttttatcactagataaggaaattgatccttagaaataatatacccaacagcatacagctaagaagtatcagattgggatttgaatatcaacatatagaattgcagaactctatttatgtgaaagagggtctcaatatgttgcccaggctagtgtgcagtggatattcacaggtgtgatcagagcacactatagcctcaactcttgggctcaagcgatcttcccacctcagtcttccaagtagctaggactacaggagcacaggatcatgcccagcttttttgttatactacgtacccctcttagatatctttatctctttttatcattaaaaggccacaggtcttttgtcgctctttttgtttacagctttattcagacctcctttcttacttgtagctttacccttttcctgtattgtttggcacttgaatattcagatctttagaatgaaaatctgccaaataagccaaatgagctagtgtttggcattggagttctattccagacctcactgaagcctcagaaaaaatattgttgcgaatgaaaagtgccgataaattcaagtttcctagaatattgacatttggaaaccgatgacttcagtgaaggagaaaagtgccaaagtgtgacaatcaaatgttgcacgattctttatgcatcagttttctttaataactcatgaaagtaatgtaatatggtaaaggaccttattgtaccctactcctggccggacatgccccgtatttaatacatatcattaattttagaagtatatctgtttctaatgtttcaagttcctcttccagtgtgaaagcttcttaggcatatcaatacgcctaattatgactattggtttcccaagacccaagaaaactgtgttttaacctctaaaactctgctttctatctttctttcttttttcttttttttttttttttttgttgttgttgagacagagtcctgctctgccacctaggatggagtgcagtggcacaatatcggctcactgcaacctctgtctcctgggttcaagcaattcttctgcctcagcctcctgagtagctgggattacaggcacacgccaccacacctggctaatttttgtatttttagtagagacagggtttcaccgtgttggccaggctggtctcaaactcttgacttcaggtgatccacccgccttctatctttcttaattgctgatagcatctggtcatcaaataacaaatttgaatgatctatctccactgtaccacgtgtgtgtgtgtgtgtgtgtgtgtgtgtgtgtgtgtgtgactctcactctcattctgtatctctagtctaaacaggaccctttgggccctagagccataagccacatatatatatgttatattatatataatatatatatatattccattgtctatgaaacagctcctatacatatttctgacccagtcccagaaaaacttgatcatatggggatccatgtctgtctccttctactagattgaaattctcatgagggcaaggactttgtcatttcagtttttacatccctagaacctggcaaataatatgtgtgcctaatgaatttaaattgtcagtctagaatacagtcagattttctgaatctagaagtacaatggaaactgcttttgataagtcttcgtatattaataaaagaggattaaaaatagatagtgagacagctactctaagaagcttctgtccttaccttagatgaaagggaatttgacaagctaataggagagcagaactgaattaacttatcagcctttgggtttctcaatagtctgaagacttttgtctattagcattgcctacctttgatgcataaacagccctctacagggattgctgccttacaatcaaggtctgcagatttgtttgttattagtagaataagtctaatttagataataacttaggcaactttgtcactttttaaaaattttttaattcttacagaaaaagaaggcattgctaagattttctggattggtttaaatcagctatactctgctagaggctgggaatggtcagaccacaaaccattaaactttctcaactgggatccaggtaactgctctttccctaccccctctgcacagaacaaatcttcaaaaaagcaaaagcttctcactcaccaatagcttagaaaagtttcacatcttggcagctcttactatggttacctctcagaagaattttttcttcctaaaccattcttaattgtggtactgttattgccaagctgaaccacaccatggacaactgagcatttgaacctctagacctttagaacaaccctacatttttatgtaagagcaaaatgagctccaccacatggcccaggagccattctatgtccctaaaggacttggcatgtctataactcacccatgctgtgtttcatctgcagctgaactctaatatggaattatccgctcgttttcaaactcttggggtctctccccactatagcacccaagtactgacaatataatggttgtattttataatacaaataaatacctcaaagaaagtcttttagggaataaaacaagcaaaatgccacttagccaaaaagcattcttcccaaaggaaggattagacaactttgaaaaataaaatcttaggcttatgacaaatgtagaacctaaagttaacactaatttcagtataaagctgcctgcacacatagtaggaaaactgagttaagagcaataaaattcaaattagccactttagttaatttagtttgctaaatttccttaccagcaaatgaagtaatacttttattatttcagtaaatagaatatttaaagataatttaatctttaactcaaggccttaatggcatgacaatgataaattaatatttttattttatggagtagcagattaagagctactaaccatagaatatggcctggaagtcatttgaggaaaaagtttggtttttgtttttaaaattaactacaacatatcatgatgttttccctttagattctatattttagaagaaagacatatttaagcacataattattcattgaggcttatacgtttcaatttagttaagttttaactataatatgagttcccataaaagcataaaattaggaatacaaattattctttctgacaccatcctggccctaactttctcattctaatgctttgaaaaatgttcccttttaagacaggcccagtgcacctactataggtggctccagctgtgcaagaatggatgctgagtctggtctgtggcagagcttttcctgtgaagctcaactgccctatgtctgcaggaaaccattaaataatacagtggagttaacaggtatctttctcacatactcatacaaatagacaaataggtcttaaaatcatagttttgtgaaaacaagtaaatcttttccaacatccgtttccacctttccttctcctgatactgacagtacagaaaagtacttgatttttaaccctgtggttagatattatcaaccatatatgaataaagctttatttgaggtaatgaagaatattaaatataaatatgtatgcgcccagaagaaggcagagatattcgagataggaaatatacttctgttcgtgtgtggctcttttttctccagagcagtggttctccaggggtggtccccagaccaacagcatcagcatcacctcttcctgttagaaatgcaagctctcaggacccaccccagatttgctacatcagaaactacaggatggggtccagcaatctgtattttaagaaactttccaggtggttctgatgcgtattcaagtctgagaaccactgcagttcatgcctccgtaatgaggcaaaacctatagacacaggagtaagcccaggcttctctaccttgtgccccacagcacccagccctcttctatccttctctgtcaggcaagtctttgcattgaaaaatcaagtaaaaaaggagaggtgcagagggacaaaatgtgtacaataagggggtttttccagggcgtttggggatgaaagtgacacaagaacagctgaagtttttgaggagtggaagggtgtgaggagtttttgaaagaatggagaagaggagtgtattgactgtcaagcacagggcctgatgtatacctggtatttaattacatcctcaccaaatgagagaaactaatactcaaagctggagggatgtattcatccgttttcatgctactgataaagacatacccaagactgggaagaaaaagaggtttaatggaccttacaatctcacgtggctggggaggtctcacaatcatggccgaaggcaaggaggagcaagtcacatcttacatgaatggtggcaggcaaagaaagagagcttgtgcaggaaaactccgccttataaaaccgccagatctcatgagacttattcgctatcatgagaacagcagggagagacctgcccccatgattcaattacctttcaccaggtccctcccataacacatgggaatttaaggtgagatttgggtgaggacacagccaaaccatatcaaggggaaaggatgatttttaaatgtcctgctttaaggaactgtgagtgaagggaataaagcattcaaatgtcttgtcatctaaaaaggagtatagagcaatttttaaggaaaaactagatataaaataaagaatctgaggggatattttaagataataggggaaatgaacatttgtcttccaagttgattcaaaccaaatttagtccatacaacaaaaggcataatagaaaagccagcacaaatgaaaataaactagagcaattgatgatagattaagtaaataccttgcagtagcaattattaaataaatcatgatgtttccacatgattgaataatatgcatttactaaaataactgtgccagcaggaaaatacaaagaacaaaaccaaatgatatgcctacttatcattttaatcttgtaaaaatatgtattcattgagacaaagactagaatatgaaaatgattgcattaagttccattatgggtgatatttttcctctgttcctttatcataattataaaatataacaataatacatgctatttcagaatattaaagttaattgagttatctcgcaagtgtaagaggctagctgaatctgaatcactttatcctttagtaaaaaaaacaaactgtccacatttttttttctttttttttttaattatactttaagttttagggtacatgtgcacattgtgcaggttagttacatatgtatacgtgtgccatgctggtgcgctgcacccactaactcgtcatctagcattaggtatatctcccaatgctatccctcccccctccccctccccccaccccacaacagtccccagagatgctgtgttttcttacaacaaatattccaaatggttctaaatcagtgaagtctgagtaaccaactcactttctggttttgttaacggggatagaagtattctgtggggtttcatacttcattctttttttctaatctggaaagattagaccttcgattgtgagctttctcatggtcaaaacagaatcactaattccatgaggaccatctgtctagcagaggggaggaaagaagtccaggggtaacctttgccctctcatctcttggatgcgaagtgtataaatgtcttattctgtcccttaaatctctgcctgtcctttgttcaacggtgagcgttaatctacatccccttgctaagctggccatacaagaaaaggaggcttgccctcttataatcttctcaaggacagagactggagggaaacctaacaaattccatatccaggaaaaaatttgtcagaaaatgacttaaggcacatctttctactgtctacttggactaagggcaatctcccttgactgtgtccaagcccttaatagtctgtgctcagccatatagcacattgaagcatgttaaagtcacatcattttctgaatcccagcgggaattcctatgatgctatatatacctcatttatgtggtaggcaccacatgaattcatgtcaccgtagcatctgacatcacgtccccagttttccaggactctcattattcaagaaaaaagaatttgcaatgttattgattcacaatagatgtatctttactggaatataaatagctgcttttcccccagatgtctggacatactcagatacccgctgtgatgcaggctggctgccaaataatggattttgctatctgctggtaaatgaaagtaattcctgggataaggcacatgcgaaatgcaaagccttcagtagtgacctaatcagcattcattctctagcagatgtggaggtggttgtcacaaaactccataatgagggtaagtttttaaaaataccctatttgagaggcttaagccattttaaagtatccctggttttagactctttgtgggaatgaaaagcttacagtttgatcccacagatcagccctgtcagataggattgtctctggtgatggaactgttctacaattggtctagtatggtggtcactagcaacatgcagcttctgagcagttggcatgtagccagggcaactgaggaactgaattattacttttatttcatcttaattaatttaagtggccgcatgtgcctagtggcaaccaatttgacagtactgccattgattgatttccctcttctcatgagctaaattctatttaagttgctcaaaaaacttaagtgataattacttcacttttgtaattatttgaaagctaaagactggtaaaggaaaatatactagacggacagtattatgatctcttcctagaatagaactcttagctagaatagctaagagtaggtacctactcagtgccagcctggtgctccttgtttcacttgtgaaggcagcagagtcataccagggcagcagtggacagtatttctattcaaattgggatatgtatgattgtatttatagaatttcattcaccccacaaagcaaagtttatctacaccagatatcaggaacacccagcctgcagatgttctacctgtgtactttacttgcataagttacttgaaaagccttcattacccaacctgcctgtcgtatcaacatattaataaccgaattaagaatactacaaaggctcttaaaactccatatcagaatataaaaatttgtataacaatgtacatattacagtatttaattgagcaaaaccaaacaaataatacatttttcttttagatatcaaagaagaagtgtggataggccttaagaacataaacataccaactttatttcagtggtcagatggtactgaagttactctaacatattgggatgagaatgagccaaatgttccctacaataagacgcccaactgtgtttcctacttaggagaggtacgaaacctcctgtggtttctttatattcttactgttttacctaatgataatattaagacttctttggttgggaagtttgcgtataagctggaaaagaaaaggtaagagcactctggatcagggtacagagccacggaccattacctgttaagaattgggccgcacagcaggaggtgagcggcgggtaagcaagcattactgcctgaactccgcctcctgtcagattggcagcagcattagattctcctaggagggtgaaccctattatgaactgcacatgcaagggatctaggttgcacttccttgtggaacagtttcatcccaaaactatcctcttccccaccctctgtggaaaaaattgtcttccacaaaactggtccctggtgtcaaaggttggcaacaaataatctaaagtctagactgtctttctggtagctactttaaaaaggtaaataaaagcaattactaaataagcaacccatatcctatctgagagcatcttttctggtctcaaacagatacagagaatccctttagaactcacattcttgtgctgactgattctagcaacctgctttctctcaggaccagggcctgcacccacctttctgccatcagtgtgatattcggcagatagccacaatttaacctgaaaaatcccatcttccaaattcatgttcagattgttttatatcgatactactttgagaagtaaaaaaatggttttatttaaaaactaggcctaacatttttcagaaaccaccttactcctatagaatgcttaaacattttttgaacatcttttacttaataatccaaaataggctgtgtcttgagcagaaaagatatatgtacctctacgttttgtttgtatcactttcctgtggacccctaattggttatgaaagtgactgtgtcactcagacatctaaagagacttaagtggaagcaataaatattatgtgtatttaaaagaagtttagaaaggtgtcacatttgatgctctatttaaaaggacatccaacatgtctttagaagaacatcagaaatggaaaagtgttcccatgggcaagagtgaattgatggcatacctagacagcattccaatgttcaaaactgacccttatcacaatcgacttattagaatttaattcaaacaaagcaaagtgacgtagtcagttaagcaaattaatgttaagtagcatatatgaaagagagaattttgaagtccagattgaagtagagttgaaagaaacttttgacctagaattcatggagaatagctattttagccaccatcatcattttacacatgaggaaaccgagaaagggaggttgatgatgtacctaaaagtttcaaactttggctgtgcccttctagtctagaagactagaatgctggaactgtgggctgagttcttctctcttcaacttttatactaagtgtgctttgatggttttattgctactcttataagaaaatgaaatttatccacactgtgacctggaggtgatgctgaggtaactggctgtgagccatcactttgcaggcctgttgagtagcattttctaggagtgtgttctcacatttgataattcacttatattcatttctctctctctgtctctgtcatagtttttgtgagttcagttctgaatatgcggtaaataatttcctttccaagcaaatgtttttgtctcctttcaaagctaggtcagtggaaagtccaatcatgtgaggagaaactaaaatatgtatgcaagagaaagggagaaaaactgaatgacgcaagttctgataagatgtgtcctccagatgaggtaggtaaaatccctatgtaaattttctcaagcagtattacaacttcttggttagaaatggtagctgagacttaaataactcagacttataaaatagaggaaactactagcttctgttcatttaagttagaacaagccagaaggcagtgagtcatagcatattggccttcttacagaagcagaaacttgaaaatttctataaatatttgtagaattactatcctcaaggctgatgtctttacttcccccactaatatcaatattcaaaaataattcatccagtgaatattatactcttatgatgagccagccacccatatgagaagtaacccatactttttgtctgacacaggcccacagtcttgtggaggttatctgtgaaattgcatcccaccctcatcacatgtatgatttcaatagccatgtcctcaatttccacaagttctaagacgttatcaatgtagcagaaacatgcttgccagacgggacaccatcaagtctggaaaagagtttgacaatatttttcctctgacttagggctggaagagacatggagaaacctgttacaagatttatgaggatgaggtcccttttggaacaaactgcaatctgactatcactagcaggtgtgaccatcagtaaacttgtactcataaactttcaactctgaattcttttgccaaacagtcttcctaagtaaaaggtgcatcttcaaatagagtcaatcattgtgaaacacttgccaatttgattctccttttgtagatttgagcaagaatacctaaatgatttgatgaaaaagtatgataaatctctaagaaaatacttctggactggcctgagagatgtagattcttgtggagagtataactgggcaactgttggtggaagaaggcgggctgtaaccttttccaactggaattttcttgagccaggtgagtgtcttaatctttgaagtagtagtatactgtgactagtgaaaggcagcactcctcccaaagatgttcctcacttacttttgaaatgtgagggacatgatgatcttcaggattggagtctatctatggaaccataaatagaagcagtggctatgtcttccctattatgtccttgggaataatccaatgaaagaaattcaaaaacttagttctcccaaaccaccatctaatggctcagagctagaagcaccagtgtgagtttttaaaatcttttccatgtaaatctcaaatagaatctagaagctcccgtgtgaggctctttacattttcatctctctgcttcttaacctattttcaaaactgaatgtgttttcttcccttattctcaatgggtaagaattatggaggctatcttgtattatttattttgtttttgtttttgtttttgttttgagatggggtctcactctgttgcccaggctggaatgcagtggtgtgatctcggctcactgcaacctctgcctcccaggttcaagtgattcttctgcctcagcctcccaagtagctgggattacaggtgcatgccaacatgcccagctactttttgtatttctgtagagatggggttttaacatgttggccaggctggtctcgatctcctgaccccaagtaatccatctgcctcagcctcccaaagtgctgggattacaggtgtgagccactgtgcctggcttcttatttattttgaaagttatttcctctttctccaaccagcctaaagcattgaccataatttgccatagaatcagaacacttaagccggaaaggacctcagaaatacttttagagttaagaaaacagagactttaaaaggtgatttacttgacaaagatcatctggttattgaattaatgaaatccagagttcctgatttttaagccagtggctttgaataagacagcagtataaagcattctacttttcaccctgtgaattatttatattttattgtgttggtctaatgtgatcatgaagactattttttataacacagagattggaaaatatgagcttacaattgaacatgttatttgaaatagaaaatgcccacaaaagttaggacacatggtcatcaccatcaacatgagtgatgttgctagtaacaaagtcatccttttatgtctgaaaaagatagagtatacagatgttgatcctggttaaatctcagattaagaacactctaatggataaagcacatagatttctttttttctttttcttttttcttttttctttttttttttttttttttttttgagatggagtttcgctcctcttgcccaggctggagtgcaatggctcgatctcggctcactgtaacctctgcctcccgtgtacaaacaattctcctgcctcagcctcccaagtagctgggattacaggcacctgccaccatgcccagctaattttttttgtatttttagtagagacggagtttcaccattttggccaggctggtctcgaactcctgacctcaggtgatctacccacctcagcctccgaaagtgctgggattacaggcgtgagccaccgtgcctggccagatttgttttatagacactaagagtaaaggtgacgttcttgataactaagtcttggtggttggagaggtgcttgggaagtagctaccatgactacttcctccattctatggccagaaaggctatgtgaagctctctttaccattattgcacccatcctcagccaacttggtctatcatgggcacaccgtggatagaaggactgaacagggaaaaatagcacacccattcagggtagcaaggcaattatttttcccagtttcttattcctcttgctgtttgtgtatatgagactatgtggcttctctgtttggtgggatagaagttgtcctattacttttcagtatatgtaactcttcttgtcttttacctgcttcaggcagtgtgatgtaatggaaaatggaacatgatgttttgtcagacaaatctggtttcaaccccaactctaccattcactaactctgactgtgggcaagttacttagtcttcatttacaaaatggaactgataattcaaactaccttttaatactgttatgaatacataaaattatgactgtcataaaattaacggtaaacaaatgtatgttaccacatacctccttctacctttattgtaccagcttttcctttggatcagaatctgggagagttgtgttttgaggttaactaagtttcttaaaaactgctcaaagtttttaagctaatttgaaccactatcctaagcagcagtagtatttagggtacagctctagaaacagaccacctgggcacaaatcctggggcaaccacttactaattctatgaccttgaacaagtcacttcattctcactgtacctcaaattatgacaatagaatccccccataggtttgttatgaggattaatctttttcaaaaagtactttacaaataataaacacctgtcattattattctgaacaacatatttctttcctctctttgttccattttttttttattctctctccccaacttggctgaagtaaagagtagaaacactagaaaatgtttgaactttaacgttttaatttttaattgagctttccacttcaatcccagcttccccgggcggctgcgtggctatgtctactggaaagtctgttggaaagtgggaggtgaaggactgcagaagcttcaaagcactttcaatttgcaagaaaatgagtggaccccttgggcctgaagaagcatcccctaagcctgatgacccctgtcctgaaggctggcagagtttccccgcaagtctttcttgttataaggtaaagtgacattctcattctatccttcaatgaagttatttttccactacccttgttcatgtccttgtacaaattatgctcttctccatagtactatgtaacctaactaaagtgctctggagcacagagtccttggcagggcatcgctgaacctctggtgtgaggtgcctcagccccacaccctgcacgtgtcctacctgaaagggcaggcccaaagccagaagtggctccaccccaaggtctttttttcccagtaagttggtgtactatatgccatactgccactatgcctatgatcctcatattcctctaattcttgttgtcaaattaacagctccagcactcctaataatgtaaaaaaagtgtatatatatttacacttttacaaacatatatatatttgtgtgtatatatacaaatatatatatttatatatacaatatatatatttataaacatatttacaatatatatattataaatatatttataaatatatttacaatatatatatttataaatatatttataaaatatatatgtttatatatttacaaaatatatatgtatatatatttacaaaatatatatatatttacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacatgatatttacaatatatttatatatatttacaatatatatatttacaatatatatatttacaatatatttatatatatttactatatatatttacaatatatttatatatatttacaatatatatacgtttatatatatttacaaaatatatatactttatatatatttacaaaatatatatacgtttatatatttacaaaatatatatacgtttatatttttacaaaatatatacgtttatatatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttacaaaatatatacgtttatatgtatttttactatatgtatatatttatgtatatttttacaaaatgtatatatttatgtatatttttacaaaatgtatatatttatgtgtatttttattatatgtatatatatttatatatatatttggtctgcatcagtcagctagttccataaacaaaccactagatgccatcccaaaattcggtggctatgacaacaaacatttagcctcacattctcacagatcttcaggccagctagagtttgactgatctagtttgggcttgaatggtgacctctgctcccaacttcaggtcagctgtgctgggctccagcccttccttctagagctcaggctaaaagggcaacagctcacaggggtttgttgttctcatggtatatcactggagcccaagaaggcaagccaaccatataagcacatttcaggcctctgctcagtttaccttcactaatatcccatcaacacagtaagtcatatggccaagccccatgccaaggtacaaagaagtatactccgcccaccagggggctgtggcaagaccatctaattatattacaaggaactgaagaattgggacaaatataattcatcctgtcattgtgtcatcatctcttcttcctcctctgcctcctcctcctcctctttttcttctttcttctttcttcttctttctttttctcctttcttcttcttttgaaacagcccaagttccaggtttacttttgccactttctgtcaatattcacacaccagtgcagactgctctttggttgttcctcgtcagaaaatagtgctatttttgtgtgggtcactgtgtcttatattcgaaatttctattgttagcacatttctttgccaaaggctactcccaaagcatttatatgtatcctttacagccttgcctcctggttcattttatctttcaaggtcctaggaatacaggagaacgtggatcttgttggaatagttccccagcctggctgaggaaggccatccatctgaccacaaggactggcatctgtgctggcctttagttgaattgacactttcagcaggacctgtctgtgtctcagtatatgtgcatttacctatgccttcactacacctttaagaattcatttcaggggcccacacatgtgacagtaattgactttagcactatgaaatactttatgataataccagaaaacaaattaatattatattttgctaaggtattccatgcagaaagaattgtaagaaagaggaactgggaagaagctgaacgattctgccaagcccttggagcacacctttctagcttcagccatgtggatgaaataaaggaatttcttcactttttaacggaccagttcaggtaatactttaagaatgagaatttctatgctgaatttgatgtcctctagatattcaaaattgacatgttcttaccctcactctctgttggaaaaaaaatggacatgttttattatctaaaaggtcatttggtgcttagcagtcatggaacattaagcactcttaatgtgcagacactatgaggaatctaaaaatgaatgagatgtattccctaccctttgtttaataaagtccaacagcaatgtatggcagaaaatctagaatataggcaaggaagggccttgggaattcagaggagggagggagtgtttctgggagtataatcaggaaaaatgtcataaagaaggctgattcttggaaggtaggtattatttcaaaaggcaagataggagaaggagaaggagccagaaaaaaaacagaacataagcaaaggaactaagaccagaatatacagatatggtcaaggagaaatgagtcatacaaattagctagaaaatggaatttggatatgaaattggaatgtccttgtttgcaagggaaggagtttgatcttaagtaattaaacacaaccaaacaaaaaacaaaaacaaggtgcgtgtgtgtgtatttatatctacacacactcacatatacctgcatatatacatatatacacagagaggaaggggttggccaggctggtctcgaacttctgacctcaggtgatctgcccacctcagcctcccaaagtactgggattacaggcattagccaccacacccagcccattatcagttttgattaagtgtgagtctgcaaatttgttcaataataataaagtccaattctgcacttttgaaagagacttaaaacaaagcttgccaattagtacttatccagctctaagactataatgttcttttcctgggaggaaggggccacaaaatactacaaaattgtgaaattctaataaaaatccttaaaaatttaaaaattttttaaattttttaattttaaaaattaaagcaactagcaacattttcattgtgcaacagataaaagttagtgctgagtagctggtggcctcctgaaatggggcctgactctccaatttgccaggtctctaatttattacttcttgaccccacttcacttgcttatgttatgtgcttgtcttatatttactcaaatagcaattgagttaataatcacaagtcatgtgatcatcttaataggtactgaaaatgcattgggtaaaatccactattcattcctggtttaatacataaatatacacttatatttagtaaatataactaatatgtaaattcttatttgaatagaagaatagctcaaattaatagccatatcacacttaatgatgaagcattgttaagtgcatttccctgaaagtcagaaaaaggtaagtatccctatatcatcactattgttaatcttggtttgaaattcaactcctgcacattaagataaaaacaatactataatgtgtaaatgtttatatatattaagcagaggaaaagacagattatcaaagagtaaaaaatatactatttacatttaaaactagactgcaaaaagggtaatggctattatatctctaggaagtaagattttgagtgatttttaaagtcttttctatgggctgggtgtggtggcttatgcctgtaatcccagcactttgggggcctgaggtgagaggattgcttgaaaccaggagttcgagaccagcctgggtagcatagggagaccctatctctatttaaaaaaaaaaaaaaagaattagctgggcatggtggcacacacctgtagtcctggttactcaggaggctgagtcaggaggatcacttgagcccaggagttcaaggatacagtgagacaagatagtgccactgcactccagcttgggcaacagagtgagatgctgtctgtaaaaaataaatgaatagaatgttttctttgaaaatttctatattttccagatttgctttttgttttgttttttgagacggagtcttgttttgtcactcaggctgaggtacagtggcatgattacagctcactgcagcctcaacctcccagactcaggtaatccccccacttcagcctcccaagtagctgggactacaatcacatgccaccacacccagctaatgtttgtatttttttgtagaaacgggtttttccatgttgcccaggctaatctcagattcctggctcaagcgattcaccttccttggcctcccaaggtgctgggatcacagatgtgagccacagtgcctggcccagatttgctctaatatagcttctgctgtgtttttctcattagagaatgtagtttcactacagtgtactgggaatctaatgtaaaatatgatacctgtgttccataaatatttatttattaagcatctatcgtagaatctcaggtattctagacatcattgtccagtgttagaaattaatatacaaaatttcactgcagactgacccaaggcaatttgtatatactaaatactaactcttgggttctttgtgaggtgagtgttagctattccctcaaccttgagaatagattataacaaatgcaaaattcagaccaaaattttccacacatacagacatttgctatgcaaacattcattgaagcagacacaaaacattttatacaacgtgttttgtaagcttgacaacattccagcaatctgtcctttttggtgttttaactatcaccttgcacagatttacttgaagcagatgtggcagtgttctgtggcagcattctgttcccattgtagtgagtatcaggccatcacaatcacctgacccaatgactggatgtggggttgtttcgaatcaagccctactaagatacaggctgcggcctcgcaagattctaatacactcttgagaagtgtgagagtttctctaaatattttagctaatccctgcatctcaaataacttatatttcaccagtgagagcccaatcctaccatcatgctgatgaacaagcttccgatttcactgacattaacccagttctcacattcattctgctcatgaccaaagcctccagtgtgactttggtgatcatggaagtcctcatggtggccacctctggaccatggcctttctttttcttttttttttttattattatactttaagttctagggtacatgtgcacaacatgctggtttgttacgtatgtatacatgtgccatgttggtttgctgcacccattagctcgtcatttacattaggtatttctcctaatgctatccctcccccatcactctgccccacaacaggtcccggtgtgtgatgttccccgccctgtgtccaagtgttctcattgttcaattcccacctgtgagtgagaacatgcggtgtttggttttctgtccttgcgatagtttgctcagaatgatggtttccagcttcatccgtgtccctacaaaggacatgaactcatccttttttatggctgcatagtattccatggtgtatatgtgtggggcatggcctttcaaatacaccaccaatacttcctgacatgtaagtttcaagcagggcaacttaatggcccttagatttcaagcttgacacacacaatatcatattatccagataaagtatttttaagtaaaatgctgacataagctctagattccaagcaagaggttagtaactctaactggaacgaggagccatggataagtactaatgaatgaggttgtagatatttgtgagaaacaataagtagaaaacattggaatatcatatgtgatagaaatgaccattaagagcatccatatacagaacaaattacactaggaaacaaaacatgaaaggaaatttttatgatttgtttctttgttttgaatcacacttgttgagcactcccttctttaaaaaattaatacaagttcattatataaaatttggaaaatataaaaatgagtaatgaagcaaacaatcacctcaaatcctagctcctgattataaacatagtaaacccttagtgtaaaccctttctgtttacttacatctctacacatttagcttttacaaaacctattttccatagaatgtactatgtttaatttttttctaatcataaaagtaatgcacattgaatttagaaaacagaacagcacagagaaaaaacaaatctccttaatcccttcacttataggaactgtattttatttgtactctgatcctagcagttaacacaatgccatggtaagcagactgctttgtttgcttaataacttctccataataaagaaattgtttgcctgtgctgtgcttagagaacatattctaaaaccaaaattgtaaccatggcttaaaggaaagaaggaagcaaacccatttatattagaaaatgattctaaagcatactccttgaatgccttggctttttattgcaggaattgacctttctcagcaagatatccattgcccaaattgtgtattgcatgccaaggagttaagtcagattactgctgtacctctcacaatctaagttccacatctctatttgtatttcagtgaaaaggattcatggtgcaccaaatcattaaggctctgagatctttgcaactcttaatggcagcccaacagggacagccactgtagggcaaaaatagccataggattagagaagaaagccttgtttgcaatgccattgctgctgtgtacactaccccctgtgatgtggcaagaatggatttagacataaatctaaggctttgtagaataagcaccctcatcaaatagtatttattggggcttatggctgagatactgttttccttagcaaccaaatgcagcaggaaatttgattgagaataggaattttaacacaattacacatattaaccttttacgctatctcttcttaacccaatagttttaaaaccatatacttagtgcttggagtaccaggaacttataaagagagagagggaatctcagtttgacttgattccccagttatgatcaggtgcaattttttccttcacattttctaaaatcaacattggaagtgtgcaatgatcaatgtgatatccaatttcttcttccctttatctgcctacagctaaactaggccaaaccaggaatgagttacaattgaggaaatattttccacttctgatcccgcacaaaaaaaatacatacatgtcgctattattttctgtatttatgacatgctagtgagttctttaaaatgaagctgaaatctgtaaatttctgtgttcaaatgaaacttttttcaatctgtaaatttctgtgttcaaatgaaacatttctgaaatacagtttcagaaagtagtggagattagaaattttggacaatcgagcaaactcttttctctaggaagctgtcctctgaggtgcagcaaaggagccagaaatgggcttgaaagcagagatgtttctaagtggaaggaaggggagctattagctgagagaagactgggtaagggcttgaggagcctagaaagttgaggatgaacctctaaaaaggctaccagtgggagcctctacaatgcaggtgacaaatgatctttgatcgtcttcctggttgtattgtggattgtgtaaagaagataaaatagctaatgcttactttagggaaacacaaaattctacacgaattccccaggcccaaatatataatgtgcaaagatttgggagaaatgcagttatttccccaagtaaatatgaggaagaaaacttaactgcctctctattttagccgtctggctttaattgtgctgtgtatgccaattgtctagaccctgtggtttagaaatccagcactcgggcagtatgatacactcggaagcctgtaagagagctccgatgagctgaaggcataaactgcaaattcctcttgtagctactaaatttaaactggatttaattgtctccactggatatatcttaggtccacaaattggtggatctgtctctatgaaagaaaacaagataacaataaaaaccaaaacaggacagtcctcattcatattccattgcattaagtccaaaagccttgaggttgaaaagatgaaaaagtacttattgttgttaaaatatgagagaatgttgaacaaaggtaagaaataaagaaaagcaattatttattaaaaaataagaaatcagtttaaaattctttgtttcagcctttgattcactagtacattttattaaaatgcacttatatttctctgtagacttgtagctatatgttccatatattctgctgaacttgagagtatgcattgtttttagatttggaatctaccccttctctaaaatgtatctgtattacacttacaggcatattacatttatatatatgtatacacacatatgtactgatcatacataccatgtaccaacaaaaggttaaattatgtggaatattattggtcgcctaaaagtgtaataaattttagaaaacattttcaaatggagttagaggcagagaaaattttctgtgcttatattacatctacttatgctggatatttatccctggccagagcataaatgtatttgaggggaaaggattacttagacatatgttcctgcctccatattgcttgtgtagatagtcttccttggaaggcctacccttcttcctcttggccaatctgaatactggcattcagatcatgactagaaagaaatgttagccatcccttgaagaatatcttttgtcctaccaacctcacaaagtctttcttcattttctgcagtccgcagtgacctctcctttctctgaacttttgtgtcacctaaaatgtatataactcatttgatagctttcataaatggtctttacttttttgttcatatatatcttatctctctatttcatattacatttcagggtagatgtaggtcttatacttctctgtgtcatcattgcacctagctcaatgccttttacataaaagtataatacttataggtgataagtataatcacttaaattattgcttaatttatttttctggtatatttctttggcacataggcaatactcaaatgcttgtttaaacttagtggatagtaggaactcaactatgtttcaaatattgtttaacaaaaatttagccaaatagttctgcattttaaagaagaatatttgatagtgttatagacaaacactttaaagaaatgccattgttgcctttgactgtatctgaaagtattgtttaatattcaagcactacagtaaaagtcttggaataatttccatttttttcctcttaaaattcaaagtagaatggtttttgcctttcatatgaagaaaacagcttaatatgtagttttaaaagtatggtactttttctgtaactaccccacattaagggcttagtttcatttcaaaagacttctttatgttgcttgaaactgtgcttttcaattagtgatgcacattagacatgtgagtgctaaatatttttgccaagcattgtcctgtatttttaacacttgctttttacatagtggccagcattggctgtggattggtttgaataaaaggagcccagatttacaaggatcctggcaatggagtgatcgtacaccagtaagttaaaacgttattgttttaggtagtatggaaacactgtttgtttcaataacaagttgattgttaaataatacattgacacctaaaatttatatggaaccacaaaagaccctgaatagccaaagaaatcttgagcaaaaagaataaagctggaggccatcacactacctgagcttgaagatacacctcaaagctatagtaaccaaaacagcatggtactggcataaaaacagacacttagaccaacggaacagaatagagaggccaaaaatacatccatatatttatagccaactggttttcaacaaagataccaagagcacacaatgagaaaaggacagtctcttctataaatgatagtaggaaaactggatttccacatgcagaaaaatgagattaaacccttatctcataccatatacaaaaatcaactccaaatgaattaaagccctaaatggtaggccccaaactatgaaactactaggagaaaacacagggggaaagctccatgacattggtctggacaatgatttttttggatacgaactcaaaaacacagacaacaaaaaccaaaatagacaaatgggattacatcagactaaaaagcttctgcacaataaaggaaacaatcaacagagtgaagagacaacccacagaataagagaaaatatttgcaaattatcatctgattaaaggttaatatccaaaatacagtcgtacatcacttaacaatgggatacattttgagaaatgcattgttagttaggcagtgtttttgtgcaaacatcatagaacatacttaaacaaacctagatggtacagcctacttcacacataggctacacatctaggctttatattgctcctaggctacaaacctgttgaacatgttactgtactgaatactatagggatttgtaacacaatgataacatagaaaaggtacagtaaagatataatcttgtgggaacacatcttcaagggatggctaacatttctttctagccatgatctgaatgccagtattcacactggccaagaggaggaaggataggccttccaaggaagactatctacacaagcatatggaggcaggaacatacatgtaggccatctgtggttgactgaaaggccattatgcaatgcatgactgtagataaggaactcaaacaactcaatagcaagaaaacaatctgattttaaaatggccaaatgactgaatagacatttctcaaaagaagacatacagatggccaacagtcataggaaaaaatgctcaacatcactaatcatcagggaaatgcacattaaaaccatagtaagttatcacctcccacctctcagaatgattattataaaaaagacaaaagatacatgttggtaaggatgtggagaagagggagcttttgcacactgttggtgggaatgtaaattagtacaaccattattgaaaacactatgaaggtccctcaaaaaattaaaaatagaactaaccacatgaacagcaatcccactactgggcatatattcagaggaagtgaaatgagaatgtttaagatactcggagggtgactgcagcactattcatggtagccaagataggaaatcaacctaagtgtccatcaacagatgaatggatgaagcaagtatggtacatgtacacaatggagtactactcagccataaaagggaaggaaatcctgccgtttgtgacaacatgggtgaccctggaggacattatgttaaatgaaagaagccaggcacagaaagacaaatgccacgtgatatcactgagatgtggaatttaaaaaaaaaaaaaaaggatctcatagagctaaagaatagaatggtggtttccaagagctggggcagatgaggtgggggactggggagatgttggtcaaaggatacaaaatttcatttagataggaagaataagttcaagagatctattgtacaacaagttggttatagttaatattttatattcttgaaaaatgctaaaagtagatgttaagtgttctcaccacagaaataactgtgtgagataatgcatttgttaattagctaaatttagtcagtccacaatgtatatatacttcaaaacatcatgttgtatatgataaatgcatatacttttatctgccaatttaaaaaataaatacattcacgtatcatacaaccattaaaattatgtgtctttattgaaatgaaaatagagtctcatataggcagtaaggaaaagacaagttacaagtcttctttttatttttaaaaacccatatgtatagtctctctatatatagtcaaaaaattgtaaagctataaatatagtagtcatctttgggtagtatgagtgatttttttctttttgaaatggggtcttactctgccacccagggtgaagtgcagtgctgcgatctcaactcactacaaccttcacctcccaggctcaagcgatcttcccacctagcctccccagtagctgagaccacagatgcatgccatcacgcccggctaattttttttttttttttttgagacgtagtctcactctgtcgcccaggctagagtgcagtcgtgcaatctctgctcactgcaagctccgcctcccgggttcacaccattctcctgcctcagcctcctgagtggctgggacttcaggcatgtgccaccacgcccaactaattttttagtagagatggggtttcaccatattggccagggtgatctctaactcctgaccctgtgatccacccgcctcagcctcccaaagtgctgggattacaggtgtgagctaccgtgcccttccacgcccagctaattcttatatttttttgtagagatagggtttcaccatgttgcccaggctggtctcaaactcctgagctcaggcagtctgcccatcttagcctcccaaagtgttggaattacaggtgtgagccacatctggccacaagtgattgttttcaaagctttctctttatactgtttattttcatttttatagtaagaagcttttctttttattatctaaatatggaagagttatacaaaaaataaaatatctttttctggggggactaggtggggatgacagagtctcactgtgtcacccaggctagaatacagtggtgccagtatgactcactgcagcctcaacctcctgggttcaattgatcctcatgtctcagcctctcaagtacaggcacatgccaccacatccagctaatttttgtattttttgtagagatggggtttcaccatgttgcccaggctggtctcgaattcctgggctcaagccatctgccaaccttggcctcccaaagtgctgggattaccagcatgagtcactgtgcctggccaaaagtatccttattggaggaaattatttgtttggagaaacctctagaaaatccttgctattattccacatttatattataaggatatattagtgtaatagttataggagcaaaattattctcagatattcaatatttactccaatttttgtcaccaaaaattggtgactccaatgtcacctccttttttattctttctaaatgtaaaactccttgagtttattttcaaattggagcatatctgagattagttaatcaaataatgagcatttcaacacatgcaaaaaaagaaaaaagtattttgcaaacctgattctctatgactccagcggcgaacttaatacactattaacttccacttctgaaactgtggcttcctttgtttggaaacttatgacattatgacatttgctaagtcctctcatgatttagcatcatgatataaaaaagagatggaaaagttttctttctgtggcatatcaacgcacttgagtgattaaggctgcctaaattacatctaaattgcaaatatttatacatcagtcttaaattctcaagcctctcttgtcttttcaggtgtctactattatcatgccaaatgagtttcagcaggattatgacatcagagactgtgctgctgtcaaggtcagtacaatgctggaaaatctgcatatttaaaacataagtccatcatcatatgcagtcaagtaacagatccatggagtgtctttttatgtgaagcatgatgttagatgcagtgagagataagcacacccatggcctggccctcagcagcctaacttacacttcatttgagaggataaaattcatattcaagaaaacctctctcattaccacgcagtaatatgctccaaatgagggggctgaggaaggctaatgaaattcagaggagaaagtgagtcccatggccatttcccaggaagaggtgggacttgaactgggactttaaggatggatagagtttctacaaatgggatagggtaaggttttttcatgaggggatggtatgagaaagtggtataaaataaggtggaagtggaagagggcagtggagaacagaatacagatcaagaagtttcattggtgctgtccttgataacagtattaggaaatcagattgatgccactttaaggaatttctacacttcttgataggcaacagggcattttttaaagtttctgagtagggagggtcacatgaactaaggagggtatgaggaagattcatcttgagacagatgtcaaaagcaacaggtaagattggaaggcatagaagaccagtgaggcatcttcctttgcagaatgcattcatgtatccatttcataaacagtccaaggagtcagtgaggcactgggtgatagaacaatgacaaggtacaaagcatagccattgtcttcacaaaactaaagtctagtaggaaataaagacaagtaaacaagcaattacgacaccactgagtaaagactatgacatgcgaaatacaagttttatgcaagaacaagaattttacgaaagaataataaggatggtgatggtgatggtccatggtggtggtgatgatgatgatggagcagctaacactgattaactcctttatgagccagccactatactaggcatgtcacatatgtcacatagcacataagcaatcttgtgaggtaggcactgttactgtattcatctcacatggaaatttgagctgtgagtaatttaccccagcttacatggagtaaatttaaactgaaagaactgaaatttacacccatgtgtgtctgggtctggtactcttaaccactatgctatatgactaggcatttatagaaatagaaagggtattgatttatgagaaaattgtatgttttagttcagatattttgaatccaagctagctataagatgtatgctatggtaagttgagatcaagagtcttgagttgaaaggaaaatgtatatttttaaaaaaagggccaagaagtggatttggaggaactgccaatatatagagtgaaaaaagatgaagatggaggagacatcagttaatatctttgatttgtagtccaagaaagagattcaacaaggtggctgaccagaaatgttacaggaaggctgagggatataagaactgacaaaaccacaggaaagcactgttttcaaagtaactcttctagtaataaactgtgtagtacatgtcatttttatagaattcccaatgtaacacaggaaaaggtgaaaacttcagagaagcttatggaatttttagtagtgttgagaacactggtacaataaactgtgttctagggaaatagagttgccaagtatggagagatttgaaaatctaccaaataaataaagagatactaatgcaacctgcatcaggaacaagcccagccagggcagtgttctgtaaggaaaatcttacctcacctgccacagaacccccagaaacttggtcttaagagaaaatagtctaagaagtgatggatgtctctcccaagtaatgccttcccctatcctttttatcctacttgctgactggaatttgtaatgagccatcctggaccatgtggagaagggcaaaatcctagaaatggcatggtaacaccagagaaggagcctgagccgctgaggctggacctttatgtcgctttctgatctaatttgatcacagcttggtgcttggatacctctgaaataaatattctaacaaaaattgtcaggtgtgggggagaaaatttgcattttggacataaacatgactttacaacatatttcctttgttagcccctttgagggctcttgctcagggtattactgtttaaatattccattaattcatgtgttcatttatcgaacaaatatcttaggtgctagagctaaaatagagatcaaagtcatagggcttacagtttagtgttccataagggatgtatcaacttcaaaatattctgcaatacttttcctcttataggtatttcataggccatggcgaagaggctggcatttctatgatgatagagaatttatttatttgaggccttttgcttgtgatacaaaacttgaatgggtgtgccaaattccaaaaggtaagtggtagttattccttttcacaaccttctcatgttaacattgtgaatgcctagctcaaagtagctaggggagcattttgatctataattctgatgtctaaaagcctatgatgatgatgcaattaatatgtggagcaccccctgcctgactccggcttctaatagaaggctagcttattgaaatttagtgatatcttactctttgatcatggaagaatttgcatagaagataaaatgtgaggctcattcagggaaattagattttggatgaaatattattttaagcaaaaggagaaatgcagaatcattttcgtttttattttgatgcaaaatgaaaaaataaagataatcttgggaagaataaggcagaagtcaagaaataaaaatttggcaggtccctgtaaaatttagaagcaattttcaatgaactataaaactgctaatactttatataaattcaaatttgagaagccagttagattgatagtatagcctttgataacagaagggagagtggggagaaatgtagataccattttactttactttttccagcaaaacatgaaatattaagaaaaatgttaagactttaattctcaaattattattattattttttaagacagtcttgctcagtcttccaggctggagtgcagtagcacaatcttggctcactgcagcctctgcctcccaggttcaagtgattctcctgcctcagccactggcgtagctgggactacaggcacccactaccacacctagccaatttttgtattttcagtagagtcagggtttcaccatgttggccaagctggtctcgaactcctgacctcaggtgattggcccgcctcagcctcccaaagtgctagaattacaggcatgagccactgcacccagcctcaaattatttttaagcagagattggctgtatgaaattaattagcagaaaacccatagaaggtttttaaagaaatctctgaactgaatgtaaacagatcattgaaactaaaggtatatcctcctacaagttctcaaagaacccaaagttcacatcatggaactgcctattagaagattgttattcctaaaatagttaaaagagcttcagatgtgacatcaggtagtagcgaatctctttcacaaaggcaaactgtcaaaccagttgtaagggaaagacagttgtgttgatgggtttttctaaaggataaattatgcctaagttattcttgattattttattaaacccaaaaaagggacaaaggaaaaccagtttggatatcctttaaacaagtggaaaagtaacttgtatataattaattcggacaatgtctctgttttgaagtgttaatgtgagcctcccattactctctggcatttgttagcattccacagacagtgtcattgttccaaccaaagtgccctctatgggagctgctgcccccacctcctgtttgagcagtggagcagaccccagagtttaaacaagggcaaccttagaaatggcaaattagccaccacaggaaatagtatgaagggcatgtggaggtgtatatatattttttttaatatatattttttaacaagagagaaaggaattaacccacttaaaaatataaatcaattaatcgaacaaatctaaataattccacctccattatccccatgcagaaataaaataaaaaactaaactcctgttctcagcctgtcccaatcacttgaagaaatcaatgattgcttgctccagggtttaaatgttatgttcacccttttttgaccgtactgtacctaactttctaagttacgatgtgatgcattcagctggttggatattttcttggttattagagcagcctaagtttactcaacttgtattcatctgtattttctggttttcttaaagaagttttcctcttatgtattctaaatcaccatgcctcttctctggctcttgcctttttattacttggttctaattaatcctctcttccctaaaagagatattttgacaacctgtaaatttgaagttacctcaaccacagtggatatttgtactttttaaatattattttttgagaaaactgtgtcaaaaataaggctcataaaagtgtttttaggaaaattacctatgatgccattacccagacatagcaatttttattgtatttcttgataccttgtacacacatacatgtttgcaatcttgtataaaaaacaccttgcatcctacttttctcactaatttaaagatatttaaaggttagccatagctttccctcccccacacacaaataatcagaagtctttgacaagattacagacaagaaactatgtacattttgaactgacttgcaacattattgttggaaattatccaatacgaatagaactggctcagagagagactaaagatgctggctattcaggcagtcctctgagtcaggtcttctgatgcctgcctgaggctcacatgccacaccaaaattaagaccagctattttactctgtaatttctaagattaagcaaatgatgtctttgacttgaagccagtgtgatctgtggccagaatgaaaagggggaggaacgcaaataggctcccatggggaacttccctgtgcctggtcctgtgctggccacttcctccagggcatcacacgtgaccttcactctctgtgagtcaggtagccatctagttttcatagaggagaaaatcaaggctcagagagggttaagccactcatccgaaataccacggcagcaaaatgcataagggcatttgcacactgacccgcccagcttccaacccagaattctgtgtagcatgccattatttactccgtttccatctgggaatcctgagtcacttttaattattttcctctcagttttgtctcatcttctcaaaaggttcaacactggagcattgtacattgtttccaaggatatcttggaagacaatgaactctatcaacctaagtttacagaacagttaacctgtttcattagatgcagaagtggttcctgaataacttcccttttcaatgaccgttattttggttcctacttcttatgcttctgtgtaacacatacaatatcattatttacttgtttttactttctaattcttagctatattttatctgtcttacttcttttgtgacctctgtgacacaaggtaaaagactgctagaaatacttcattaatatttaacgtatctgccttttggatttctcctgaagcaggtttagcatcggccctacaaaatacaactaaagtgatcaaaacgtgaagtgggttggccagaaatggacaagcctcaacaatactgcaagtcctttcgagctacattaaaggccgtacttatagtataccctgatctgtcatggaatactaatgccacttgctttcttcctcatacaggccgtactccaaaaacaccagactggtacaatccaggtgagttaagaaaactgaaatttaaccaaagctgcttttaccttgtcactaatgcatttagttaattatttaagtgccagcttcttctctatacatcttcaagtgagacaaaatttctccaggcaaggaaggtgagcgactggtatgggatgaggtgatgagggtggctttttccttccctgtgagtgtaggggagtggcagagtcactggctcaggaatctcttgttccttgtagtcagtactgccccagccagagagggccggtaatctgaattactatttatagttttgaacattaactcatgcttagaggacacagtttgctttgcatagtcataattctaatctttttcttcttcttctttagagcgtgctggaattcatggacctccacttataattgaaggaagtgaatattggtttgttgctgatcttcacctaaactatgaagaagccgtcctgtactgtgccagcaatcacagctttcttgcaactataacatcttttgtgggactaaaagccatcaaaaacaaaatagcaaatgtaatttaaaagaatatattttaaatatatttcttatttttgtatttattccatttaaaaatattacaaaaattttgccaaaatctacaaaagttaaatttttctttaatgtaaaatctgcctcacagcatccaaatttgtttcatgttagaaaaattaagtagaattgcttatgttttaaaatatacaagattaataataaatgtcactttataaggtaaacatcagtagataatatagatcattctaatttcctgtcacattttttactaaaagtcaactttatagttaacttgagtttctgtttctactaataagtaactttgcaaaataatttttgggaagaaaaataatttctgtatttttaaatttataatcaattgcaataggatactgtatgcccacttaaagtattagtctaattaatatatgcccataattacagctaccatatttcctgtacccacaataggatctgtaaatatactgagaaatttcaactactctttggcaaaaggttctagtttgtataattttgaaatctaagtaaggaatgtctggaaattttagtggttagtgattatagtaagacaatgtattcgaatcaaaaccctcaagaaagctcagcacatataaggatggatgtttggcttgtttttcagatatctggtgatggacagaagtggtggataagaattagcgagtggccaatagatgatcattttacatagtaggtgacatcattgattctacctttgtaaagttatcacttaaaagaagcagttccttttactaaatggatttctatttataagtagtttgaatattaatccataaactgcctaaattagagaaaccaagcccttttgcatgttagcatcaagaaaaaaggggtatagagtaatggtattaacattaaatttagaaataaaataacttacagtaaaaagaaaaaaatggaacacctaattacattacgagttgtcaaatctgtcattttcttttagctcacgatatccatggcaccgctttcctgtgacatttggagaggaatgcttgtacatgtctgccaagacttggcttatcggtaaagttaattctaaatcctttaatgctgattatgtaatatgtgaagttcaggttcagtttctagcttaatcttgttttccttttaattatatgtttggtaatttcatcttattctgatttattattagcaacaatagctcaaattcccaatgcaaataaaggtacttttcactgtgaatattttaacttcctttatcctaaagcagttacttagtaataaacttaccactttcctaactgataagtgtctaagcaaattttcaaagataagcaggcagcagttctaaaatatagtttaagtcccctccccctgattacattgccccttcaactctcttcctacctcctgccttcaccctgggatggtatggtagtcacacaaaatgtgtgctgtttcatagacagtattggtatgctgtaacctactgataaaaataatcatagaagacagaaatggctagagaagaaagggaatatattttaagcatttaggaaagattgatttcaagagcctttctttactactgggttgcttttaaaatgtgctgacttggccgggcacggtggctcatgcctgtaatcccagcactttgggaggctgaggcaggcaaatcacttgaggcaaggagttcgagaccagcctggccaacgtggtgaatccctgtctctactaaaaatacaaaaattagccaggtgtggcagcatgcacctgcaatcccagcttcttgggaggctgaagtatgagaatcacttgaatctgggaggtggaggatgcagtaagccaacattgcaccactgcactccagccccgggcaacagagcgagactctgtctcaaaaaaaaaaaaacaaaaaaaaacacacaaaacaaaataaaaatgtactgactgaaaaattctcaccatagtaatcctggcttttcatttctcagacttaggtaaaccaacagactgtagtaccaagttgcccttcatctgtgaaaaatataatgtttcttcgttagagaaatacagcccagattctgcagctaaagtgcaatgttctgagcaatggattccttttcagaataaggtaaaaagagaattgctacattatgcaacaatgattgcttccatgctggttttatagcctatggcagaatggcaacccattagtgacaacatcactgaaatagactctgcatgtttcaggatcccacctggccctctgtgttgccagaaaccgtggatgatatcaagaattaactctcaagttggtcatgcctacaggtcttttaaagtgcagcatttctattttgttgctactaacacttaaattgcttaagttgatctgttgagggattgggatgcattgaatagtcaggactgtctctatggccttataggaaactgacttaatttctggcttgtgttttctttttcccctcaaggagagcatccaagcagcatctgccaatcaaattagaccagcatttcacaaactactttttggggactacacacatgctacaaaatgttaatcattgatcttgcctccaaatgggggttttatgattaaataggtttgagaaatgctgcattctgtatctgcctctttgagatgcataatccatgttggtatatgtatgtattaggaaatgcatttggcttctgaaaagaggttgctacagtatgagaaaagatttattctgtcacattaaagacatttgaagataagcaggtttgtgtggaaacaccatgaagtcttcaaaatcaggcttcttttggttttgctctgccatccttaatataaggcttccgagcttaaattcagggtgttctctctagggtcttttctagaagttacccgatgagtttgtccacattgggtagcttggctcattggccactccagtctataagaaagctgaaaaaaaaattttttttgtaagatatttcaaggaacacaatttgggacataccactctacactaaagtgatcataatgtgaaaaagggaaaaaagagatgtgtctgacagctgaaagcatctgtagtaaagctaggggtacattttaactttttaaaattaggacaatctttttaattcctcaaggtaatagtactgtgttaatttgcatagctgatataaatttgaattaaaatatcctgccaagaaagagatgaatttttcaacagtgtttcttgacataaggagatgatgattaaggacacagattttgaaattaggtggaacagagtacagatactgaccttactattgtgtggctatttcacttatggatgaagttatttaatgtccctgtgcctcagtttctgtctccattgtgagaattaaatgagataatactacacaaactgcttaacacataggaagcactcaataaatgagagatctttaaatatataaagatataatataaaatatatattaaagatataatatacaatatatatcttatatataagatataatatatatatatatatatatatatatgaaagtttgaagaccgctcttcagttgtttcaattgagaaggtagcttgagcctggaagctcaaggttacagtgagctatgattgcaccactgcactccggcctgtgcaacagagagagactctgtctcttaaaaaattaaataattaatgagagcataaacttgaattcttatggtactacattgcaaattaccatatctcacagaccgaaaattagcagccctctaaaagatgaagcattttacttcctatgtgagcgttcctgtgtctggaatctcatgcttcacatatgtctttgtttgcagtgttttctaaagatcaaacccgtgtctctcacattttctcaagcaagcgatacctgtcactcctatggtggcacccttccttcagtgttgagccagattgaacaaggtactggaattatttgggaaacatgttttattctgatctggggccaggttagttttaggaggctatggggaattaacatacaaaaattcttattaaacttcttttgttatggaacagataaaagactatgttgatagataaacaaaatatattcattgacatttttaatgtatctttaatttgaataaatcaaatgctttttaaaaatctctttctaacagactttattacatccttgcttccggatatggaagctactttatggattggtttgcgctggactgcctatgaaaagataaacaaatggacagataacagagagctgacgtacagtaactttcacccattattggttagtgggaggctgagaataccagaaaatgtaagtttttttaaaaaccaatactcttcatacctctgtgaaatacttgagtctttcatacatttttggactaagcaaaaccccactgtattattccatttgtatgaaatgtccagaataggcacatctaagatagtaagtaggttagtgattgctagaggctacgggggatggaaggattgagaatagtgcctaaagagtatggagtttcttttggggatggcgaaaatgttctaagatttatggggtgatggttgtgtaactctgtgaatatactaaaaactattgaatatgtactttaaatgagcgaattgtctcatatatgaattatagctcagtaaagctgttgcaagaacaacaggtgcctccccagccttctgatggatgtactggtttttcacagtagcatcagattccatagcacttatttcataaccatataaaaccatcatgtagtgagttgtaaatagaagcaaatacagatgttttgctttacattttgggactttgggctctcagcctcagtctcctgaggcaaaaagtacaaaattggtaactggtgatcatttttccccaagagctaaatatagggaagtcagagaagggaagagggcattatactgacagtagttatgctgacaccacagtattaccgcccactgcttctgttctctatactttctggatgcagattaccttttgcacaaagggcaaagattgagaaattaacataaaagtctaattccaaaagtatgtcttagacagtaatcaactgatattcctgacataatgttactttgctcaaagttgatgttggtagcaaaggaagttctcaatcgtgagtaactatgtacaatataaatatcaaattattacttggttattatagaagatgtggaagttagagtaaacgcagcaatgaaaaatgtcaaccctaatcttaagacagtttaaacttttaagcataatctatagtaagaaatacatttaaatcaccatctagtacatagatatagatataatattaattgaaacaaaagtttcaagaaacaatacttacccttataatttatgcactctgatatgttcgttctcttctattttgttccattctcctgtcttatcctatcctttactgtccaatcctactatctcctattctgttctatttcattatcacaaatacttgccaaaatccacttaagtgatttcatgatatacgaaatgagtctcaaccatatttgagccctagactagggaattacaatgagtacttgagcatcttttcttctagggcttttccatacactgttttcttgatataagtgagatcatagtatatatactattactctgcttttctcagtttgtattatatcataagtagtttcttcagccattaaaagatctacttgataagctttttaatggttgctggggaacaggtggtgtttggttacacgagtaaagtctttaatggtgatttgtgagattttggtgcacccatcacctgagcagtatacactgcactcaatttgtagtattttatccctcacccccttcccatcctttcctcctaagtcccccaaagttcattgtgtcattcttatgcctttgcatcctcatagcttagctcccacttattagtgagaacataacgatgtttggttttccattactgagttacttcacttagaataatagtctccaatctcatccaggttgctgtgaatgccattaattcattcctttttatggctgagtagtattcctccatcatatatatatacatacatacatatatatacatatacacacacacacacaccatatataaatacacaccatatatataccgtatatatggtgtgtgtatgtgtgtgtgtatatatatatatatatatatatatacacaccataatttctttatccattcattgactgatgggcatttgggttggttccacatttttataattgcgaattggattgcacaatatttcttgattgatatgccatcatttacctaaccagtgctgggtgttaggttgtttccagttttacacaatcataaatagtgctgcaatgaacacctttgtgtataatcttagcctatatttcacattacctgcagagagattttggaagtcatgtagccagatcaaaggatataggtaatataaagctctgattaccaacttgcttccagaaaggtttatgaatttacattcctattcacagcatattgtgattgtccttctatcctcaccagcatattattaatttccaacatatatcaagcagttaagatgtgccaggcactctgctaatgtatcacatacattatttcatttaatttgcccaatagctatgaaataaagatgttacccctgccccaccttagaaaagtgaagatggagtcagtaacttgccagagatcatgcagcctatgcatgcagagtcacggttgacatctggttctgggtgggcatggtggctcacgcctgtaatcccagagactctggaggctgagagggggaggcctgcttaagccctggggttcaagtctgtagtgagccatgattgcaacactgccctcccatgtgggcaacagagcaagaccctgtctctaaaaaaaattgttttaattaaaaaatgagaaaaaaggctgggcgtggtggctcatgcctgtaatcctagcactttaggaggccaaggtgggcggattgcctgagctcaggagttcgagaccagcctgggcaacacagtgaaaccccatctctactaagaagtacaaaaaattaaccgggcatggcagtgtgggcctgtactcccagctattcaggaggctgaggcaggagaatggcttgaacctgggaggcggaagttgcagtgagctgagatcgtgtcattgcactccagcctgggcgacagagcgagattccatctccaaaaataatataaaataaaagagagagaaaataaaattgcctttaaagagcacttggtttttaaaattcttcttaatttggtagtttgatatcgtattttcattgatctttctctgatttctaatgaaaacaaacttcaataagttaaataatcattcatagttcatcaagtgggagtgttctttttctttgcaaatttatctatcaaacccttcatgtatttcttattgattttatgactttggaaatatcaaatatgctgatcctgtatttcttgtgtttattgcaaatactttcctaagttttctttaagtctgaatgccaaaaatattacagaaataaattttgactattttttaatatgttcaaatctgtatatttcctttttatttttcctctgttgcttttaggttagaaagtccatcatgtaaattgtaaatattagttaaatatatgtccatattttcttctagttttgtttcataggttgcctttttttgttgttttttctgacacagggtcttactctgtcacccaggctggagtgtggtggtgcattcataacttactataacctgacctcaagcaatccgcctgcctgagccttccaagtagctaggactgcaggagcgcaccaccatgcgcagctacattttctaatttttttgtagagacagggtctcattgtgttgcccaggctggtctggaacccctggcttcaagtgatcctcccacatggtccttccaaagtgctgggattacaagcaggagtcaccacacccagcctctgttttttgtgtgttttttttttcccctttctgatagcatgttacatccatggtatatgatacatgttgtcagtgcatgcttaattattttccctaatcctagccacttgttctagcatcatttattacatatactttcatttgttaaaaacaatataggcctgggctagcactttgggaggctgaggcaggaggatcacttgagcccaggaatttgagaccagagaccagcctgggcaacacagcaaaaccctgtctatgtttaaaaaaaaaagagagagaaaacaatatagcaatataggatgcctcttttatcatatattaggactgtgtgtgtatgcatatatatgtgtatgtgtatatatatatactgtattttataatatttatatcagtatggtagctatttaaaaatatttctcatatacataatgtgtgtatgtgtgtatataacatacaaatacagtcagcccttcatatccatgggttctgaatctggattnnnnnnnnnnnnnnnnnnnnnnnnnnnnnnnnnnnnnnnnnnnnnnnnnnnnnnnnnnnnnnnnatcagaggatcccccctataatagctaatacaatgtaaatgctatgtaaatagttgttatactgtattttttagggaataatgacaaaaaagtctacatgttcagtacagacaaaaaaaattttttctcaaatattttccatctgcagttggttgaatccagattcagaacccacggatatgaagggctgactgtattgatatgttatatacacacatacacatattatatatatgagaaatatttttaaatagctaccatactgatctaaatattataattttaccatatttttaaaaactataataggattaattatactttattacatgcccttaaaacatacttttagatattcttgtccatttttccaggaaaactttagaattattagtcatttttcatccaaatagttaaaattttaaaactcttgatgagaatttgactacatgtttgggagaattgacatctttctattaatcttccaattcatgaatttgatatatctatttattcaactcttcctttagatcactctgtgaagttttatagttccatctctttctcattgtcattaacaatggcaactttagctataaaaagaatggaatcatgtcctttggagcaacatggatggagctggaggccataatcctaagcaaattaacacaggaacccaaaaccaaatactgcatgttctaacgtacaagtggaggttaaacactgagcacaggggagagggagggagggggacctgggttgaaaaactacctcctgggtactgtgctcactacctgggtccaacacacccatttaacaatcctacacatgtgcccccatatctaaaataaaagctgaaatttaaaaaaaaaaaaaaagaatgacagctttaaaaaatttttcttactgatttgtggggaagctattgtttgaatttgttatgggttttttttttccccataggcatctgtctcactaaacgctctttctctctgagtttttcattggattttcttgggtttcctaagtagctaataataatatacaagcaacagtgaccctcgttcctatagttacctctctcgttttcatttcatgcctcaccacatatgctagaatttccagaatttccatggcaaataccaggagcagtagtagccaccattgtagacttgatctggacctcaacaggttgttaaacattatgttgactcttggtttaagatatagcattctataactagcttgtttagaacttttaatcaggaataagtactgggttttctaaaacttgttcccagcatctgttaagattgccatatagttttttttttttttttttaccattaggcctatttgtacgtggtatatattagtagatattgtattaaaccattttacattcttgttgtaaaatctgggtgctcagagtggattaatattttactattctgcattatatttgttagaattttacttgggaatgtgttcctctctcttcatagagtcaatttcttatgctatattgtcatatttttttctgatcatgttagcctcataaaatgactgggtagctttccatcttttctgtgttctgaaattctgactcagcttggggaattctctttccctgaaagtttgggggaactacctacaaaatgttagaacccttatccaggagcatttttgctttttaaaaaattttaattattccttatttataattgactcataataattgtaccaatttatcaggtgcagtgtgatgtttcaatgcatgcatgtgttgtataaacaatctgatcagggtaattaccatattcctcactttaaacatttatcttttctttgtaaagataacattcaaaaccttctcttctatgtgtcttgaaatatacactacattgttctttgcagagatcatactctaatgataaaggaatttggtgcagcagtgaagggcccaagctctggagtcagattgcctaggtttgaattccagttcagccatttactatgcctttggaggtttacttaacttttcttaagcctcaatttcttatctgcaagctctaattctgttgcattaccttataaggtcaatataaggattatataagataatttatttaaagctttatcaatagtacctgacagacagtaaaaaaaaaaaatggccattattaattttccatttccttcaaagtgattgttacattttggtatttccatttttccttatgacaattatgctaattggcatttttcaagaaagttgtctatttaatttagattttcaaatgtattgaagtaaagttgcttatggtatttaaaaaatctccattatctttgctaacatttttagtttgcattatttacatttttacaaaaacagatgcatgttattggttttgtccactctcttctccaccctctactcctattgcttgacctgtgttataaatactatttctacctttttctaccccatttttcgtggggttctgtttttgttcattttccaatctcctatattgaattcagttcatatttcctttaaaaaaaagagaatatatttaataatacacatttggctccacataaagttttactcataccaatttttttgacatttctcattttattctttcctataattattttagttcatttttggtttactatttattgagtagcatttttttttgtcagtatctcctggtataaacttacttttcttatttttctaagtgtgatatgtttcaaacatacagaaaatgatagggataatatacttggaataaattttcatatctaatattattgattgtgattagaaaatgaaatctagatacttctgttttaatatatggagatttttatagtgactagtataggatcagagctttaaggtatattctgttatgtggtacacaacttgttacaaaaagtctataaaaatctaataagttgaattaataatcattatgttttgcttatactgtagtcgagtgttaaatattgctggaggtgttttatcttatttctaatagtttatctctttaaaaatatgtttatcaagattgccactattttgttttttataaagttaattgccctttatccatgctttgaaagtttttaaagattttctaggaaatgtcatggtcaggtccttcatggaattcttttatagggggacaaattcaatctagaatctaaacttttcttgctaggagcttcagaccattgttacatgattgcatgtatgtatttgcctttttgtttagttttttgaggaagagtctcgctaccactgtgccctaatactcaacctccaaaaatcaccgtttactgggacgtggaattttacatcctgcagtgaacgccactttgtgtctctctgtcagaaatattcaggtaacaattattatctagataactatggtactttatgctattacatatatatatatagagagagagagagtcactttctatagggagggaggggaacataggttgaaaaattacctattgggtagtatgcttaccacctgggtccaatacaccatgtaacaatcctacacatgtaccccctgtatctaaaataaaagccgaaaaaattttttaatactataaaagaatttatattaatttataatcatatggcttaaaatttcagcatggctaaatccatattgggttagtgagtcagagtttatcaaatggaatgtgatttttttaaaggatcattgccataattaattaaattaattaattgtatctgatggaatttgttaatagtagttatcccattatagtaattgaattttgttcttttttctactctggcatttttcagattttacattttattatgggaaaaggagaaaaaaacttcatatttttaattgagtgcagtattgagtattaagtccactaatagtattcactgttaaatttagcattaacaaataaacaagtgggggtttgaaacattataaacagatcactgtctatgcctttccataatccaaataaaagtagaatgcatacttaaaagtaggcatcatccatattttgaaaaatatatttttaaaaaagtattacattatttttcattgatcacaatgtgtttttaacaaatgatcaagaaaaaattttgtcatataatgagaactgtaagtagatatctcatgtgctttggcagaatttttttttgctaaattaatctttacccattttttccatgtttttaactaactcctttattagcgaagtactataaagcaataattcaaatacctcctcttgtggatggtttcttacatttcttcatgctagctctcccaggtgaaaactttgtaaggggatacttaatacatttatttccttcaaacaaaagaggtatttagcaccgacatgacatgataatgcaggttacatttatttgcagatattctcttcataaatcagaaaaatgaaacagaatgttgttctgattttagaaaacaaatgttgcagctcacacattttacttaaggtatacagcaagacatacctaattctctcacccaaaatctaaaataaataggcaaataatatctaaattagattagtatggggagaaatgtgaaaaaaatgtcccataacttgcagagtgtggggaagggtttgttgttgttgttgttttcttttacatgcagaagttaaaagcagacagacgttgcagaatgcttcagaaactgtaaagtatctaaataatctgtacaaaataatcccaaagactctgacttggcacagtgctaaaagggagtgtctgaaaagtaacatgcagctggtgagcatcacggacccttaccagcaggcattcctcagtgtgcaggcgctccttcacaactcttccttatggatcggactcttcagtcaagatgtaagtgttcagtcccaactgccaggactgggtgatggaaagcgacattttttattgtgcatagcttctctcacagcagactaaaacaaacagaagaactgaaaatcttactccagtaaatttcatggaatatgtcggggtttttaaattttgttttgagacaaaggctcacactgtcacccaggctggagtacagtggtgtgatcacacttcactgcagccttgacctcccgggctcaagcgatcctcccacctcagcctcttgagtatctgggactgcagttacacaccaccatacctggctaatttttgtattttttgtaaagatgaggttttgccatattgcccaagctggtctcaaatgcctagactcaagcactctgcccaccttggcctcccaaaggtgctgggattaccagcatgagccatggcacctagcagcaatatgtggtttttagaggcaattatctttccactattgaaagatctagtacttcattgtttaaatgaggaaaaggttctggtggagatatatatatatttgagcacttctttttatttattctaatcaaagacgagctagaatctggagctgccatatctcttcagccaatgaaaagataagggaagaatttaaaaatcagttgtgtggaagcactatggatagtgttaaagagtcctttccatccctttctcttttttctttttcttttttttttttttgagacaggttcttgttctgtcacccaggctggagtacagtggtgcaatctcggctcactgcaacctccacctccaaggttcaagtgattctcatgcttcagcctcctcagtagctgggattacaggcatgcgccaacacgcccagctaatttttgtatttgtaatagagatggggtttcaccatgttggcaaggctggtcttgaactctttacctcaagtgatccgcccgccccaggctcccaaagtgttgggattagaggtgtgagccaccacaaccagcttccatccctttcaacatcagcagcatggctgggcaccgtggtgcacacctgtagtcccatttactctggaggcaagaggataacttgagcccaggagttcaaatccagcctggactacatagcaaaaccccagtctctagtttaagaagaaaaaattcagcaaagtaaaattaagcaactctgaaaaggaggttgaatagtgttttcctccatctcaagtgctgatcctagatagatgtctcaagcacttctcattcatttcagagcccaacaaagaatgctagtctcctactaattcgcatcactaacctctgcacatgtagcacaaaccggaatcattacacagctgaagttttggctataattaaataagggatttttaaataaagctgtggtattcctattggcattataggccacctcttttctcagccatggtatatcccaaagtataccaggatgggtctagggatgcatggaaaaaatgcgattgaagactcagaattgaactgaagaatggatggaaaaacaagaattgttatcaaaagctcaattaaaagtagcatttaggaatagcttaaagaatagtctctctgagccacagggtattctaaagttaacccagatcggccgggcatggtggctcatgcctgtaatcccagcactttgggaggccaaagtgggtggatcacttgaggtcaggagtttgggaccagcctggccaacatggtgaaaccctgtctctactaaaaatacaaaaattagctgggtatcatggcgggcgtctgtaatcccagctactcagaaggctgaggcaccagaatcacttgaacctgggaggtggaggttgcagtgagccgagattataccactgcattccagcctgggcgacagagtgagactccatctctaaataaaaaaattaattaattaattaaattaaattaacccagagcaagccaggagatggggaagctgcttactcagtcctcacagtctcaattgttttatagcattgcatttacttgctttatcttcagcattggaaattctgtgaaacgctttgttgtgtctgttgtgaggaaacaataggtgattacatttcctagtttcagtcaccctaaatcttttgagacaaaaacagtattgcaatgtagaaaatttgtcagtaattaaaagaacaaaattaaagtcacctgtaatgccagtacctaaaaataaacatgattcaatcaatattttggtatggatctttcaagttatttttctatgtgtacctatttattttttagacagttggaatcagactattttgtaactcccctccccacttaatgatttgggtcttacttcttatcctattttcaacctttacctatggttctcttttccctttcacccttaattttaacatattctgtgtagctgtttaactatatatcctaatagctgccttaattctttgaaaatgacaggatgttaataaatactttacattgaaagcaatgagaagatattgaaagattttaaacagagtagtggcaatataagactttacttaagtagacgacactgtgtggaaggccggggaggacgcaagcagctggagagagggagagcagttatttttctataaattcatgcaggaaatgctgttggcgtttacagtgtctgaggagaggcagctctgggttatgtgaagtgcagagtgtggccatgcagtgggtcactcaagtacccagcttgaagaaataaaaatacatagaattaaaggaagtcaagaaggcttggaaacatgaacacaggcatcccaagttaatggtaggaccgggaggacagcaagaattgggacatcttagtgaatgtcagggaggagcaaggcgaccaagtcctctgtgaatgtcatggggagtttgcagtgatacaaggggaataatcctgaaaggaaataaaaggagataaaaatatccactactcctttctcatagtcctgtggtatctgagaatagaatatcaaatagtcttcccctgtgggtgctgaaaggagattattcccttggaaaagccagatttatgtatttatttaagattcagggggtacacgtgcaggattgttacaatacatacactgtgggatgctgaggcttgggcttcagttgaacctgtcacccaaatagtgaacacagtacccaataggtagtgtttcaacccttgctccactccctccccacttttggagtccccagacaatatcatgcccatctttacatccatgtgtacccaatatttagctcccacttatataagtgagaacatgtggtatttggtcttctgttcctgcattaatttacttaggataatgtcctccagctacatccatgttgctgtaaaggagatgatttcgttcttttttatggctgcacagtatgccatcatgtatatgtgctacatcttcttgatccaatccactgctgatggacatctagattgattccctgtctttgctgttgtgaatagtgctacaataaacatatgagcgcaggtgtattttggtagaacgatttgttttcctctgggtatatacccagtaatgggattgctgggttgaatggtaattctatttttgttttttgggaaatctccaaactactttccgcaggggctgaactaatttataatcccaccaacaatgtgtgagcattccctggaaaagccagagttaaattaagatcaattaagatcaagaatttagtgaaaagatatttatagtcttcatactttgtattcagtaaaaagataaaaggtgtgggatgatttatttagatggaatggaaattccaaaggatcagggacagggttaggtggggagtgcagcaaaggggaagaaatgcagggcagtctgaatgagtgcaggcaaagtcgcatggccgaagggccacactggaggccacagtggcttaggccctaactgggttaggttaggggctaggattacagctggaactctggtcatgaacatttcagaatgaagcagcgagtggtgttgaggcttgactgtgttgctgtttatggtttactaaggagactgtgtcgcttcgttccatatttcaaataaactagtgatgcagattgtcttgggactcaggaaagcttagctcagtgggtctgttaggccagcaccaggcccaccagtgggtatgtaaggtctctggcagcaccatggggaagctcagacaggcctgtaccccacaatccatctcctgtacctagatgggtggtcaggaccttggcagggtgtaaaggcagacgttcacagacctctagcacacaacagaatctagtgaatgaagaagcttctctccccaacaagtgtgaaaacagtgatgtgagagccacagcgcctgaagagttcagaggaagggaaccaccagctctctgtgtgccagctagcccctgggttgcgggctttacacatgttatcccattaattccagccccacgaagttaagtgtcacacttaacttggtaggggatggaaatttggagagatggcacatgaaagctagtaagtgactgaatcaggattcaaaaccatgtaggtttagctccgtagcccatattctttccactatgccaggtggtctctgatctaatcagtacttatagtgatcctcaccccattttagctttctgatttctgataaccagtggatccaattatgtgtgaggcagcgtagcataatggttaggacatagactctggggatcgacagcctggcagaaaggcccagcactgtggtttgtattctgtgggactttgcacaagttacatacctttagtttcctcatctttaaaatggagataataatagtacctctcctatatggttgttacaaggattaagtaagccaatatttgtaaagcatttagaacaatgcttgttatgtagtaaatggtatgtaaatgtgtattaaatattaaaaaaattaaaaatcattagattgaccatgggagtcaaaataatacaaagggttaacatcaatattgccacctgaaatgtacttctgctccttacaggatgaactcaactttggttggtcagatgggaaacgtcttcattttagtcgctgggctgaaactaatgggcaactcgaagactgtgtagtattagacactgatggattctggaaaacagttgattgcaatgacaatcaaccaggtgctatttgctactattcaggaagtatgtgaatttcagatcttttaattcttaaattattaacagtcccataagtggtagaatttctgaggagtggttttataaaatctggttttggaattgtgaagaaattatagtcatgtctttttatggcaacatttgttgtgaaaatttgtattcaagtagaattatatattacatatattattattaatgggtcattttaggcatgttttatttttatgtcagctgacaatggggattaacacttaaaatcccattgttactctacctctttctgcatatatttatagttgtagaaagcttacatttgtgagaattcttttgtgattcataatatcacaactaacaggacttttatgagtcttaagattcacagcaaccacctcaagctagcttaagacaaggggaaatttaggatccccaaaacggggatagagctgaacctataactggagatgagttgacaatttctaaatttcactttgtaaatccctagagaacatctcatgaacttagcctgagtcaggtgtgcagtctctagcccagtcagaggaaagtgtttttacaactggcaaggtcacatttgtgggtctgtggtagaaagaagacactgcttcatggacaaagggacttattgtgatccaggagagatactgagtgatctctgccacatattaaatcagtttaatgtatttgagtggaatatgtttatatttgtatctttgtgaatgtatggccttttcataaaatggaaaaagatcataatcagatactgtagatgtcagattttaaatattatttttgtttgacttggttaaagcaataacttatttagaacatcaatgtttcatttaaatgttcctttaaaattaatagtatcagtagacagaaactttaaaataaattctcagagttatagttaggtgacttttaataatgaatatgtttgtacagcatctctaggggtggtcccttgtacttgacatttggtaatgcaggaagacagaaactgcatttaacctaatagcacctcattttttacattcttccatgccacagcaggggtaagaaaattgtgtcaagtaatttccttcctatagaaagctggctttttgtgtgctatatctgagtataaacagagacaggcttcaccaggatattacttctcggcttcctgaatatttcctacaaatcaagcctaatgactgcaaacaggatttaacatttatatctcaaattagaattcttaccattaactctttttctagatgagactgaaaaagaggtcaaaccagttgacagtgttaaatgtccatctcctgttctaaatactccgtggataccatttcagaactgttgctacaatttcataataacaaagaataggcatatggcaacaacacaggatgaagttcatactaaatgccagaaactgagtaagtattatattagtccattctcatgttgctataaggacatacccgaggctaggtaatttataaagaaaaagaggtttaatggcctcacagttccacatggctggggaggcctcacaatcatggcagaaggcaaaggagaagcaaagacatgtttacatggcagcaggcaagagagcatgtgcagggaaactgccctttgtaaaaccatcagatctcataagacttactatcacgagaacagcacgggaaaaacccaccctcaagattcaattacctcccaccaggtccctcccatgacatgtggggattatgggagctacaattcaacatgggatttggatggggaaacagccaaaccatatcaagtatattatactgtcattacttattgtattttgctaattaaaaaaatatttcctgtgttataaatatttctaattagcactagtaactagatgacaaaaatattcatctcctaatatctacattatcagtgacaaagtattaaaatttgtgttagttaaaatggaaagtataggcataactcctttctttactcttccattcaagaactagtctatgtttgtaaggaaggcaggttctcctttaaaaggaaaagaaatgggctaggcacactggctcatgcctgtaatcctagttctttggaaggctgaagtgggaggattgtttgatgccaaccattcaagaccagcctgggcaacatagtgagactttctgtctgcaaaaaattaaaagcatggtggcacatgcctgtaattctagctacttgggaggctaaggagggaggatctttgaacccaagaggttgaaggtgcagtgagctgtgattgaaccacctgcactccagcctggataacaggtgaccctatctccaaaaaaaaaaaaaaaaaggaagggggaaagaaatgacacacaagagagcagagaactggacattaaatcaagctaggctatggggaagtgaaaataagttagttggagcagtcaaaagcttagatacaccacaaggcagcagctaagcttaaagaagtgcacatttcacattttcagctctcaagagtcttcagataattcctatgagatccactaaggatttgtgacttccaaatgatggaactgttggaaccaatggaacaatgaacttagtgaaagttgctatagaaaatatcaaaccagtatttcccaaagcatgctccgtataacatcagtcttgagagatggtctgcaaaaagtccttagaataaggttgaaaaaaataaccaacaaaaaagaaaaaggttgagaaacactagacaccatagcttcctgttggacattaacaaatgtacattaacatatgccttaagaaatactggcataaactagtttaattttgtttaaaccaatgtttgcaaactttttttaaaatccatgtagatcttttctgaaacttccttgttaattttgtgaggaacaccctttgggaaatattaagcctttttaaccctcatactgaaaactaaggaaaaggaagatctgtcgtatagcccagcagtccccaacctttttggcactgacagggaggggtggatggtttcaggatgaaactgttccacctcagatcatcagaccttagttagattctcataaggagtatgtaagctatatccctcgcatgcatagttcacaagagggtttgcactcctctgtcaatctaatgccacagtgctctaacaggaggcagagctcaagcggtgatgctcgcttgcctgctgctcacctcctgctgtatggcccggttcctaacaggcccggttcctaacaggcctggttcctaacagtaccagtgtgtggcccgggggttgggaacccctgttatagttcatctaagaggttctaattattatagcgtaatctttgacagtatatcattactatgggtggatttataccaactgaaaaattacctttaaataggggaaagtgaagtgaatcaatgttttaaattctctactcagctactagttttctattataccataagaccaaatttaacatcaaaacatttgaaaactccttaacctattaattttagtacaatgggataattttattttacatatgtttctaattgtccaatattgtttatattttgaagtatattaaactgagaactaaaatgttttaaacttatcaaatagaagtgtactagataagtaattgttaaaattattgattattttttattcaacagatccaaaatcacatattctgagtattcgagatgaaaaggagaataactttgttcttgagcaactgctgtacttcaattatatggcttcatgggtcatgttaggaataacttatagaagtaagttgtaaatctgccaactttctctatttgtttttgtacttcattataacataattatcaagccatagttcttcaaagtacatgtctatcaatacgtgaaagtataattatgtacttagcataacttacataaataccaagacagtttttatgtctctgctctgcctttatcatcgagtttaaagttaaatggcggaaaataattttctgaattagtttgttcccgcactgctaaaaagaactacccgaacctgggtaatttatgaagaaaagagctttaattgagtcacggttccacaggctttacagaaagcatggctgggcagcctcaggaaacttacaatcatgtcagaggcgaatgggaaacaagcaggttttactatggtggagcaggagagagagtgaaggaggaggtgctacacacttttgaacaaccagaactcattagaactcactcactatcacgagaacagcaagggggaaaatcacctcccaccaggcccctcctccaagactgaagatcataattcaacatgagatttggatgaggacacagagccaaaccatatcaattttcttttttcactcttttatgtagcaactcaagactaactaaaaatgatcaccatcccatataaatcttcaatacttactttttgtttccactaactatgtgagatgagcaagaacagaatcactctattagtgttgcagttttgggtttataaccctggcttagtttatactggcccacatatgataagcattagaaaaatgagacacatggccaggtgtagcgtcccacgcctgtaatcccagtactttgggaggccaaggcgggtggatcaccagaggtcaggagtttgagaccagcctggccaacatggtgaaaccctgtctctactaaaaatacaaaaattagccaggcatggtgacgtgtgcctagctacttgggaagctgaggcaggagaatcacttgaacccgggaggcagaggttgcggtgagccaagatggtgccactgcactccagccagggcaacagagactcaagactccatctcaaaaaaaaaaaaaaaagaatagaaaaatgagacacatggtctgacaatgggctcgaatatttggaatttggactaaataccaccaatccaaaatatgattgataacaaaattttttaaaacagtctaatatagaggaaacaaggtcttgtttctaaatgcttctgagcatttagaaagatgctcagaaatgtcctgaaaatcatagacattttggaattaggaaaacctttccacggccatagagcatcaaaagcatacatttactctaaagagggtttgataaggggcacaggacaatgataaccaggggtagggaaggaaaagaagctaaattactcaaatctgcctgttttaaaaataggcttctcctttgctctctaacccatctgtttcttggggttaccaatgttttcctgaaatgtttatggttggcagaggggttaatggaaattaaactatcaagcaatagataaagacttggtttaccaagtgaggataagttcatcatagtaggacttagttggcccaaaccttttctctgatgacacttaactacccttgaattaaaatggagaaaaactagctggaaaattctgaggcttcacctgaaagtgactgaagaaacaatggtcttgtattgagccatagagaccacacccaggacagagagattgaaattgtaccctttggtatactttgtagttatattatcagaagcaactgaaaatctattataaattctgaaaaagcatttttagatcagaagactcccttattgttttaccttctttcataaaatgtttgagtaataaaatttctattaaaatatacaggcatatgagggacatatagaaagacatttcaggcaaatggcacatttgatttgaatctcattcttactgacttaatttacatctgtaagttactgttttgggttactttgatatacttataaaatatttaattttttggcccctatacaaggaattctgtttttaaaacagctttgacttttcaatagcagggccatgaatagaaatcactgtaagtcactgtttttggttacgttgatatagaatatttaattgtatttggcacctacccaaagaagtttgtttttttaaacatttttgatttttcaatagcagggccatgaatagaaattactatgagaagccacagtatgtcaactgagagatacattaagccaagtgaaaaaagtgactttttcttaaaacaactttagaaatctaccattgcacatcatattggtcagaaaattgataactttgaagtttaggagaagggaagaggaactggaaggcatgagatgatataaagcagcaaacacgaaccaaatcgtgtgtgcagtgcttctaatgtgtcattgctgcaggcagatgtttaggggtcttgccttgggagatggtaatcaatgaagaccagaaataaccaggacaacattgggtgtgtgtaggtagtgatggcatcaatctttataccaatttataattgtaatatgcctagcacctttttttaaagctttattgcaatcatcactaccccaaaaagaaacacaatacccactagcattccctccctgtctcctagtcctcagcaaccactgatctactttctgtctctacagattgcctgaatgtaaaattctggacattttacataaatgaaatcataccatgtgtgctttttgcgtgtgactggctttttccattaagcataaagattttaaggtttatccacattgtagcatgtatcagtacgttattcctttttatgactgaataaaattccattctatggatataatacattttatttatccatgtatcacttgatggacatttaggtaaaacaacctaaattttaaaccatttttaattattatgtataatgcttctctgaacattcacgtacaagtttttgcatggacatatgtttccatttctcttgggtaaacccctgggaatagaattgctgcatcttttgtttaaccctttgaagaactaccaggttgttttccaaaccagctataccattttccattcccggtatatgagagtactgatttctccgtatcgatgccaacatttgtgtgtttttcattatagccatctaagtgagtgtggaatgatatctcactgggatttttatttcatttccctaatggctaatgatattaagcatcttttcatgtgcttattgaatatttgtatatcacctttggggaaatccctattcagattttttgctcatgttttaaattgagtctttttattgtcgaggggtaagaattctttatatattctggatataaatactttccagtatttatatataaatatataaataatttccaaattattttaaaatttatataaaatataaaattttatatttctggatataaataatttccaaatattttctcccatgactttacttatgccacaaaagtgtttttctttttttttcttctttttttattgtactttaagttctggggtacatgtgtagaacgtgcagttttgttacataggtatacacatgccatggtggtttgatgcacccatcaacccgtcacctacgttaggtatttctcctaatgttatccctcccctagccccctaccccccgacaggcccagtgtgtgatgttccactccctgtgtccatgtgttctcattgttcaactcccacttatgagtgagaacatgcggtgtttggttttctgttcctgtgttaatttgctgagattgatggtttctagcttcatccatgtccctgcaaaggacaggaactcatccttttttatggctgcatagtattctatggtatctatgtgccacattttctttatccagtttatcattgatggacatttgggttggttccaagtctttgctattggaatagtgccacaataaacatacgtgtgcatacatctttatagtggaatgatttgtaatcctttgagtatatacccagtaatgggattgctgggtcaaatgatatttctagttctagatccttaaggaattgccatactgtcttccacaatggttgaactaatttacagtcccaccaacagtgtaaaagtgttcctatttctccacatcctctccagcacctgttgttcctgactttttaatgattgtcattctaactggcatgagatggtatctcattgtggttttgatttgcatttctctaatgacgagtgatgatgagcattttttcatgtgtctgttggctgtataaatgtcttctcttgagaagtgtctgttcatatcctttgcccaattttgatggggttgtttgtttttttcttgtaaatttgttgaagtttcttgtagattctggatattagccctttgtcaaatggatagactgcaaaaattttctctcattttgtatgttgcctgttgactctgatgatagtttcttttgctatgcagaagctctttagtttaattagatcccatttgtcaattttggcttttgttgccgttgcttttggtgttttagacatgaagtctttgcccatgcctatgtcctggatggtattgcccaggtttccttctaggatttttatggtcataggtcttacatttaagtctttgatccatcttgagtttatttttgtataaggtgtgaggaaggggggtccagtttcagttttctgcatatggctagccagttttcccaacaccatttattaaatagggaatattttacccagtgcttgtttgtgtcagatttgtcaaagatcagatggttgtagatgtgtggtgttatttctgaggcctctgttctgttccattggtctatatctctgttttggtaccagtaccatgatgttttggttactgtagcctcatagtatagtttgaagtcaggtagcatgatgcctccatctttgttcttcttgtccaggattgtcttggctatccgggctcttttttggttccatatgaagtataaagtagttttttccagttctgtgaagaaagtcagtggtagcttcatggggatagcattgaatctataaattactttgggcagtatggccattttcacgatattgattctacctatccatgagcatggaatgtttttccatttgtttgtgtcctcttttatttccttgagcagtggtttgtagttctccttgaagaggtccttcacatcccaggtaagttgtattcctaggtattttattctctttgtaacagttgtgaatgggagctcattcatgatttggctctctatttgtctgttattggtgtacaggaatgcttgtgatttttgcacattgattttgtatcttgagactttgctgaggttccttatcagcttaaggagaatttgggctgaggtgatggggctttctaaatatacaatcatgtcatctgcaaacagagacaatttgacttcccctcttcccatttgaatgcccttcatttctttctcttgccagattgccctggccagaacttccaatactatgttgaacaggagaggtgagagagggcatccttatcttgtgccagttttcaaagggaatgcttccagtttttgcccattcagtatgatactggctgtgggtttatcatgaatagctcttattattttgagatacgttccatcaatacctagtttgagagtttttagcatgaaggggtgttgaattttgtcgaaggccttttctgcaactattgagataatcatgtaatttttgtcattggttctgtttatgtgatggattatgtttattgatttgcatatgttgaaccagtctttcatcccagatatgaagccgacttgatcctggtggataaactttttgatgtgctgctggattcggtttgccagtattttcttgaggatttttgcatcgatgttcatcagagatattggcctgaaattttctttttttgttgtgtttctgccaggttttggtatcaggatgatgctggcctcataaaatgagtgaaggaggagtccctctttttctattgtttggaatagtttcagaaggaatgttaccagctcctctttgtacctctggtagaattcagctgtgaatctgtctggtcctggacttttttcggttggtaggctattaattactgcctaaatttcagaacttgttattggcttattcagggattcagcttcttcctggtttagacttgggagggtgtatgtgtccaggaatttatccatttcttctagattttctagtttatctgcatagaggtgtttatagtattctctgatggtagtttgtatttctgtgggatcagtggtggtatcccctatatcattttttattgtgtctatttgattcttatctcttttcttctttattagtctggctagtggtctatctattttattcatcttttcaaaaaccagctcctggattcactgattttttgaaggttgtttttttgtctctatcgccttcagttctgctctgacgttagttatttcttgtcttctgctagcttttgaatttgtttgctgttgcttctctacttcttttaactttgatgttagggtgttaattttagatctttcctgctttctcttgtgggcatttagtgctataaatttccccctacacactgctttaaatgtgtcccaaagattctgatatgttgtgtctttgttctcattggtttcaaagaacatctttatttctgccttcatttcgttatttacccagtagtcattcaggagcaggttgttcagtttccatgtagttgtgcggttttgagtgagtttcttaatcctgagttctaatttgattgcactgtggtatgagagacttatgatttccattcttttgcttttgcttaggagtgttttactttcaattatgtggtcaattttagaataagtgcgatgaggtgctgagaagaatgtatattctattgatttgggctggagagttctgtagatggctattaggtccacttggtccagagctgagttcaagtcctgaatatccttgttaattttctgtctcgttgatctaatattgacagtggggtgttaaagtctcccactattattgtgcaggagcctaagtctctttgtaggtctctatgaacttgctttgtgaatctgggtgctcctgtattgggtgcatatatgttttggatagttaactcttcttgctgcattgatccctctaccattatgtaatggccttctttgtctcttttgatctttgttagtttaaagtctgttttatcagagattaggattgcaacttctgctttttttttgttttgttttccatttgcttggtaaatattcctccatccctttattttgagcctatttgtgtctttgcacatgaggtgggtctcctgaacccatctcatctgaacagcacattgatgggtcttgactctttatccaatttgccagtcgtgtgttttaattgggggcatttagcccctttacatttaaggttaatattgttatgtgtgaatttgatcctgtcattatgatgctagctgattgttttgcatgttagttgatgcagtttcttcatagtgtgaatgttctttacagtttggtatgttttgcagtggctggtaccggtttttcctttccatgtttagtgcttccttcaggagctcttgtaaggcaggcttggtggtgacaaaatctctcagcacttgcctgtctgtcaaggattttatttctcctttgcttatgaagcttagtttggctggatatgaaattctgggttgaaaattcttttctttaggaatgttgaatattggctcccactctcttctggcttgtaaagtttctgcagggagatctactattagtctgatgggcttccctttgtgggtaacctgacctttctctctggctgttcttaacattttttccttcatttcaaccttggtaaatttgatgattatgtgttttggggttgctcctctcgaggagtatctttgggttgttctctgtgtcttctgaatttcagtgttggcctgtcttgctaggttggtgaagttctcccagataatatcctgaagtgtgttttccaacttggtttcattctcctcatcactttcaggtacaccagtcaaacgtagatttggtcttttcacatagtcccatatttcttggaggctttgttcattcctttttattcttttttctttaatcgtgtcttctctctttatttcattaagttgatcttcaatccctgatatcctttcttccgcttgatcaattcagctattgatacttgtgtatgcttcacgaagttctcatgctgtgtttttcagctccatcaggtcactaatgttcttctctacactgggtattctagttagcagttcctctaaccttttttcaaggttcttagcttccttgcattgggttagaacatgctcctttagctcggagcagtttgtaattacccaccttctgaagcccacttctgtcaattcatcaaactctttctccatccagttttgttcgctagctggtgaagagttgtgatcctttggaggagaagaagtgttctggtttttggaattttcagcctttttgcactggtttctccccatctttgtggatttatctacctttggtctttgatgttggtgaccttcagatggggtctttgagtggacatgctattcttttctgttttttagttttccttctaacaggcccctctgctgctggtctgctggagtttgctggatgtctacccgactctgtttgcctagttatcacccacggaggctgcagaacagcaaagattgctgcctgttctttcctctggaagcttcttcccagaggggcacctgcctgatgccagccagagctctcctgtatgaaatgtctgtcggcacctactgggagatgtctcccagtcagaatacctgggggtcagagacccacttgaggaggcagtctgacccttagcagagctcgaacactgtgctgggaggtccgctgctctcttcagagccatcaggcagggatgtttaactctgctataagtccctgactgtggctgctgcccttttttcagagatgccctgcccagagaggagaaatagggccatctggccacagcaaccttgctgagctgcagtgggctccacccagttcaaacttcccagcagctttgtttacactgggagcgtaaaactgcctactcgagcctcagcaatggcggatgccactcccccgaccaagctctagcgtcccaggtcaatctcagactgctgctatgctggcagcgagaatttcaagccggtagatcttagtttcctgggctccataggggtgggacccacctagccagaccacttggctccctggcttcagcacccctttccaggggagtgaacagttctgtctcaccggcattccaggcaccacttgggtatggggaaaaaagaactcctgcagctagtttggtgtctgcccaaatggctgcccagttttgtccttgaaacccagggccctggtggggtaggcaccagagggaatctcctcgtttgcaggttgcaaagaccctgggacaagtgcactatctgtgccagagttcctcaggctcagtccctcatggcttcccttggataggggagaaaattccccgaccccttgcatttcacaggtgaggcaatgccccaccctgcttcagctcgccctctgtgggctgcacccactgtccaaccagtcccattgagatgaacccggtacctcagttagaaatgcagaaatcacctgccttctgcatcaatcttgcttggagctgcacactggagttgttcctatttggccatcttgccagcaatccatcacaaaagtgtttttcttttgtcatttgtgcatatgtaagaaggctttgcttaccccaaggttatgaagacttactcctatgttttctttcttttctttttttttttttttttgagacagacttttgctcttgtcaccgaagctgaagtggtgcagtgacatgatcttggctcactgctacctctgcctcctaggttcaagcagtctccagcctcagccttctgagtacctggtattacagacaaccgccaccacgcccagctaatttttgtatttttagtagagatggggttttaccatgttggtcaggctggtctcgaactcctgacctcaggtgatctgcccacctcagcctcccaaagtgctgtgattacaggggtgagccaccatgcctggccttccatgttttcttctaaagattttatagctgtagcgcttatatttatgtctgtgatctactttaatttttgtgtgtggtgaaagaaaggggtccaacttcattttttttttttttttacatgtggatatccagtttagaagactattctttccacactgaattgtcttggcatccttcttaaaaatcaattgactggccaggcacggtggctcatgcctataatcgcagcaatttgggaggccaaggcggatggattatgagatcaggagttcaagacctgcctggccaagagggtgaaaccccatctctactaaaatatacaaaagttagccagccgtggtggtgggcacctgtaatccctgctactcgggaggctgaggcagagaattgcttgaacccaggaggtggaggttgcagtgagctgagatcgtgccactgcactccagcctgggtgacagagtgagactgtgtctcaaagaaaaaaaatattaattgaccataagtatgcacaactgtgaacagtttatgtccagagaagagatttctgtggtgacttttataacttatcaatcatgttttaaataaataaaatagttatgttcatttccatgcaattaaacgtatatgtaagagaaaataatatttttttatttcaataggtttttggggaacaggtggtggttggttacatagataagttctttagtgttgacttctgagattttggtgcacccatcacacgagcagtgtacactgtacctagtgtgtaatcttttatccctcatcccctcccactcttccccccgagttcccagagtctattgtatcattttatgcctttgcatcctcatagcttagctcccacttggtgagaacacacaatgtttggttttccattcctgagttacttcacttagaataatgatctccatttccattcaggttgctgcgaatgccattatttcattcctttttatggctgagtagtattccatggtacatatataccacattaccacattttctttgttcacttgttgattgatgggcatttgggctggttccatatttttgctattgtgaattgtgctgctataaacatgcatgtgcaagtatctttttcatataatgacttcaagaaaagaatatttgatgacaaaaatgaaatgttattactgaaggatggtggaattataggtcaatatttatagtttgtatttatattcaaattaaaaatgagcatgatttactgttataatcagaaaatatcttaaagggttatacataatcatacaaccttttagaaggttgggaaaagagaaaattagtcaagtttgaaatcttaactgtataagtgtaattcaagtcttgatttaatctctaagcataggaaaaaatgtttcttctctagataattctcttatgtggtttgataagaccccactgtcatatacacattggagagcaggaagaccaactataaaaaatgagaagtttttggctggtttaagtactgacggcttctgggatattcaaacctttaaagttattgaagaagcagtttattttcaccagcacagcattcttgcttgtaaaattgaaatgggtaagtatagtaaaatatagagttttctttcactccagggaaagaatataaggctattagttccaccagtgggaatcatacaatcaaatgcttcctctgtattcagtcctgtgcgaggtgttacagaggttatcgaggaaggaaaagatacgggccctgctgtcaaggttttgaccctaaggagtaaaatgtagttgtggagacagcattaaattccttatcattgtttaatgtaaattggtcttagattaattgatacaggcttaaattgtggggaagtcaaaaccgatacattggaaaggggaataacaaaaaaaaaaggaaaggcttcaagaagaggtgaaacttggttggggtttgaaaaatggatagggtttatataaataagaaagtgtttggggaacgagttttaacattccgtgcaaagtgaatgtctctccaccttgcttaatctttaaataaatctatttttaaatatatgttagttttaattttttcacagcttaaaaactgttaattattaccactgtgccctaaaactgtcattactcccactgtgcccaaagctccctgctcactgggagcccgtaaaggtggagtgctggctagttggctcacttacagcgccgcagtcacttcccaagaccgtgtccaccagcaacctccagggattccttattctaacctactttgagtgcatgtaaacttttgagacattttagaaacttagtctctatccccagtttctaggccttctcccagttccctgtttttccccattcttgctcagcaaagcatctttttctcaatcaagctggtctcttcattgtcccaggcacagtgtatgcccatcctcatacttgcacctttatgttttccttctgccaagaagttttccaatttctttctttctttattttttttacatctttaataaacttttcattttaggatagctttagagttacagaaaagttgcaaagatagtacagagcattcccatctaccctacaatcaatttcccctactgttggcatattactttagtatggtacatttgtcacaactaataaaccaatatttatccattattatctttaactaaagtccacacattattcaaatttctgtagtttttatttaacatactttttctttctaggatcccacctaacctttagttctcctgcctccttaagctcctcttggctggctgttttctcagacttttcttatttttgctggccttgacagttttgaggaacactggtcatgtatttggtagaacgtccctcagtttgggttggcgtatgtttttctcatgattaaactggggttataagtttttgagggaagaccaaagatgtgagggagcattctcacttcacatggacagcatgtactattcatatgacttatcactggccacctggcccaaggtagtgtttgttaggttctctgctgcaaagttacctcttttcctcctttccatactgtcttctttccaaggaagtcactatgttgagtccacacttaatagggtagaaagttatcctccaccttcctatgaggggagtatcgatataaattacttgaaattcttctgcacaggatatttgtctattttctccaatttttattttattttattattttatttatttatttatttttttggagatggagtcttgctctgtcacccaggctggagtgcagtggcgccatctcagctcactgcaacctctgcctcctgggttccagcgattctcctgcctcagcctcccaagtacctgggattacaggcacgccccaccatgcccagctaattttttgtatttttggtagagacggggtttcaccatgttggccaggatggtcttgaactcctgacctcaggtgatccccccgccttggcctcccaaaatgctgggattacaggcgtgagccactgcacctggccccaatttttaaatttattcagtcatttatttataccctcatcattgtagtttttttgttatttgtttgtttgtagcacttccatactttctccttaccttctttttattcttgatttcccccaatcctctagacctagtataggttcattgttatttattttatactttggattataatctaacatactgcattctgtaatattttgcttaagtctttccagctttggcccttgggagctctttcacttggctcccatgtcccttgaaataacctcgtcattgtggctttgctgtttgtgcttgttttaagcacttccttactttctggttcccttatttctttttagtcttaatttcacctaacccttgagacctggtttatcaagtagtcttcctgactcttctcattcaaatgaatctctaccaatttcacataccctactggttaacagttttgccatcatttcagccattgttgtttctgtctccaactaatatatgagcttcttaaatcaaagaaaatgtttatgccttttaaaatatcaatcagagaactttaagagcctaagatatgtgtcataccagtaagaaaaataaaatatacatttgacctcccttattaataagaaacccagttttatttaacttttgaaatgattgcatgttgtctcatccaaaagatgtatttgaaataatttaaattttaatcaccagtgcttttaattattatagttgactacaaagaagaatataatactacactgccacagtttatgccatatgaagatggtatttacagtgttattcaaaaaaaggtaacatggtatgaagcattaaacatgtgttctcaaagtggaggtcacttggcaagcgttcacaaccaaaatggccagctctttctggaagatattgtaaaacgtgatggatttccactatgggttgggctctcaagtcatgatgtaagtcttgcttcgttttccagaaacttttcaaatgtgttattttgagggttagaaatttgagcgtaaagtattaacacaaagtacaacattagatgaagtactgggactccgcttgcatagcatggtgctttcttaccttttacaacacagaacaaatagaaaattttactgtagcatgcactaggacaaatgatcaggccatcccaagggcccagtggatgactatctcaacaacacctctatagcctatttgggacagacaaattggaaagctgataaaaatgaaatagcatagaatcagaaaaccctgagtttgagtaccagtagcagatcttccatttatgtgctgggtgatcattaacctttgcaaccttatttcctcatgtagaaaatcagggtaataataatttcactgagattttaacacaaaagtttatacaaagtaccatctaaaattctccacatggttaggactaataaatgtataccttcttcccacttttcctctagaaaattatactacttaggattaattctgctagtaaagacatctgtgccactatttgaatcatattatttaatcatttatgtacttacagtagggtcttgtgtacaaaaaatggttatctattgagactagagttgtagttttaatttaaataatctttagaacagagtggggaagatttttttttaaaagcatggcaagttaagattataaattcaaggaaaattcaaaaatagtcttcccattttgagtttcttgggaagtgtttctcttttctagctccctactgcttggtgtcctctgtagtgtgaaaaatgtagccagagacacaaaacacaaaactataaaacacagaaaacaatattcagaacaatatgaaggttgggattgtaaatttgtaattatgacaaatggaagccatttgcatgttgtttaatttcgagtgtcacataaactcatccttcaaaaaaatctgaagaccaggtgtagtaactctgtctgtaagtttaaagttctccataaactgtatcagagcaaatgtcccaaatcaatgcatcagaagtaaatcagacctacaataatagtaggttcagacctacaatactgtaagcaaataattaatattccattataatatttcttaaagtatgtatgttgttctttgtattctttttgaagtcaaacatctggattcaggttatctctattgttcttacaacagggaagtgaatcaagttttgaatggtctgatggtagtacatttgactatatcccatggaaaggccaaacatctcctggaaattgtgttctcttggatccaaaaggaacttggaaacatgaaaaatgcaactctgttaaggatggtgctatttgttataaacctacaaaatgtaagacttcaatttcagtaacagtacatttatgaaaatgtgacataatttatgcacataattaaaagctcagtggaatttttatttaaagatttattcacaagggccgggcgcagtggctcgcgcctgtaatcccagcactttgggaggccgaggcgtgcggatcacgaggtcaggagatggagatcatcctggctaacaaggtgaaaccccttctctactaaaaatgcaaaaaaaatagctgggcatggtggcgggcgcctgtagtcccagctagtcaggaggctgaggcgggagaatggcgtgaacccgggaggcggagcttgcagtgagccgagattgcgccactgcagtccagcctgggagacagagcaagactccgtctcaaaaaaaaaaaaaaaaaaaaagatgtattcacaaataatttttgtgaaaataattttgatactttgtaaatggaaacaaatacagtataagcactcagggaatttattcccaatgactttcatttgttctgtcaccaggtaaattctaccctagaatttgtgaattctaatttcacttagcaatgtttttcaaaggctgagatgcttatttcaaaaaagggtcccacaacatataaatttggggaacacctcatgtgatttaccgtattaaagtttctaagagagtttcttttcttttcttttcttttcctttcttttcttttcttttttcttttcttatcttttctttttctttttttttttttgacagggtttcagctctgttgcccagactggagtgcagtggcatgaacatggctcactgcagccttgacctcctaggctcaagcagtcctcccaactcagcctcctgagtagctgggaccacatacacatgccaccacacccagctaatatttaaaatattttgtagagttagggtctcacaatgctgttcaagctggtcttgaactaggatcctaggctcaaacaatcctcctgtttcagcctcccaaagtgctgagagtataggtgtgagctactacgcctggccaaaggttctaagagagtttctgtaataatgaagtctgtttaactttgtgtaaccaagcattttccaaatttatatgatccttaaagtttaagggaagagcctcttccattagaggctggacttagggtcacccctggtggataaagcatgaaccttgaggaagaccacaaaaaaacaaactaccggggactgcagaggcctgcaggacaggctggggggtggtggcattggtttccgaagactctggttctcaatgctcaccatgttttctgctctgaagaatcttgaacggcagattcaacatttggttgaacagattcaggccgaagaaaatgtgaaaactttagagaagcaggttaataaaagaaagggagaatgatataaaggatgaggaatcaaggtacaatcaagaactgacttctcagttgttaggcacagaaaacaaatgtaactctttagaaaaacaattggaatacatgagaaataaggcatgcagaaatagagaaacaggctttataggatagagaatgataagatggccagacataagttctgtgctctaccaggttgaagagtgcctcctccccaaagattcccgtccagtcagaaccttagaatgtgactttactgagaaatagtctttacagatctaggtagttgaggtgaggacatattggataatggtgggccctaaatccaatgactagtgtccttataagagggagatacagacacacagagggaaaaagtccacgtgatgacaaaggctgagattgcagtgacagagtgataaaccaaggactgtcggcaaccaccagaagatgagagggaggcacgagacagattctccaatacagcctccaatgaaaaccaatcctaacaccctcttcaattcagacttctagcctccagaactgtgagagcatacatttctgttgttttaagccaccaattttgtggaatttattatggcagcccaaggaaacgaatacaagggctaactttaaaaactggatcttcaaaaaaaaaaaaaacaaaacagagaataacaggcattagtgaagatgtggagaaaatggaacccttatgcactgctggtaggaatataaaacagtgtaaccactgtgcaaaatggtgtggcaattcttcaaaaacatgtacataagattactatgtgatccagcacttcaggtatatactcaaaacaactgaaagcagggattcaaacaggtgtttgtacaaccatgtcatagcagcataattcataatagccaaaagatgaaagcaacccaagtgtccatggatggacgaatggataagaagccttaaaaaggaaggaaatgctgatgcatgctgcaacacagatgaaccctgaagacagtatgctaagtgaaataagccagtcacaaaaagacaaatactctatgattccatttatatgaggtagtacccagagttgtcaaattcatagagacaggaagtggaatggcagttaccagggactagatggaggggaatatggggagttattgtttagtgggtatagagtttcagttttgcaagataaaaaattttagagatgggtggtggtgatagttgtacaacagagtgaattcatttagcaccacgggactgtacacttaaaaatggttaaggccagatgtggtggttcatgcttgtaatctcagcactttggggggctgagacaggtgggtggcttgagcccaggagttcaagaccagcctgggcaacacagtaagactccgtctctacaaaaacgtgtaaaaattagctggacacagtagtacatgcctgtaatcccagctacttgggaaactgaggcaggaggatctattgcacccaagagtttgagactgcagtgagctatgattgcactactgcattccaacctgggtgacagaataagaccctgtctctaaaaacaaaacaaaaccaaaatggttaagatggtaaattttatgttatgtgtattttaccacaattaaaaaaaatggatcttcttgaacaggaatgtaacacacttaccacgatgcaagcccttacagaaaaaaaaaaaaaaaagagttggaagcaaaacttcatgaagaacaagaagaaaaaaaaatgtacgcagcctaagagaccccagttgcagactatactagaaacaaatagaccaaagataaggcagttccttatgttgccagtgcaagaagtaatgttaaaaaaaaaaaggtcaaaccattcagaaaagttccctatcctaatgatgccataataatcaatgttcaacaagttttgcattaacaattgagcccagtgcaacaatgagtaatcagcaatatacctttgcccaaccaactattttcataaggtggtaaaaacaagaacttactagtaacatttcttttcaacagcagcattgatgaggagttgtgagaagttttatagattgtatagatgaatttggcaaatgcattttgatctgcagcagctgggaaacttacccaggagtccaactgctgaactgaagacttagtactcaaattggtgtgttagtgagaagaatggaggcaaaagccaatcaaataaccgaagttcaaaaagatcaagtctggtttctaacagaagatagagaagcagcagaaggaactaagggccactaaagagtctcacagtagccgccattcctctctaatcacagagaccacaaataaggactctgccaagtggagatttggagaaaaaaacagaaaaagcctttacttactgaaggacataaagatcatacagaatgcattacaaagcaatagtttgggttgagattactgactggtaccaggtcagatatttgattcagataagctgtaccgcactaatacgacattgacaatttactttccagttttcatatgctcttcggttggaattaaaaacaggtgttaaagggcacaagctgcattcctcaggctgcttctgttactcagcacaattaaaaatcaatttaaatggaaaccaggggcatttttaagagctaagaagccactcctagtctttttttgtttgagtgatgttgcggtgctgatgtattatgctttgtaaaacaaattagctatttttaaaaaatagttcttcttatgactaagtaaaactagatttatttagattatcaaaataaaaaggaatccaacgggctaggcgctgtggggtcacgcctgtaatcccagcactttgggagcctgaggcaggcaaatcacttgaggtgaggagtttgaaaccagcctggccagcatggtgaaacttcgtctctactaaaaaaaataataataaacaaaaaaaggaatccaaagaaagaaataattttaattattatttcagagtactttcaggtctgcctggcctgtctttacttctttttctagtctgtctttctcattgtttctactttagtccaaatcagtcttagaaagctaaggcactttccacttctatcacctaggttttttaaacggtattccaaaaagttaattaaaatatgtatttatagagtgtgggctgtggctttctctggtatgagttaaatgctactcaaccacaaacgcaacagttccaatcagggacattgaagtagattttgaaaggcagtcttttttttccatgcattgttacaactgtgtctaacatttttatagctaaaaagctgtcccgtcttacatattcatcaagatgtccagcagcaaaagagaatgggtcacggtggatccagtacaagggtcactgttacaagtctgatcaggcattgcacagtttttcagaggccaaaaaattgtgttcaaaacatggtgagttaaaatttgttgattttcttatgactcaataatttttagaaatgtttcttaaggatataatttgaagcaatgattgtatttttgaaaatatttttaaagcactttccatttctaatagcgctataaactaattgcccagtggtagggaaatggttaagtatctgatgacataggaactcaatgaaatattggaatagccattaaaaacgcctgtaatcccagcactttgggaggccaaggcgggcagatcatgaggtcaagagatcaagaccatcctggccaacatggtgaaaccctatctctactaaaaatacaaaaattagctgggtgtggtcgcacacacctgtagtcccagctactcgggaggctgaggcaggagaatcgcttgaacccaggaggcggaggttgcagtgagctgagatggcaccactgcactccagcctgggtgacagagcaagactctatctcaaaaaaaaattatcaatgttaataataagtacatggaaaataataagttggaagaagtagaattttaaagtggtggctgggtgcggtggctcacgcctataatcccagcactttgggaggccgaggtgggaggatcacttgaggttagccattcaagactagcgtgaccaacatggcgagccctcgtctctactaaaaatacaaaacttagctgggcgtggtggcgtgcacctgtaatcccagctacttgggaagctgaggcaggagaatcacatgaaccagggaggtggaggttgcagtgagccaagactgtgccactgcgctccagcctgggcgacagagcaagactccatctcaaaaataaataaataaataaaataaataataaaaataataataaatgtaaaataataaaataaaagtggctaagtgaactgctaagtaaaaatactgacaaatgattggaaacggttttacctatagctagatatgcttagaaaaaggaattaagaggtaaaatttttgtaaagttagctaagtagtaaataaaaattatagttgttccattgcttagttattaatacataagcttagcctcaccagggtaacaaatcaaagtagtatggttgtccatccgttctgcaataggattggccacatcctctgaccaccataaagggcagtgctttttgccttcagatttagctattttagaaagagtagcaatgattggctctttcccgtgacaaatttgatccatagtcaaactgtaaaatgacttctagggaaactacctagagtatttcaaagaccaaaacttgtttacctgcttccttgggtagcaaattagccaggtagatggatggcatttatctaatttattctgataaccgttgtggagacacttgactgattgaaaaatcttgtagttaccgggaacttttgtgtgggaaccattcggttttatacctgaatacacatgatggaaactgttgtaagatatatgtatgttttgaaagtcataaacctttttctcctaaaggagaaaacagaatggtttactgtaaaactaatatgtaggttaagcacttaagacttggaggcatgagggtctgggttcaaatcccagttcccacatatcctagctaagtggcattgggaggttacacaactctttctcttttctcatctgaacagtcagagaggtctcaggggtaggcagttccagggccaaaaaaatattgccagataaatattttgaagaaacacaaaatttctttatacgtgtttggaagtaatttttttgaagtacttataaaattttgacctaaataccagtttttaaaaactgtctctgtgtaaggcttgaatttatcaatgatcttgttaataatatatgtatttttcaaatggctagttgagaataaactacttctctagtttccataaagctaattgagaatgtgttttctttcaacagatcactctgcaactatcgtttccataaaagatgaagatgagaataaatttgtgagcagactgatgagggaaaataataacattaccatgagagtttggcttggattatctcaacattctgttggtaagtgaaataattgtatgtgtagtgtgcaaagagagttctaactcatcctaaataacaagtcgtccttgctaaagaatgttaagtagtggctaattcagatgcctcttctggataaataagctaggtcgctggctgttctggatggttataaattttgaatgaatccatgagttaacttagcaatgacggaaaccactaatgacacagaaaatcctgttaaataaagtggaatctttctagaggcttatttctgggatccttggatcaacatcaggacattttcttctccacaggaatgtctgtgtccccacaaggaacccatgcctgccttctcttagagttctagtgcctgtcaccgcatggatttgcagcttataacttcgttattcagaaagttatcttcttgttattcccttctctctaagaatatttttaccattggttaaaattatgtcttaatagtaatctttaaaaactgtcttagtgttaggttggtgcgaaagtaattgcagcttttgccattacttttgcgccaacctataaaattgcagataattgattcaaagaaaatttgtggaaggattttttaatacgaaatagtagatacagggtttaggtgaacttggaattggtagaaataagagtacaaatatgacagaagataaggtttttcacattttatgcaaagttgaattttaaattattaaaatgtgaattttaaaatgttaagtacttgtcaaaaaataaaaggattccaagatgtccatctaaatgaatcctaaatcgtgtttacactgtcaccacaaggtggtgccacttcagctggaaagcaaaaatggagtcctggtggtggtgtgggagaaaggtggggatggagattcctgcacccttcctcttccaccagcatatctttaacgatatgactttttacaattagagtaggggaaggatatgggtccttagaaatctctccctcacaaaataaatgtgcaagcattctgcactttaacggaaacaccacattctctatctgtgttgtccaatagaactttctacaaagacagaaatgttctatatctgcactgtccaatatagtagtcactggccacatgtggctcttgagcacttgaaatgtgactagtgcaactgaagaactgattttatttttttcatttttaatgcattttattttaacaagtggctctcatattggacagcacagttctgatgagttacatgaacccatgcttgtaacttactagtttagtggcagtagacatagttgtatttaatttctttcttcagaccagtcttggagttggttagatggatcagaagtgacatttgtcaaatgggaaaataaaagtaagagtggtgttggaagatgtagcatgttgatagcttcaaatgaaacttggaaaaaagttgaatgtgaacatggttttggaagagttgtctgcaaagtgcctctgggtaagtatggaacctgtccttaggagactttttgcagaacagtcaggaaataaatgtacaatccaattatgtacaaaattctgtatttagtcttgaagtatttagtccttaaagtatatccaactatcttgattaagtcatagagatttccccctgaaaaatagattacaagggacgataactgcacaagatgtccaggactccagtctacattttatataattctttcctaagaaaaacagaagttgccagggtattagggaagtaatttcttttaaaatgttcttgagatgtattttattctatagtttgattatataaaagcttaaaggtctatttctgcagttaatttgcttcctttcttcctaatcccataaaactcatggttaattttaaaacaatgcaaaactggatttagttattgaaaacattcagggtatctataaaaaatcataatttgaacttacatttcattatgaattgatacataaaattaccattaaaatgttatattaacttcatttctggagaaagagctccaaatttttcacagtaacatttttaaagatcttgcataaaacttttgcttcttgtatataaatattaaagataaaacctcaattctaggtaatcagtatccatgtatacacacactgagacagtaaatagagtgtctactatatgccatgccctgttttgcacactgggatgcacctgagaacaagacagataaggtacctgttctcacagagattacaatctggtgaagaaagataagtaaacaggtcaattttttaaagagaggaaaatatcaaatagttataaactctatgtgatggagactcagtggatagctactctagattaggaaaccagggaagaagcctagaagcaggagacaccgaagctaagatctaaaaaatcaagccaagcaaacttcaagggaaagggcataacagacagaggtaccagttggagcaaagagcctaaggcagaacaagttggctgagcgctcagggaagaactgaaaggtaggcaggtgctagacatacagagctttggaagcaaggcttgagttctggttttattctgagtggaatggaaagcaactggaagatttggggggttgggtgggagcagagttagggtgttgcaaatcaaaagttctacgttggccattttgagttatccatagagggacgagatgtgtagtgtgcatagcaatggtatttaaagtcatggaacagagcgaatccatctgggcagtatgcagataagggtcttggaacagcagctgcactaaatgaactcatctgagagacttaaatcattttgaagcaaataacactttatttagccccaggtaagtcaaaaacaaaaatttatagcttttagcaatttgctatcaaagtaggataatatacaagtagtgatgttcccaaattggtgttaggaagggggaatgtgagaataatcatagcgcattaatgtctttggaagaaaattcctatcacaatgaagaggatttgaatgaataggaaaacacttacatttgaaaagaaatcacttaagtgtttcttttgatctgacgatgagtttgaattctatgttagcgctatgaaacaatcagatttattatgtctgtatacagcttacaggtttacatgtgtgacacaacccataatgtataaaatcaataatgatcacttttgtattctctcctccaacatcaaaccttttcctgttccaggccctgattacacagcaatagctatcatagttgccacactaagtatcttagttctcatgggcggactgatttggttcctcttccaaaggcaccgtttgcacctggcgggtttctcatcagttcgatatgcacaaggagtgaatgaagatgagattatgcttccttctttccatgactaaattcttctaaaagttttctaatttgcactaatgtgttatgagaaattagtcacttaaaatgtcccagtgtcagtatttactctgctccaaagtagaactcttaaatactttttcagttgtttagatcttaggcatgtgctggtatccacagttaattccctgctaaatgccatgtttatcaccctaattaatagaatggaggggactccaaagctggaactgaagtccaaattgtttgtacagtaatatgtttaatgttcattttctctgtatgaatgtgattggtaactaggatatgtatattttaatagaatttttaacaaaacttcttagaaaattaaaataggcatattactaggtgacatgtctactttttaatttttaagagcatccggccaaatgcaaaattagtacctcaaagtaaaaattgaactgtaaactctatcagcattgtttcaaaatagtcatttttagcactggggaaaaataaacaataagacatgcttactttttaatttttatttttttgagactgagtctctctctgttgcccaggctggagtacaatggcgtgatctcggctcactgcaaatctccgcctcccaggttcaagcgattctcctgcctcagcctcctgagtagctgggattacaggcaactgccaccatgcccggctaatttttgtatttttagtagagatggggtttcaccatgttggccaggctggtctcgaactcgtgaccgcaggtgatcctcccgcctcggcctcccaaagtgctgggattacaggcatgagccaccgcgcctggcctctgcttactttttatatagcaaaatgattcctcttggcaagatgtttcttatattattccaaagttatttcataccattattatgtaaatatgaagagtttttttctgtttataattgtttataaaacaatgacttttaaagatttagtgcttaacattttcccaagtgtgggaacattatttttagattgagtaggtaccttgtagcagtgtgctttgcattttctgatgtattacatgactgtttcttttgtaaagagaatcaactaggtatttaagactgataattttacaatttatatgcttcacatagcatgtcaacttttgactaagaattttgttttacttttttaacatgtgttaaacagagaaagggtccatgaaggaaagtgtatgagttgcatttgtaaaaatgagactttttcagtggaactctaaaccttgtgatgactactaacaaatgtaaaattatgagtgattaagaaaacattgctttgtggttatcactttaagttttgacacctagattatagtcttagtaatagcatccactggaaaaggtgaaaatgttttattcagcatttaacttacatttgtactttagagtatttttgtataaaatccatagatttattttacatttagagtatttacactatgataaagttgtaaataattttctaagacagtttttatatagtctacagttgtcctgatttcttattgaatttgttagactagttctcttgtcctgtgatctgtgtacaattttagtcactaagactttcctccaagaactaagccaacttgatgtgaaaagcacagctgtatataatggtgatgtcataataaagttgttttatcttttaagtaaaagtaaaagtgctggagttgatccttcttgaaaaaaaaaatctctagattgggttttttatgttaggcatatagtacaagaaataaattgaccacctattgtaaagcgaggcatttgctaagagattttgtgtgcattttttagagaataaataggcgggtagtggctcacacccgtaatccctcttgacactttgggaggccaaggcagggggatcatttgagcccaggaattcaagttcagcatgggcaacaaagcaagaccccatttctaaaaaaaaataaaataattagccaggtgtggtggcacccatgtgtagtgccagctactcaagaagccaaggcaggaggatcccatgagcccaggagtttgaggctacagtgagctatgaacgtgccactgaactccagtctgggtgacagagcaagaccctgttttgaaaaacaagtcgatattgatccaattgctgaatactggaaaggcaaagtcagataaaactggattctcggaattaggaaaccaatgaccatcttagccaatgcaaatgtagcagagtagtgaagccagaatccagatggaagtgagtttaaaagtgaaagggaaggccaggtgtggcatctcgtgcctgtaatcccagcactttgggaatccgaggtgggtggatcacctgaggtcaggagtttgagaccagcctggccaaatggtgaaaccccatctctactaaaaatacaaaaaaaaaaaaaaaaaaaaaaattagcccggtgtggtggtgcatgcttgtaatcccagctacttgggaagctgaggcgggagactctcttgaacccaggaggcagaggctgcagtgagctgagatcgtaccattgcattccagcctgggtgacagagcaagactctgtctcaaaaaaaaaaaaaaaaaattgaaagggaaattaggagatgaggaacatgagatttcgagaagtatgatggagacagaaaggaaaggggctgggctatagccagaggggaaagaagggttgaaaaagggtttttttctaaaggggagagaaagaggttcacaagtttagaagctgagatgaaaaaaacaaaaacaaaaacaaaaataatggacagagagcagttgatgatgcagtggggagagggaatcattaatggaagatcttggagaagataaaatgagaggggcagtcctaagcagaaagaggaactggtttgggtgggctggagaagcatgccttcctctctgagaccacaagagaagaactgcagataagcatttgaagatgtttgtctatatgtaatggcacctgttttcttgtgtactagaaggcaaggtctgctgagaaagatgggtagcagatggggtcttttaaaaagttttttaattttttagagacagggtctggctcagttgcccaggctggaatgcagtggtgcaactctagctcactgcagtctcgacctccaacattaacttttttttttccctagagacaggtgatttcaatgttacctaggctgctctcaaactcctgggctcaagtgatcctcccacttcagcctcccaagtgttgggattacaggtgtgagccaccatacccagcctgggatcttagcttgaaaagagtaataaatttgaaagactcaatgagagaaataggagaggacagtgactaaggtaaaatcaaatacaaggattgcagaagaggcatagaaggcccagatgaaattaaaagccatattgtttatagtgacagccatcgggagaactgattgatttcctccacctgtcctcagttaacttcagtaaagttgaggaaaaagagagcacgggccaggcgaggtggctcatgcctgtaatcccagcactttgggaggccaaggcgggcagatcacttgaggtcaggagttcaagaccagcctggccaacatggtgaaaccccacctctactaaaaatagaaaaaacttagccaggtgtggtgatacacgcctgt

SEQ ID NO: 628 - DNA, 11808 bp, Human
ggacttgggaaacatcttccagggaagtcgtcgaagctgttttaaaatatagcaaacttttgtatttagttcaggaacagcatggcccattttgccaatcacatcttaacagttggaaaagcaaacatattatctatcaggctttcctctaaactttaaatatgttttataagttataactccagagaaaatttacaaaggataaaccttaatatagaaggaattagagctgccacagcttctacacttttaacctctcaatattttatctgttgggctccactgtttcttcctggaattcacatcactgccaccactctgttctccttgtcctcatatcaatgtggccaaatattttccctgtatttcaatcaggacaagacatggttttttccccccatcaaaggaatggagaaccatagaatactagttttaaaatgtctttaggccaggtgccgtgacccatgtctgtaatcctagcactttgagaggttgaggcaggagaatcacttgagcccagagctcgaaaccagcctgggcaacatagtgaaacctctgtctctattttttaaataaaatttgaaaaagtctttagacataatctagtctaaaaatgaaggcttaaatgtgatgtatagccccctgccaagtggctatcacctgtgtgggcatcttcagtcatagggatcttattgccacagagaaatccctttaaacttattgggtaaaatctctccaatgtttattaagaaacacacaaaaaataaagcaaagaagaaaatgcaaaagagttataaatgagaggaagcaaaatgggcacttattaaaggtctaataaatgcacatttgtatccatcattctactgagttcttactcccaagatgttcttccctttagcaaacaaataagcaagtcagcaaagaaagaaagaacaaacaaaatgtggtgatcagggaagcattgaggagatggatggtggcaggtggcaagaggactataaaagttttacaaaatgtcttcctctgaatatgtttagagtcttgcattcaagcatttattatacaccaataatgtgagcaacactttacttgacaaagaaacagaaaagaaaggaaaggaagaaaacagaagagcatgaagagaaaatttaggatggattctgttcttcaacttcaaagcatctgctaatttgaatttagggaggaggggaaaaggttgaaagagaataagacatgtgtagaagacaaggacagagagaatttcagtccggtaagcaatgtaattcatttcaattctacaactatttatggagcagctacgtgggcccatcacccattaataaattggttacagaattaaaaccaacccaaagggaatatacttccttctttttcacagaccctctttgttctattctgcccatgaggttttcctcctcaagaaccagcaaatccaacgacagtcaatagcaggcattacaaatcagattcagaaaaataaatcaccccttctaaatttcttctagatattatcttttatgttttgagtataattgtatatagtatagactatagctatgtatgtacactttccacttacatcttttatttgcttttataatgtgtttcttaaaataaaactgcttttagaagttctgcacaattctgatttttaccaagtcaacctacttcttctctcaaaaggacaaacataaattgtctagtgaattccagtcaatttttccagaagaaaaaaaatgctccagttttctcctctaccaagacaggaagcacttcctggagattaatcactgtgttgccttgcaaaattgggaaggttgagagaaattagtaaagtaggttgtatcatcctactttgaatttggaatgtttggaaatggtcctgctgccatttggatgaaagcaaggatgagtcaagctgcgggtgatccaaacaaacactgtcactctttaaaagctgcgctcccgaggttggacctacaaggaggcaggcaagacagcaaggcatagagacaacatagagctaagtaaagccagtggaaatgaagagtcttccaatcctactgttgctgtgcgtggcagtttgctcagcctatccattggatggagctgcaaggggtgaggacaccagcatgaaccttgttcaggtaattaacactaactgacctggccaggtggggagcttccagagtaagctgaaaccattctgtgtgtcttaaaacccacatagaatgcttgagcttactgtgtaggaacagttcaagaatagagagttatagagtgttggaagtggaaaaggtctcattatcacaccatttgggcttctcctcttatgtaggaagaaacaaaggccagaaatattaggtgttttcttaagatcacacaacaccatagcagtagcagcactggggcttaaggcacatgagtaacaagtggagagtggatgaaccatatcttgctttggaacagcttcagttttttttttaatgcaacgtaattttagctaaatatttgtgttgctagtatcatattataaaatttggcattatttcagcaagctagagaaatactccaaatagattaagaagtgagcaactgcaaaaacttactataaatagatagctatagtaaaaattgtaagagtgacctaaaaactatacttattctgttagaaatatctagaaaactactacgacctcaaaaaagatgtgaaacagtttgttaggagaaaggacagtggtcctgttgttaaaaaaatccgagaaatgcagaagttccttggattggaggtgacggggaagctggactccgacactctggaggtgatgcgcaagcccaggtgtggagttcctgatgttggtcacttcagaacctttcctggcatcccgaagtggaggaaaacccaccttacatacaggtaatggttcagaggggttttcacataagattggaattttataaactatatcataggagaaaatagcatctgcttcaatttttctcctacaggattgtgaattatacaccagatttgccaaaagatgctgttgattctgctgttgagaaagctctgaaagtctgggaagaggtgactccactcacattctccaggctgtatgaaggagaggctgatataatgatctcttttgcagttagaggtaaaaaaaaaaaaaaaaaaaaaaaagcaaaacaaaacaaaacaaaaaacacatgaaatgtatccattcatctatctggtgttgttgtactggaaaaggctcaaaagggatccttgttacatatctttccaataaatttttttcctactagaacatggagacttttacccttttgatggacctggaaatgttttggcccatgcctatgcccctgggccagggattaatggagatgcccactttgatgatgatgaacaatggacaaaggatacaacaggttagttacacatctctcagaatgattttggcattaatttttttatatgtagaaatctgttaataaccaagaatgctcaagaaatgagatgttctggattttccagtggatcagagatcagcagaatatatttttgttttaattattattgaaaatattttcagatgctttaacagttttcctatattggtaagcacaatataggaaatatcattaagtatttctttaatgactggatctttgtgatctaggggtaaccattattaagaaaaatttctcatatcaaaatacaaacattcaagggatagtatattgcactgaatctacattaaaatgtgctctggatgttacttatgtaatttcctccatttacttctttactcttcaaaccagaaataagaattaaatttcagaaactgagattctcttttttttttttttctggctgaggcattattttagtacttttaggttaaaagaatttttatgggcttgttctgaaggaaaagactaactcccaaatacaacgttcaaactgtttaggtagaagaatgtttctcagttcataactgtatgttttggggaatgacatccaaagttttcaaaaaaatcagctaaaacaattaacactacttctaaaaaaataggaaaacaattaatactatgtctgaggtttaactgggatttataatgaaaatgtaaacctctgtaggacgtacaaatgtgagtttagtcctggatagaattcttgattggttgagttaacgaattcttgtaaagaaaccttcctgcaaactctcaaatgagattgttcctagcatcacaagttacacaagtaatactagcaaaagtaaggtagatttacttactatattgatcataattacccaatgcctcccaattttagcattatgggtgtttttaaaaatatgaaggaaaaaattttgaataaagccagtgtttatgtattctaaatctgttgtgtgacaaatgctagacatgattgggcatactgtgttttaaaccaattttgcaaatcctatgacatctatcattattcatgtttttagtctcaatatgtacttcatgatgatgaggctgagacattatcaattaacatgaatatagtttcctttaactgagactgcaaatggcaaatgtaaatatattaaaacagtgtttagctttgcattgacaaatgaaggtaaatatctgatatgctaagcaagtgggttcattccattcctgagtacaagaaaagggatctggttcttctggagttaatatgcttgtgaggctgggggtgggtttggggccatggggggcaagtggatgtaactgggaaatcaatctcaaagattgattacaggtatgagttttaaaatacacttagctttccattaagtgtgtaattagtcaattgttcaattaaccaacaaacaaggtgtaaaaagccctgtgtggttccaagaagtaaaaaccaatacaatgcacagcagacctgtgtaatgcacatgtatttaaaaaataagtaactattgttctcaatttcttaaatagggaccaatttatttctcgttgctgctcatgaaattggccactccctgggtctctttcactcagccaacactgaagctttgatgtacccactctatcactcactcacagacctgactcggttccgcctgtctcaagatgatataaatggcattcagtccctctatggtgagtgacactgggaaaatcagccattgtagttttgcaatgatggtcttcagaagagctttcaaatgctacataaagtatttatgatttagttcaaagcaccgtgagaatgtttggaaagcatacaaatgggcatatattgaaacgtatcacatttcccctaatgttccctttaggacctccccctgactcccctgagacccccctggtacccacggaacctgtccctccagaacctgggacgccagccaactgtgatcctgctttgtcctttgatgctgtcagcactctgaggggagaaatcctgatctttaaagacaggtcaggctgaaaaattatattttcctaccattttaatctacaatgtttagaaaggaaaacacgcagaaacttgatagagattcttagacatttaaaacaaaaacgtttcttctgagcttggaatcatttagatctggtgctgccttttcccacattttcctaaaattgtcaggttcatttttgaaggcacaggctgatctggttcttagcttctaattgctgtttccaaatgtcttaagtcacagttacttttcaaaaggcatgagtagatctttcgaataataattttatttttacttcctttaaaaatgacatcaggatcaacattacatttaatcaagtaatttacttactgatggatcaatatgcacatgacaaacattcaaagagcacaaatgagaagcaaattaaaaattttagttcccagttctccctgtactcatccagagtcaagactttttgtgcatccttccagaatctttctacacacatacaagaatatatttacacagcacatacacgtatacaaacacggcctagcttttggaagagggtatagcacacgcactgttttgcatacattgcaggtaattaaagcttatgctgggctaattcatttgcacgatagaataatttttctttcatagaagacattactctggaaacctatgacgggagactcactacagtcttctgaagaaaaaggaaagaaattttctaatggcaatatacctgatttctatctgtcatccagcctagaagatgagagaatgggggaagctgggtgaggcaagacggtgaggaaaatattctaaaggtgaaagattgtttttcaatttacatttctttttacatatattttaggcacttttggcgcaaatccctcaggaagcttgaacctgaattgcatttgatctcttcattttggccatctcttccttcaggcgtggatgccgcatatgaagttactagcaaggacctcgttttcatttttaaaggtaattactatatcatcatttgtttaacttgccaaagtaaaccctctcataagaaattgaacaacactttaattttccctactacaagttctggctaatacagtagtcaacggtaatgaagaaataaccagggctgatatcattgtatttatatttcatagatgataaaaataaagacaagaagataaattacccagagttgtaaattctctcatttgaccttagttcattcattcagtctgcaaatttttgtgaaaagcccactgtaagctggtgactaaatctaaaatttgggctactactttaccatgaaaatcaaagatgctaaagtgtatttctaaagcgaaagggcttaactgttataattcaatatgactctgaattatttatatttaacaggaaatcaattctgggctatcagaggaaatgaggtacgagctggatacccaagaggcatccacaccctaggtttccctccaaccgtgaggaaaatcgatgcagccatttctgataaggaaaagaacaaaacatatttctttgtagaggacaaatactggaggtgagatgcaagagaaatgactttgtatggagcctaattagggaaattagtttcttttactaaggaaatcccccaccccaaccttaggcctgcttctctcttagtaggaaggatgggacttcagacaactgtgggaaagttcttactttaaaacagcagcaccttaggctctcctgctttcagtcccaagtgcagttggctggtgcttcccttggtgctgtcaccccacctgcctggagccccctcttctctcctcaacctattcaaatcttgcccatccttcaagtcctggctcaagtctcatcacctccatgcagctttccctcgtggactttagacccattgggaaaatgttctgagaacccagaccgcaatttagcgttcccttcccattgtcttttagtttggctcactgtctcactgtgtgtttgtcactgtctcattgtgtgtttgttttgtcttcctaacactactatatgattttcaagggctacctctaacctcacccacttgtcacctctacctgataatgatggctcatttaagagatgatgatcaatagcagtccagtttatggatacaacccaacactcacagacaggttgattcctgggtcatttggccagactttgagacatcgaggccgaccatctgatatccagccaatgggctaaaaacacacttactgtgctttgcttcttatcctaatcccttttcccaggaggccaccagagaagatttagatgtgcaggggaggggacagcaggcatatatgggccaattgtggtagggaattaaaattgcattttagatgttgattcaattcactttatatatatgttcacactttcatgtctttgtgacagaaagatgattaaggttctttctgtccaggcttaagaaatatgatgacaaacagcatgtgctacatacagcaggatgcggcccctgttccggatggagatatggctttcagaactctttacagtaccattaaagtcacatatttctatagtcccaaatatgcttggcatttatttgcagtatttataaagtttagtaaaattccacattaaacctaacatgatctaagatgttcggtaacatggcctctatgcaatgctgagctgtttcttttacttggtacagatttgatgagaagagaaattccatggagccaggctttcccaagcaaatagctgaagactttccagggattgactcaaagattgatgctgtttttgaagaatttggtaagaggatacttactgtgttggccatagagcacttgaaacattttatgatatcagagggaagaggagcattgaaactttttaataacaagtgtttcttagggccagttccctcctcaaaattttgattcgcctacatttgtactcattatagaactacttcacaaaataacttgtttggaaccataaagataattacacaaatctcgctactttatcttatacatgcatataaaatcaaagtgctccagtgtcacttacatctcgagctaacatgtggagtcaagctcgactttcagattaccatgttagcataaaaatcccatcaagtggtgtggccaggtttaatgttggttagctggccttctcctccaccctatcttattgctgctactaattcccagggagattttttgtctgtctttcctgagttgtcagtcattgcccatgccagtcatttgcaaatacttacctttccatgtgcccaaagtttaaaaaaaaaaaaagattttgttttctactcaaggtaaggaagtggaggctgatgatctttattgaaaggtaacctgatcaccatgtttgcagagcactaaagggtcccctggtgttttgaaatagttgctgtgcttcctaggctgcaatgcagggaaaagggaggaggatttttggggaagaaagaaataggtgatgagagtttccaagcaagtggagaatttatctgatcggaagcagaataaccctgtaacctggaatctggctgtgttttcagacagagctggcaccgagtgctgtctccattcttccttgctgagtaaccttgaggaagcatcgaaatctgtctcaacctcaacttgctcaatctgtaaatggagttagacatacaacctcatagggttgttgcagaaataaatgaaaataaattcatgtaacaagcttggcatagtccctgacataaagtaaagctctataaacactttctatttttagttctctatgattctgagttttgtatattgtcaaatgtctttatttggaaaaatatcttactatttcccttgtctgtatttgcagggttcttttatttctttactggatcttcacagttggagtttgacccaaatgcaaagaaagtgacacacactttgaagagtaacagctggcttaattgttgaaagagatatgtagaaggcacaatatgggcactttaaatgaagctaataattcttcacctaagtctctgtgaattgaaatgttcgttttctcctgcctgtgctgtgactcgagtcacactcaagggaacttgagcgtgaatctgtatcttgccggtcatttttatgttattacagggcattcaaatgggctgctgcttagcttgcaccttgtcacatagagtgatctttcccaagagaaggggaagcactcgtgtgcaacagacaagtgactgtatctgtgtagactatttgcttatttaataaagacgatttgtcagttattttatcttattgttgtgtttgtttgtttcaagggcaagttgttctcataatttgggcactttatgggctgagcatgctcagccagtagactagagtctccatggcttggggttcacaatgggttccagaactgcagagaatctaccacttgccctcctcatgagccctgcaaacaggatgcttatttctaccacctagacattttatgtgtcctgacatacctaaggcaaaaaatctagaggggttgtgacattgtagagcaggctctaggaaaaactgtgaagggaatcctataatcatagcaaattgccttgtttgcacatctcattttacagggtgaggaaatcagacttgtttttcatcttttccttttacttataaattccctcagtgcaggtccctcccctgacctagcaagcaaacttcctcatatctaccctattcacatggtaaaatatactcttgtactcattttgtatctgcctgtgcctggatgtaaatgcccattggcaaatgacgattctaacattggtttatcatccataactaatgtctctagcacaatgcctcgtacatggtaagagccgtttttaacttatccattcatctgagagtaatttacaaatcatattccatatgccaggcattatgctaggttgcaggcataagaatatgaaaataatagacacaggcccctgccctcatcgagattataatccagcgaaaagaacacgtgtagataaccacaaatataaatacgcaattgtaaatttcataagagttataaagggaaaaaaataataggaggatctattttgaaccagatggttttagaagaacttttgagggaatggcattgaaggaggttttgaaaggaggtgtggagactaagaggggagatgatggcttggaccacatgggcacacgggagagttaggaatgagagtagactctatagatatgagatagataacagaacttagtgatggattagatatgcaatttgagagaaaaggaaatgttccgagtaaatcctaggtagcttgcttgagcataagagctgatggtgacggcatttactgagatggggaaagacttggagagaagaaggtttgtgaaggaagggcaagagttaggatgaattttttatgtttgcccatttttgaaatgtgttggagaaattcaagcacccaagagctaaaggaatctgaaatgcaaaagagacacacacatatatataaaacatatatgtatatggaaggtttcaacattgagattattcttaaagccagaagtatgggagagatcatatggggagagtttaagataaaactaatgaatagcaacatttggtcaaaatttacagcatttctttatttttaaaattacctaattttatttatttctaataggtactaccttagccacaacacaaaatccaaacgttaaaagacattatgcaatataaacaattttcctcccacccctgtttccaacatctaactccttttctcagaggtaaccaagcagatctttcttgaatccttccagagctattttacgcataccaagcattaatataatctttcaaaataaaaatggtactatgcaaaattacactgtcttgctctttgatttctttcacttaatgtatcttggcagctattccacattagtacatgtagaattgctttattcaatttttttttctttaggtgcacttaatttaatatcaagaccacaatacaaaaggcccaaatacaatgaaaaaacacatttgtccattaacaccaatgataatgctctttcagcacatgcctgccgaatggaatgcggatttaataaagctcactcctgaaaaaaataacccagtgagtctcaccacagccaacatccttaagcaatctggttgtgaaatgaatgtttataatgcttcaaacagcttaaacctgaagtttgataccacaccttcatgtttgcacagttctcaataagattatcta

SEQ ID NO: 629 - DNA, 11614 bp, Human
actgctagctgcatgggagtggggtgaggcctgtgactgccagctttcccccacttcccagatgacctgtatgactgagcagatgcagccataatctccttgggaacataactccattgcctagggaccacacccccattccccacagcagctgcagcaagccctgcccaaggaaagtctaagctcggacacatctaaccctgcccccacctggtggtctttctctaccttccctggtagctgaagacaaagggcatctcttgggagctctagggccctgcccaccttctgagaaacctgaatacttaaccaggcatccctagggcaagtttgcatcctccctgtggtactgcaactgatgcactctggaaagcaccacctcctggctggaggccagccaatacaaaaccagcacactaaacaaaaatagaaccaaggaccctcacagagtccacttcactcccctgctacctccactggagcaggtgctggtatccagggctgaaaggcctgaagacagttcatatcacaggactctttgcagacactccgcagcaccagcccagagcccagcagctctgcagggtcgctagacccagaagaccacaaacaatcactgcagttcagctctcaagaagcctcattcccaggggaaggggaagaacaccatgtcaaaggagcactctgtgggacaaaagaatctgaacagtaacccttaagtcccagatcttttatctgacatagtctacccaaatgagaatgaaccagaaaaacaattctggtaatatgacaaaacaaggttctttaacacccccaaaagatcacaccagctcagcagccatggatccaaatcaagatgaaatcgttgaattgccagaaaaagaattcagaaggtcaattattatgctattcaaggaggcaccagagaaaagtgaagttcaacttaaagaaatcaaaaacattacacaggatatgaaagaaaaaaatcttcagtgaaatagacagcacaaataaaaaacaatcacaacttctggaaatcaaggacaagcttagagaagcgtaagatgtattggaaagtctcagcaatagaatctaacaagccaaagaaagaacttctgagctcaaagacaaggcctttgagttaacccaatgcttcaaagatggattaaaaataattttaaaaaatgaacaaagcctccaaaaagtttgggactatgttaaatgcccaaacctaagaataattggtgttcccaaggaagaagagaaatctaaaagtttggaaaacatatttgagggtataatcaaggaaaatttccccagccttgctagagatctagacatccaaatacaagaagctcaaagaacacctgagacatttatgacaaaaagaccattgcctaggcacatagtcatcaagttatttaaagtgaagacaaagaaaagaatcttaagagctatgaggcaaaagtatcaggtaacctataaaggaaaacctatcagattaacagcaaatttctcagcagaaatcctacaagctagaagggattgaggtcctattgttagcctcctgaaacaaaacaattatcggccaagaattttgtatccagtgaaacaaagttttataaatgaaagatacagtcttttccagacaaacaaatgatgacagaatttgccactaccaagccagcactacaagaactgctaaaaggagctcaaatcttgaaacagatccttgaaatatgccaaaacagaacctccttaaagcatcaatttcacaggatctgtatatcaataatacagtgagaaaaacacaaggtattcaggcaacagatagcatgatgaatagaatagtgcctcaaatctcaatactaacgttgaatatgaatgacctaaattctctacttaaaagacatcgaatggcagagtggatgggaattcaccaatcaagtttctgctgtcttcaggagaccctgctagagtgcttttctggcagccgccattggggggttcccaatttgcttctagcaaattgggaacaccttggcacctcaagcatagcaggtgcttgaccttgaggggccaaaaacaaagctgcagacctggtcccagcaccccatagttggagcatgaagctcaggagtgctgagctgagccctggcctcctgaaagcatccagaaatgaagccagtcaactacacccaacttataccacagttaaacttttcagggcatcaaaaaatataaaagcaaaaaggcccattcaaaggataacaaattcaaagattaaaggaacatcagcccacacagatgaaaaacaaccggcacaagaattctggcaactctaaaagtcagggtgtcttcttaccctcagacaaccacactagctccccagcaatagttcttaccagattaaagtggctaaaatgacagacataaaattcagaatctggatgacaaagaagctcaaaaagatataggagaagattgaaacccaatcaagaaaaccagtaaaacaatccaagagttgaaagatgacatatcaattttaacaaagcatcaaactaaacctctagaaatgaaaaattcactacaggaatttcataatgaaatcagaagcattaataacagaatagacgaagctgaggaaagagtctcagagctcaaagactgctccttcaaaccaacacaggcagacaacaattttttaaaaaatttaaacatgaacaaaacctctgagaaatatgggattatgtaaagagaccaaacctacaactcattggcattcctcaaagagttggagagagaggaagcagcttggaaaacatatttgaggatgttgtccacaaaaatttccccaaccttgctagagaggtcaacaggcaaattcagaaaattcatagaacccctgcaagatacactagatggtgaacaacaattcccaagacacatagtcgtcagattctccaaggtcaacatgaaagaaaaaatcttaaaggcagctagaaagaaagggaaagtcaggtacaaagggaaccctgtcacactaacagcaggcctttcagcagagaccttacgagccaaaatagattagggccctgtattcagcatccttaagggaaaaaaaattctaggctgggtgttgtagcttatggctgtaatcccagcacattgggaggccaatgcaggaggatcacttgagcccagaaattttggactagcctgggcaactaggtcagacccacatctctacaaaaaataaaaaattagccaggtgtgtggcatgtactgcagtcccagctactcaggatgctgatgtgggaggatcacttgagcccagcatgttgaggctacagtgagctgagatcacaccactgcactgcagcctgagcaacagagtaagattatgccttaaaaaaagaaaagaaaagaaattccaaccaagaatttcctatccagccaaacgaagcttcataagtgaaggagaaataaagtccttttcagactgacaaatgccaggggaattcattatcaccagacttgtcttacaagagatcctgaagagggtgctacgcatggaaatgaaagactgaggcctgccaccacaaaaacacacttaggtacattgcccactcacactataaagcaactattcaatcatgtctacagaacaaccagctaacacacagtgacagaattaaatccttagatatcgatattgaccttgaatgtaaaggtctatgaatggtgtcaacacattcacaatatcaatatgtgtgaatgtaaaggtgtaaacatttcacttaaaaggcataaagtggcaagttggataaagaagcaagacccaagtgcttgctgtcaaaagaccaatctcatctgcaatggcgcccataggctcagagtaaaaggatggaaaacgatctatcaagaaaatagaaaacaaaaaagagcaagggttgctatacttatttcagacaaaacagactttaaaccaacaatgatcagaaaggacaaagaagggcgttatgaaatgataaagggttcaattcaacaagaagacttagctgtcctaaatatatatgcacccaaccctggggcagccagattcatacaagttcttacagacctatgaagagacttagataaccacacgataacagcaggagacttcaacaccccactgacagtgttagacagctcatcaaggcagaaaactaacaaagatatttgggacctaaacttgacacttgaccaaatggaccctaacaggcagctatacagcactccaactgacaatagaacatacattcttctcatctgcacatggcatgtaatctaagatatagaacactccacccaacaacaacagaatatacattattctcatctgcacatggcgtgtactctaagattgacaacatgctcagccataaagcaattctcaaacaaattcagaacaaccaaaatcatactaaccgtgttctcagaccacagtgcaataaaaatagaaatcaatactaagaagatcactcaaaaccatacaatcacagggaaattaaacaacctgctcctgaatgacttttgggtaaacaatgaaactaaggcagaaatcaataaattctttaaactattgagaacaaagatacaacataccagaatgtctaggacacagccaagaagtgttaagaggaaagtttatagcactaaatgcccatcaagaagttagaaagctatcaaatgaacaacctaacatcacacctaaaaaaactagaaaaagaaaagaaaagcaaccccaaagcttgcagaaaaaaaagaaataacccaaatcgagctgaagtggatgaaattgagatatgaaaatccatgcaaaagatcattgaaaccaaaagttggttttttgaaagaataaaaggaattgatagaccagtagctagattaataaaaagagagagagagagaaggcccaaataaacacaatgagaaatgacaaaggtgacattaccactgaccccacagaaatacaaaaaaccctcaggaactattatgaacatcactacgcacacacactagaaaacctagaagaaatggataaatttctaaaaacatacaacctgccaagactgaaccgggaaaaagttgtaatcctgaatagaccaataaaaaattctgaaattgaattagtaataaaaaacctacaaaccagaaaaagtcctaaagcacatgaattcatagctaaattcgaccagatgtacaaagaagagctggtaccaatccaactaaaaatatttcaaaaaattgaagaggtgactcctccctaactcatgctatgaggccaatatcattctgataccaaaacctggcagagacacaatgaaaaagaaaacttcagatcaaaatccctgatgaacatagatgcaaaaatcttcaacaaaatactagtaaactgaatccaaaatactaataaactgaaagctaattcaccacaatcaagtagggctttattcttgtgatggaagattggttcaacacgcaaaaccaaaattcgtcctctttcatgtaaaaacccttaacagactaggcattgaaggaacatacctcaaaataataagagccatctatgacaaacccacagtcaacatcgtactgaacacgtgcaaaagttggaagcattccccttgagaaccagaacaagacaaggatgttcactgtcaccactcctatacaacatagccagagcaatcaggaaagagaaggaaataaaaggtatccaaatagaaagagagaaaatcaaactatctctctgcacagacaatgtggattatgcctagaaaactccatagtctctacctaaaggctcctagaactaataaacaacttcagcaaagtttaagcatacaaatcaatgtacaaaagtcaataacatttctacacaccaataatgttccaaactgacaaccaaaccaagaatgcaatcccattcatgatatccacaaagagaataaaataactaaaaatacagctaagcagagaggtaaacaaactatacaacaagaattgcaaacactgctgacaaaaatcacaggtgacacaaatggaaaaatattccatgctcatggataggaagaatcaatattgttaaaatggccataatatccaaagcaatttacagattcaatgctattcctatgaaactaccaatacacctaaaaaaacagaaattgacaagtaggacctaattaaactgaagagtttctgcacagaaaaagaaagtatcaacaataaacagacaacctacaaaatgggagaaaatactcacaaagtatgcatctgacaacagtccctttatccagaatctacaacgaacttaaatcaacaagcaaaaaacaaacaaccccactaaaaagtgggcaaaggatatcaactgacacctttcaagagaagacataatcttagccagcaagcatatgaaacaatgctcaacatcactaagcattacagaaatgcaaatcaaaaccacaatggatactagctcacaccagtcagaacggctattattaaaaagtaaaaaaataacagatgctagtgaggtcatctagaatagggaatgcttatacgctactgatggaatgtaaattagttcagccctgtgaagagctatagaaagtttaaacatttctcaaagaacttaaaacagaactaccattttacctagcaatcccattactgcatatatacccaaaggaacataaatcattcaaccaaaaagacatgtatgttcatcacagtgatattcacaataataaagatatggaatcaactagatgctcatcagtgatggactggatagataaaatgtggtacatatatatcatggaatactatgcagccattaaaaaaccaaaatgatgtcatttgcagaaacatgaatgcagctggagatcattatattaagtgaataaatggaggaacagaaaatcaaataccacatgttctaacttataagtgggagctaaacactgagtacacatggacacaaaaataggaacaacatgcattgtggcctacttcaggggagaggttaagagaagagtgagtgtcacaaaactacctattgagtactatgctcactatctagaagacaaaattatctgtacaccaaacttcagagacatgcaatgtacccatataacaaagctgtacatgtacccctgaacctaaaatgaaagttgaaaaaagagatacttgtacatgtatgtttatcacagcactattcacaatagcaaaaatatggaatcaacttaagtgtccatcaacagagaattggataaaggaaatatggataaaggaataaaatcatgtcttttgcaaaagcccagatggaactggatgacattatcctaagtaaaataactcagaaacagaaagtcaaaatactagcatgttctcacttataagtaggagctaaacaatgggtacacacagacacacggattgtaagaattgacattggagacgacaagaggtaggagggtgggagggggatgagggacagaaaattacctgttgggtacagtgttcactatttggatgataagtacattaaaagcccagacttcaatgctacacgatataggcatgtaagaaacctgcacttgtaccccctaaatatattttttaattaaaaaaatttttaagtcacagacttatgattccatttgtatattctctacatgacaaaattatagatacagaaaacagattagccggtgccagggtttaaggatagtgggaggccaggggacaggtgtaactataaaaaagcagcacaaaggagatcttcatggtgatggactagttgtggatattgattgcaacagtgtttccatgaatctacacatgtgatagaatgacagagaatatacacacattgtaccaactgcctagtttagatattgtactatgattatgtaagatgtaatcattggggaaaactggatgaaggatacatgagtcacctctgtattatctttgcaacttcatgtgaatctataatcatttttaaattaaaagttttaaaaaagcagccatacattcatgctaaatttaacatttggtttgtgtattgaaaaaaaatttctaaggcaagctagattaaaaaagaacataaggtcaagaacaatgcatataatgtagtcctatttacttttttctttcagaaaggcaatatatgcaagtacatatgcatatacatatgcaagtacatatgcaaatacatatgcaagtacatatgcatatacatatgcaagtacatatgcatatacatatgcaagtacatatgcatatacatatgcaagtacatatgcatatacatatgcaagtacatatgcatatacatatgcaagtacatatgcatatatatgcaagtacatatgcatatatatatatgcaagtacatatgcatatatatatgcaagtacatatgcatatatatgcaagtacatatgcatatatatatgtgcaagtacatatgcatatatatgtgccagtacatatgcatatatatatatatatgcctatataatttatatatacagaaatttccaaagtaaaggacaagatactaatagcaaaggctgaccctggggaacagactgggggaacccagagtaaaggatatttttaacatgaaagaggactgtattaataattgcacagaaacaacaagcataacgagctcaaaactcagaaaatcagagtttatggtcactgagagtaacattactcaataaatgccagttattgttgttatcttttcttcttccttacatttttacctattttgtgcaaaaaaaaagtttatgataatggtagactaagttatttgtattaacactcctattaaaaaaattgataggatagttttatagtgttggtaacccatcaaatatatgataggatatcctcttaaacacctgtcagtcactcagtggtcatcaacctaaatgcttaccacaccaggaaggtaaagtaaatatgtgagggccaggtgtattatttaggaaaagattgagatggtggcaaacaagaaataacacccagacaaagcatttaaatacaaatgtatacaagacatggcttggatgaaacaaaacacatttgtgttctgccagtcccccacagcaacccatgcatgtctgcctgctaaggaatcctgttccactgtaggcagatctaattgctagaaagctccttgtgctcagctgaactttatgtcggtaatttccctctataaatcctagatctgagcattttcttcataacaatatttagttgacttggctttagcaaacacttgctgatgtctaataagaactagttcctttagcacacgttcaaagctacctacaggtaggtagacaatgtaactcaagtttgtcctcagaaagactagggtttaatcccaactctgtcatctaaaagctctaggacattggaaaagttatttaaatcttatatatattcatattcaagatgtggataataaaactgttcagcttgcagagttgctgtggagattaaatgtgaaaatatgtacaatgcatagcacatgtcaaagaaatgacgttttctgttggaaatgtaactaatttggggccaattgttcaactttcttgaatttttgagaaagtagaaaattagcaaattttcaaagtcatttcatagccaaagattgaaagacgagctacaggcttgatatcctaaagaaacttcttttctttcccaagctaccaggtgtgttttctctccttgccactagatggcaattgcctcccagggtatttgagctcaaagaccataaaatcccggaggccaccaccaaggctaacttttaaattacaaagcagtccagaaccataccctggtctctcaaagataatttgttcacttagtaactaagaaatacagggaccacttcccgaaattcaagggagtgggagaaggagtgattgtctagaagagcaactcaagactttttccacaaagtaactcattcatctgacctagtttgttcctgccgcagagtctttgctctcactgccccatattcccagaccctctccctccagacatttgtgcagcccactcctttatgtgtttacatactagctccctgcctccataatgttagtctcaggagagtgggggctgttttagtttcatacagcacactcaacctcaagaataatgcttcctatgtagtaagtgctcagtaaacattggctgaatgaaatttaaatgaatacccaggactctcaaaagttgctcgtccagtagctggaaagacaccctccctcttctcaagaaagcaaatcaagatgcaagtgaaccagagatggtcaatgtcctgctaatgcagggctgaagcttcaggtggcttcccacccgtcacctctggaaatcacatctcatctcctacgttcttggggccttcagtgacaataaactaacctgagatgatgggtaaaagtcaagagtgacccctttctttccttatcaataacatgccttttaatagagtccttctggagagaaagctgttcccaaaacccatcatctctttcctgtagtcttttatctacaccttcaggtctcataggtgcttcggatggaagtaaatgcagtctctctttctataaactgtccctgagagaggcaccccaatccctggacttcagatcagtactccccttgggccccatatataatcatcatctcctgataatctcacctcaagtcggcctctgtattcctcttccccattctcactgccgccacccggagtcaggccctccttttcctaagttggtggatgggaaataggctatttaatgaaatgcatgtttctggccatgacattctgctcaaaacctcccaaggaccttgtaaaaccagcttacatcatctccttatgcagccttccctgccccttcctctcagagcagaattgaccctctcccccttgtgtctctgctgtgcttcatgtagactcatctcataccatctgttcctctttactgcagttagccagctgcttcacctctagactagcgggccttgatcatgtcactttttatgtccagtaccttaaaaaatccctgactttcatcagcgtatcaatacctatacttggttctcattatgcatcaaaaacaatccgagcctcttgctctatcattaacagtaaccagcttgtcccttcattagtcccccatacatcccatccactcccagccaggctgagtgtccctcggtgcccctgttagcatgtgtctgggaccacctaaagggtcctggagaaaggcccctaaatggtaacgttcagtacatgatggcagattgtacttaaaatggtagatgttagaatatagttaactggaggttctagagccagaccacctggttcaatctcccttctaccacttactaacttgtgacttgggaaattataccaccttaacctctccgtgccttagtttcttccctggcaaaaaaggtagcaataatagtacctatctcataaaggtttttggaggattagaatgatacagataaagct

SEQ ID NO: 630 - DNA, 10470 bp, Human
  misc_feature (1)...(10470): n = A,T,C or G
ctacgaagccggacctgtagcagtttctttggctgcctgggccccttgagtccagccatcatgcctatccgtgctctgtgcactatctgctccgacttcttcgatcactcccgcgacgtggccgccatccactgcggccacaccttccacttgcagtggtgagtgactgcagtgttggggcccggtgtttgcccgggtaccgcttcagggccttgaggtgttgggcctccaggcggtccaaccccggaatccagacaagtgatgagaaccttcctcctagacgaggccccacgggagcttcccaacctgggcagaagtgggtcaggacaggctttctggtagaggtgatagctgagctaagcctgagggggactaagatggctcagtgaagatagatgcttccttgatcacctatacaaacagatgtgatttcaaaaccgttagcctgggcaagggtgagctttcaccacatcaacaagtccttttatttcttccagatagaaacctgctaggcttctggctacccaagagagtttgctgtgccttacttgatggtttggaattattctacccagagtcatctcactgtccagacaccccaatgtattcgccatgtcagcaaacccgtttaacatggggaaggcaaggagatgctcccctatccaggggtcctgctgaccgtgtagggccattctgttgagtgtacagctagtggggaaagattcccctagcagatgtggacaggccggtttggacctcctagcaaaagagataaggcagcgttacccctgggaatggtgggtgataataatcacagggtcttgtggggctaaaggccctaggaagcagaaaggcaggcatgacactgatggctgctggcttacttgcaaagctttgtttaggcctgtgttgctgacagcctgagccccatgctgagggagccactgctgtttggttagactagaaattaagctcgcctctaagcgtactctattttctgtttgcctactctattttcttctatccttttactttatttatttatttttattttattttatttttgagatggagtctcgctcctgtcgtgtaggctggagtgcagtggcgtgatctcggctcactgcaacctccacctcctgagttcaagtgattctccttcctcagcctcccaagtagctgacattacaggcgtgcgccaccacgcccagctaatttttgtgtttttcatagacagggtttctccatgttggccaggctggtctcgaactcctgacttcaggtgatccacccaccttggcctctcaaagtgctagggcctatccttttactttaaacttttctgtgtccttgtgttttacatgtatcccttgaaacagcatttatttctttttttgtatattaaaaagtactttagcttactgcaaagatctttattttattttattttgagacagggtctcactctgttacacaggctgcagtgcagtggtgccatctcggctcactgcagcctctacctcctgggctaaggtgattctcccatcttagcctcccaagtagctgggactacaggcgcctgccaccatgcttgactatttttttttttttgtatttttagtagagatggggtcttgctatgttgcccaggctggtcttgaacccctggactcaagtaatccacccacctctgcctcccaaagtgctaggattacaggtgtgaaccaccgcacccagccttggaaaacaacatttagttggacttttaaaaatccagtctgataatctttgtatttaactggaccatttagtctacttaaaattgttgcaattactgattaaataaagagtaaacatattgtctttagtcgattctgttttgccttgcctattatatcttattgtctcctttcttgccttggtaggaattggttaaatattctgtatttctccatttttccctcagttagttgggtcgttatataccccatttccatttataagtggttatcctagaaattaaggtatgtatccttaacttaccaatttcaaggttaatcagcacctttctcattttcccaggcaactcaaagagcttagaatactaacattcttttcccacttctacgttattgttgaatattttaattgtgtgtatgtgtggtatttttttcgttggtgttatttttgagacagagtcctgctctcttgcccaagctggtctgcagtggtacaatctctgctcactgcagccttgacctcctggactcaagcgatcctcctgcctcagcctcacaactagctgggactacaggtgcatgtcaccatgcccagctaatttttgttttttgtagagacaggatttcgccatgctgcccaggctggtttgaaactcctgtactcaagtgatccaccctccttggcctgccaaagtgctggggtttacaggcatgagccaccacgaccggccaattgtatgtttttaagtaaagtttttgtttggaataatttttttttttttttgaaacaggatcgtgctgtgtcgcccaggctggagtttataattgtttcttcttgcaggattgaactttttttaaatgttcttctttgtccttctttgtctcttgtaactttaattcaaagtctgtcttgcctaattttttttttgagatggagtctcgttctgtggcccagactggagtgcagtggcgcaatcttggctcactgcaacctctgcctcttgggttcacgtgattctcctacctcagcctcccgagtagctgggattacaggcacacaccactgtgcctggctaattttttttgtatttttagtagaggcagagtttcactatgttggccagactggtctcaaactcctgacctcgtgatccgcccacctcggcctcccaaagtgctgggattacaggcgtgagctaccgtgcgtggcctatcttgtctaatttaaagtccattttatctgctattagtatagccacttcagctgtcttttggtgactgcatggtatatcttttttcatctgttttattttattttattttattattgtttttagagacaaggtctcgctatgttagccaggctggtctcaaactcctggcctaaagcaatcctcctgccttggccttccaaagtgctgggaatacaggtgtgagccaccacactcggcccttatccaacttctagcttccgttgtagctattgaagtcagattttagtttatcagttactcctttaagcatactttggaactttatcctcagactctcattacctttagaattttctctgattttggctttctgcagttttggtatagtgtatccaatatgaatttctttttacctttttcttttcttttttttttttttgagacagagtcttgctctgttgcccaggctggagcacagtgggacaatctcaactcactgcaacctccacctccctggttcaagcaattctcctgcctcagcctcccgagtagctgggactaaaggcacgtgtcatcatgcccggctaaattttgtacttgtagcagagacagggtttcaccatgttggccaggctggtctcgaactcctgacctcaggtgatcttcccaccttggtctcccaaagtgccgggattacagccatgagccattgtgcctggccgaatttctttttacaaattctgctcgggattcattagatttctttaacgtgtagagcaatttctttctttctttcttttttttttgagacggagtctcgctgtgtcacccaggctggagtgcagtggcacgatcttggctcactgcaagctctgcctcccgggttcacgccattctcctgcctcagcctcccgagtagctgggactacaggcgcctgccaccatgcccagctaattttttgtatttttagtagagatggggtttcactgtgttagtcaggatggtcttgatctcctgacctcatgatctgcctgcctcggcctcccaaagtgctgggattacaggcgtgagccaccgcgcctggccgtgtggagcaatttctttaatcagttctggaaaattatcagccattatctcttcatatattgcctctattccattaacttttttatcctgtgttattatttatttttgaggtagagtctcgctctgtcacccaggctggagtgcaatggtccgatctcggctcnnnnnnnnnnnnnnnnnnnnaaaaatttaatttaaaaaaattttatggctgggtatggtggctcatacctgtaatcccagcactttgggaggctgaggcaggtggatcacttgaggtcaggagttcaagaccagcctggccaacatggtgaaaccctgtctctactaaaaacaaaaattagctgggcgtggtcgcgcatgcctgtaatcccagctacctgggaggctgaggtaggagaatcgtttgaaccaaggaggcggagtttgcagtgaaccaagatcgtgccactgcactccagcctgggcgacagagcaagactccacctcaaaaaaaaaaaaaaagttatgagtacatagtaggtatacatatttattgggtttatgagatattttgatgcagggatacactgtaataatcacttcagggtaaacagagtagccatcacctcaagcatttatcatttttttgtgttacaaacattcctattcttttagttactttaaaatgtacagtagattattgttgactgtagtcactctgttgtgctatcaaatactagattttattccttatatctaactttatttttgtacccttacttacttttatttctggttgatccttaccttgaaagtgtagtctttgggattccagcttaaaatgggggtgttatcagagtcctcatctctgagggcccctgagcttcgactatcatctctcccaaccccagtcaaagcccagaatgttgcctaaaggacagcttttggccaagccaacagggccaaaaaaagggccagctggttggagtcctgagtacccatcaggccttgcgggaggtgctgtaactgcctatgctactgtcctcttatttgggcaggcattgggtcaaggaggagcagaacagaccctttcgtggtcagaatgtttgcctggcttatgtccccagacaaaccagggctcatcagtctattgttctgcttttcattccagcctaattcagtggtttgagacagcaccaagtcggacctgcccacagtgccgaatccaggtgagagtattggggtgggaccacctcaactgaagagatctccttagcagagagcaggaatgtgaaaagagctctgaaactgcaatatctctgaccttttttggaccctcctggtttaaggccagttgagcctcacttgtgcccttgagtgtttgggaggtctgcttacacccacaggtagctggcagatggacttgttgcctgggccagttttcacttgggtagatttggctggcctccttccctgtcttttcatcagtgactccgcacctagagttcaggtatcttttgagcacttaaccgtgtaggtctgtagtaatatgacttcagtgaccacgaaaccagcagccccaacttggggtacctgcaggagtaaagaggtcttttgactctaaaggatgtactttgaaaaattaggtctgagaacaggcctgacatgcatgtcaggcaggtagtcagacccatgtacaacactctcctccttgcgcatgacccagctacacaatcatactcttaccttgttctcccatccaggttggcaaaagaaccattatcaataagctcttctttgatcttgcccaggaggaggagaatgtcttggatgcagaattcttaaaggtacccagaatttatctgattctactgaactccaagccttgtgcgagttcacttttcttttttcttttcttttcttttttctcttctcttctcttctcttctcttttctcttttcttttcttttcttttcttttctttttttagagacagggtcttactttgttgcccacactggagtgcagtggtgcaatcatagctcactataacctcaaactcctgagttcaagggatctccccacctcagcctacctagtagctaggactgtaggggtgcaccaccatgctcggttaatttttttattttatttatttatttatttatttatttatttatttatttattttgagatgaagtctcactctgtcacccaggctggagtgtagtggcgtgatcttggctcactgcaacctctgcctcctaggttaaaacaattctcctgcttcagcctcccgagtagctgggactacaggcacgtgccaccatacccggctagttttgtgtttttagtacagacggggtttcaccttgttggccaggctggtctcgaactcctgacctgaagtgatccacccacctcggcctcccaaagtgctgagattgcaggcgtgggccaccgtgcccagccctaatttataaaaaaaaatttttatagagatagggccttgctatgttacccaggctggtcttgaactcttgggctcgagcaatcctcccaccttggcctcccaaagggctgagattacaggcatgagccactgtgcctggcctgggagttcactttctatttccacataagtggagggttcctggaatatggagatgaagttatagaggtgagacttggtacagttttcaaggtggggacacaaaaatcagaggacaactgatgagacacagtcatcagagaaatgcactgtgagggaagaggggagctgcttgactgtaaaccctccctttgggatttcaggtcaattccaacctgaattctctcctgcggtcttgtctcctcatcttttaaagaacctacagccatcctgtacagcctactttgctgcttggacagttagtgacagattagaaaactcttctactccccagccacgggagatttttggattcagtgttccctagcctgcctgtgcctcaaaattgcctggggaggctgggcgtgatggctcacacctgtaatcccagcactttgggtgaccaaggtgggcagatcacttgagcccaggagttcaagaccagcctgagcaacatgggaccccatctctattaaataaaaaaagttaaaagaaaaaaaattgcctagggagcttggtataaagtcagatgcctgggccttccccagaccagagctcttggaatcaagagttgcagctcaggtgggaatggatatattaggggaaagtgggtagtttccctcctatacgtctaactgcttcccctcctaatctaaaatttagctttttttgtgtgcaagcaggctgcgttggcagagaactcttgaggaagttggatttgggttcacaaatgatccctggactctgagggttaatttgctggatatctgtcagatcagagttcatttggctctggccccagggtgtcatgatgtccttggaacctcactgcttcaggaacatggagcttttgtgcttagagcaagcatgttcatcgtcatggtaactgctcccagttttaagtagtgtcttccctgtgatgaaggcaacaaaggcagtttcatttatttccagctttcaaagccaggtttgtgagacaggtagcaacatcttgggtagtttggagcaagggcttggaagcccctgctggagtgtggaagaagtcaggggactatgggtagtggtgcagcagccatgtcctggtatctgttctcaggcagcccttgcgtgctcttccttacccaccacctccactcccagctgttcagcctatgctaaccagcccagccaccagaagctcttgcccccagagtcctaggtggagagtttgacagtaggggcttgtttacccactgggcctgggccatactattggtcacatgtgaaattctgagtcttctgttgatcttagacaagtgatctacagtaaggtttgcctggattccatctagctaccaccatggacccttggtcaagcgtttcagttttgtaaaaccttggatttctttgttatggagcaggcacctctcttgctcatggggatgttgagttctgtggcatcctgaacaggaactgggttcaattctgccacagcttctcaatgattctgtggcatggctgtgaaacatttgcaggggctttgagaggctcacttgatcctcacaatagtctagttagagactagacacatgggaggtttcatccaggggtacaaagctgtcctggcatagctacctccattggatactaggtctggaaggtttgtggtacacagagccagttcagagcttggaggaaagtcgactatgaatcaggaagacccagggtggagaggaggagtagtcgcccaaggtccttggccattcctattgtgtgtccctggtgagtcagctgatgcccagagggaatgagaccaacatagagcgatgaggccaaggaagtgatagaaacttctgctatggagactgatcacaggggccctactttaacttcccttccactattctacctctttacctgtcctggggccttgcccctgagattgttttcctccatcttacctacttttcaaaagggcacatagagctacagcagtgcttatctttccattgttagcttagcttggccttgaggcactgcaggattcatgccctagaaggcctcattgttcaatcctggggctccccacagccttatgggagaccacgtggaggtcagctatgatgctttcctgctgcttattgtgggtattgcctttcagaatgaactggacaatgtcagagcccagctttcccagaaaggtgagttagcaagagacgaggggtgctgggaagcccctgacttggatgctggaggaagggggccctaggaggaaggtttcaaaccgtttgggagagccagggcctttccctgctttgtatgtccaagagtcctgctagctgttgtggtgggcagaaaaagagagggaagggaggtgactgaagctgttcacctagaccaggtgagcctcttgtctctgagtgcagcttcttgcccaggaaccaagatgggagggggttacctgatgggactgaatatcttcgggagagggctcagctgctgagtttggctggaacctgcttgagtcctgggttgatgaactaactggacccatggcaggtagggaatgggcagtaaaatattttcctaagtagttcaagcagcagaaggtgggcttttccctgaatgaaggctctggctcagcttctctggtttggcacatcccagagaaagaagcgggccacccagctttcaggcctgagccttgtttctcacctgcctaagggatgaggcactgaatccaagggcccaagttcttctgctgatggatggacaggcctttccctttcctccgccctctacccctgctccagacaaggagaaacgagacagccaggtcatcatcgacactctgcgggatacgctggaagaacgcaatgctactgtggtatctctgcagcaggccttgggcaaggccgagatgctgtgctccacactgaaagtaggtcctcaggttttatgggtacagaattcatagggaggtattgccccagaactggactccccattctgggcttatcttctggttctgctccagtcatcaccttggtttggggagttgtaaaatagaggcaaatcacttcttccccttgcccttccatactgtacccatccatcccataagaaaagggccatattggctatacttgtgggttttgtactaggtagtttgaagagtcaaggccttcccagtacctcacagaggggatgctcaactaagacctcagtgaggctgggccatatttccgaaagtggttcatactctactgatgaggccagcctgaagaaccttccattagcactctagtccttggctgggctgctctcctgagccagatcaaacagcatcctagggaggagcaagggcctttgaagtcagctgtgctgagctgaccaaccagatcaaagtctgcagagtgaacagccttagacccagatgaattttgcatcagcctgggttggtgagcctcttgctctccaaggggcatgagaggcgattgatctgaacccacgattgatattctggccttgtaggcaggagcagtccttgctggatgccatttgaaagggaaagggagccatccttgtgaacagacaaggccccaggatattcattgtctctgttcctgcttgggggctgggctggatcacatggtctggctggtgggagggagcaaactggcacctggctgcagagcaggagtctctcatggtattctcaggtcagagacaagtggtcttaggctgaaggcagcctggccagcttcccctggctcaattattcattcttggcaactgtccatgggtctgggtgttgg

SEQ ID NO: 631 - DNA, 10318 bp, Human
tcagcaatcagcatgacagcctccagccaagtaatctggagtcatgagagctgctaggggagcaacatgaatcatgacggcccctgggaatttcctgataactaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatctctgactcagtctgtcccctggaaggctggcagctcagcaagcacagaagtctctccagaagacagtgggtcacctgcctcccaaaagctgaaaggctaacttgtactttccccagcaggcagctggcatcctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccagtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccatagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaagtttgagtggatcatttgaggtcaggagttcaagaccagcctggacaacatggtgtaaccctgcctctactaaaaatgcaaaaatcagcctggcatggtggtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagccgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcccctgtccatgcagcccatggccttggggacaagtcgtgctttgaggcctctagggagggaaggaagaagtggcagatttcatgggactaagctgtttgatgggtatcttctcccacagtgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattggtgagggggaaccccgcgactactgtggccataatggcttggggagagtgggacccagggagagactggagctgaggttgaagctgcccggtggggcaggggtggggcgagggaccttgaagcctcgatatacatgacaaagggagtggcagggaagagttccatgaagtctgaggggcctggtgctcctctggagagaccctgaatttccccaacaagtagcctcttgcgagtggaaacagccctgtgggtatatggcttgggctgggaaggccctgtttatatgaattagaaaaagacacaccttcctttgtgggatgcagcctctgtctgtgctaggatatagaacttggagaatggagccttgggatggattccagcctaactacctcagctgggagtttttgcagaaacgacctgtacagctgtatgcagtggctctggccatccaagcctttttcaacacctggaacaaagcccttggggcatggggcaggggaggtttccaggtgataagcgaccagcagacctccctggatgactgacctagggataggcatagctacttcctcggcacttggaggggacagatggggaccgcctaaccagtagtgatctttctcctctgaccctctgtcctcccccagccttgctgaagatccgttccaaggagggcaggtgtgcgcagccatcccggactatacagaccatctgcctgccctcgatgtataacgatccccagtttggcacaagctgtgagatcactggctttggaaaagagaattctagtaagtgacaattgcgactgacttagaaggtcctgaggagtgttttgacctgaaaatgagcccagtgtgatcaagggaagactgcagagttagaggtgggagcactgaggcggtggcagatgggtccagggatggatgaagagtgttgtttagggagcgatgggctgcaaaggtaaatagatggtaggggctataggtggagtaaaggctcagatttgcatggaagagaataagggccttccctggtagagatactttatggttcccctctctggcagactcccagtggacagataaatcttgatgcaaacgcctccctgttttctccacctagccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccaggtgagtgttccaagcatctctctccacctcttccatatctccccagagctcctgggcttgttccagccagcttaagggtgtctctctctagccaaagccctaagtagccagaatcaggagctcaggtctttgagggtttaaaccagtccttatgtgtttgccagacattaccaaaaaaatcccagctctgcgctagtcacttcagactgggggcacgagatcctagaaagaggaaacagtaaaagacaatgtaactcagtgcccagggtgtgttgtgaactataaatgatcaggtgttcaggagagggaggtgagtgccaacctgagggtcagggaggggaggctttaaaggaaatgtgacttgataggcatttgaagaggcagagggaagaaaggaaggtgtttcagttgaaagatacaaaactgagaaggaggctggcatattccgggtggggaggagaactagggtctgggagtgtggatggaatagtggcagatgacagggcttttaaagccaagcaggggattttaaacttgatgtggtagaaaatggggctgcgtcaggcacagtggctcatgcctgtaatcccagcactttgggaggccgaggtggatggatcacttgaggccaggagtttgagaccggcctggccaacatggtgaaaccctgtgtctactaaaaatgcaaaaaaaaattagccaggtgtggtggtgcctgcctgtaatcccagctaatcaggaggctgagacatgggaatcgcttgagcacaggaggcaagtttgcagtgagctgagatcacgtcattgcacgccagcctgggcgacagagcgagattctgtcctccccccgaaaaaaagaaagaaaatgggaagtcgctaaggactttgactgggaaactcttccctctctctggtatggttgggtgatgggatcagaaatcccctcctcacttctctagggctcatcttttgtatctttggcgtcacagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactccttacactgaatatttatatttcactatttttatttatatttttgtaattttaaataaaagtgatcaataaaatgtgatttttctgatgacaaatctccctggtgcttgtatgggaaggagttggagtacataaaaaggagaaaataacaaaggtggactgcaccctagagtttcttatgggactgcatctctggacttaatggagctttgggaggtagaggttaggagagctgtagggcagggccaccacagcacttaatgtatacaaagtttccccaaaccacaatcccatggctgtgtaagtagtgtacaggcttagtgtcagctcccaattgcctccttaacctgatgcctttgtgcagtgcacatcttgtacagctgtacatggtggtcttctttagggttaactccacaacagtctcttcactctgcccccaacaatccttgagctgacctcaaccaagaagaacacctgtggccaggtgtagtggctcatgcctgtaatcctaacattttgagaggctgaggtgggagaatcgcttgagcccaggagtttgagaccagcctgggaaacttagtgagaccctgtctctgcaaaaaataaaaaaattagccaggtgtggtagcacatgtctgtagtcctagctacttgggaggctgaggcaggaggatcataagccaaggagttcaagtttacagtcagctgattgtgccactgcactccagcctaggtgacagagcaagaccctgtctcaaaaaaaaaaaaaaaaaaaaaagaagaagaagacctgtaagtgaaaattgctggccaggctcagtggctcacgcctgtaatccagcactttgggaagccgaggtgtgtggatcacctgaggtcaggagtttgagaccagcctgaccaacatagtgaaaccccatctctactaaaaatacaaaaaaattagccgggtgtgggggtgggtgcctgtaatcccagctactcgggaggctgaggcaggagaatcatttgaacccgggaggcagaggttgcagtgagccgagatcgcaccactgcactccagcctgggcgacagagggaagacttcgcctcaaataaataaaaaaataaagaaagaaagaaaattgcttatccagaatgccagcttgactctgtggcattcaggaaacaaaaaacataatttcccatcatctgtgtgtgggactgatgctggaattttctcagtgtgttaacagagcttgtgaccagccattgctatgcctatgattagggggcccagaatctcaaagctggatgatgtcctaatgggggtgactatatattttgaacaaaacatcaagttctgaaaagctggggtgtagaaggcaggttgggagataattgggtatcaaaaattagaattgccaagctgtgttaatgggttggggcagtgtttcttaatcgagtcatctgaggaccttttaaaatatgcacacctacactccacctgtagagattgtgattcaggtcagggctggctccaggtctcgtggttttagaaaagctccctcggtgttactaacatgcaccactgattgacagcctttggggacaattggtcagaatatatgaagtgcccagaaaaattcaagatatggtcagcatgagttctctgcatgaacagccagttttctgagtggggtttggtggcacaaggtctcctggatttcctggttaaaggctttctggaccgtgcttccctagagggcaagaactccaagtatttggctttttcttttttttgaggcagggtctcactctgtcacccaggctggagtgcagtggcgcaatcttagctcactgcagcttctgcctcccaggttcaagcgattctcctgcctcagcctcccaagtagctgggattacaagcatgcactaccactacccggctcatttttgtgtttttggtagagatggggtttcaccctgttggccaggctggtctcgaactcccgacctcaggtgatctgcctcccttggtctcccaaagtactgggattagtattcggcttttgatccccatcatctagtgtgctgttttacacaggt

SEQ ID NO: 632 - DNA, 25966 bp, Human
cctacgactctcttcctctcctaatctgttccagccacactgacatctcttctgttcctagaatctcatcaggcttccacctcaaggcctttgcactggttgttcctgctccttggaaaggttccctgcccatctgccctacttcttccctcactgcattcagcctctgcttgaatgccacttgctcagggaacccctcctggatcacccacctaaaacagctcacacctcatttgcacccagatacttccttcagcctgctttgttttctccagtttgcttatccctctcagacagtgaaagattagataacacatatctgctccccactgtcaacacaacaaaaggtgggaactttgctttgcttcctgctgtgcccctagctcctggaccagtgcccagcacaaagtaggtccttggtagatgttaaaggaatgtgttgagccctccatttcggccagcagctattccaggcattgcacctacattaaattgctctgtttagttagatgcatcctaagacggggagacaattttatctttagtattttattttacttaaaaaaaaaaaaaacttggccaggtgcagtggctcatgcctgtaatcccagcactttggaaggacaaggcaggtggatcacctgaggtcaggagttcgagaccaccctgaccaacatggtgaaaccccatctctactaaaaatacaaaaattagccgggtgtgctggcgtgcccctgtaatcccagttactcaggaggctgaggcaggagaattgcatgaacccaggaggcggagattgcagtggccgagattgcaccactgcactctagcctgggtgacagagtgagacttcgtctcaataaataaataaataaataataaaaagaaagaaaaaacttattataagccttttcaaacccacagaaaaggagacagaatggcataatatgcccttatatactgattacctttatataattgatacaaccatttggctattttgcctttattttctactcaagtatttatttatttattatttttttgagacagggtctcgctctgttgcccaggttggagtgcagtggtgcaatcatagctcactgcagcttccagttcccaggttcaagcggtcctcccaccttagcctcccaactacctaggactacaagtacgggccactgcacccagctaattttattttatttttaatttcttttggaaagatgagggctctttatgtttcccaagctgatcttgaactcctggccccaagtgatcctcctgccttggcttcccaaagcattggtgttacaggcatgagccacctcatctgacctcttctaaaatattataaaataaatacagacatcaaaatgaaaacaaaagaaaaagaaaaaacaaaacaaaaatccccaaaacaacaacaacaaaaaatgcagacatcaataacattcaccactaaatactctagtaagcatctgcaaaaacaaacaaacaaacaaaaaccagaatcccacctaagcatacagccattgtcgtaacagtgatatctacttttttggctgaagtgtcttttttttttttttttttttttttctgtgagaaggagtcttgttctgttgccaggctggagtgcagtggcacgatctcggctcactgcaacccaacctccgcctcccgggttcaagcgattctcctgcctcagcctcctaagtaacacacacacgccactacgcccggctaatttttgtatttttagtagagacggggtttcaccattaagtgttttaatgtaggtgcaatgcctggaatagctgctggccaaaatggagggctcaacacattcctttaacatttaccaaggacctacttcgtgctgggcactggtccaggagctgggggcacagcaggaagcaaagcaagggttaagtgttttaagtgtttaagagatgcatatttcaggatgcatctctagataaggacattttccaaaataccagtatccctcctgacaaaactaacaaaaatcctgttagccaaataatcagccacattcatatttaccgtcaaagtttttatcctcattttacagcagtggagagcgattgccccgggtcccacgttaggaagagagagaactgggatttgcacccaggcaatctggggacagagctgtgatcacaactccatgagtcagggccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgctgctgctgctccacacctgcgtcccaggtaggggctgggtcccgaacgcctgcgcctggaacagggtctaattgagggggttgggggttgtcagaggatgagttggaggaatgcggttcagtcctcagcatcctccctaatcaaataatagtaattctcgtgctttgtgcaacgccacgcggcgcagtacctggcactcagtagctaaggaaatattagtggagcaaaggcatttagctttacataatttagtgagtgctttttttttttttttttttttttgacagagtctcactctgtcgcccaggctggagtgcagtggcgcgatctcggctcactgcaacctctgccgcccgggttcaagcgattctcctgcctcagcctcctgggtagctgggattacaggcgcctgccatcgcgcccggctaatttctgtatttttagtggagaccgggtttcactctgttagccaggatggtctcaatctcctgacctcagatgatccacctgcctcggcctcccaaactgctgggattacaggcgtgagccaccgcgcccggcccaagtgttctttttttaaatggagttcttcgaagcctcttccttgcaatttcaaactaggcgatgggactttattaatttcgtttcgcagaggaaactagggcacagagaggttagataactggcctaaaatcacacagccagtgcttgaatacgcaggatctgaccctgcagcgccccccagcgctctccacgctgctgggtctccccctctgagaaacggggggacaggacccccttttacaaaaggcccaaagggaggctgactgagcggcgcagagccagtgctggagacccgggactgtccctcaggacctttccctctcactgaggcgactctcacttacttccccggaaaatgtggggggctctgggtcgaggaattcgagaaggaactgagtcagggcgggtggccacagggtgttggggccgcgatgaataacccggaaagcgctcgagaccgcgggaggccgggaatgagtaacagctccgggatactccgaacgcgcagctggaaagggatgtccgggaaggcccggaggtcggggaccgggcctagggactgggctgcaatctcggggcggagcctggggcggggagagagtgtcggggaggagccagagggcggggctggaacctcaaggaagagctacgggagaggttacagaccgaggaagagctaggagcggggctagaacctcgaggcggagccagagggcggggttataacctcgaggcgtaaccagagggcggagttataacctcgggaggagctagaaggtgggactagactcttgaggggcaggattataacctcggggaggagctagagggcggggctggaacctcaaggaggggctaggggcggggttataagcttggggaggagctacggggctgggctaggacctcaaggggccaaggggcgggggttacgacctcggggaggagctacagggtggggctgaaacctcaagaagggactggggcggagttatgacctcaggggaaaactaggggcggggagagctaaagggcgaagttagaatctcaaggaggagctagagggagggactaaagcctcgaggaggagctaggggcggggttatggcatcggggaggagctagggggcgggaagataaggtcaggaagagctaaagggcggggctagaacctcgacgatgagtctggagcggggccaaaacctagttggagagctggagggcggagacagaacttcgcgggaaactagagtatctaacaatagaaactccggagggctgatggggccgggcctagaatttgggaataaattagtgggccgggagaggctctggagccgggtagaaccagggggagtgagtggagggatagttccattagggcactgggagtgacggtataacataaagatcgacgcgggtggggcaaggctagaacgtccccagcagaactggagaggcgtaatcgaccgagggccggtgcggtgagaaggacctaataggagcaggaatagaacgtactgatagagagggcggggatacgactgtcaggatatacgcctcacgaggacagaatgaaaggaaaaacgggccaaggcaggactttgggaaaggacttgtgggcagggatagaacgttcagttagtggggtggaggtagaacgtggacaacggacagactggaagtaccgccggccggaacccagcagaacatggacacgaatctgaatggacggggcctggagacttggtgttggtattgggacatgcaggggtgagcgggggtcttggagctaagcgtagttaacctctcctctcctctccctccttcccccagcctcttggggcctgcggtgcatgcagtgtaagaccaacggggattgccgtgtggaagagtgcgccctgggacaggacctctgcaggaccacgatcgtgcgcttgtgggaaggtgagcttccccccaacccacacacccctccagcgcagcatggaacgcgagtgattgagaaaccttcctcaccagtaactgggacatgcaaactaaaaacaaacaaacaaggagagcccatttcacacccaccagattggcaagcatttaaaaatctgacaatacccgggttagtaaggatgtggagttgcagaccgtgtctgtggtgggggagtaaattggcacatcaaccacttagagcgattcggcaatatctagtccagatgaagattaacatatgctacagctcaactcctcgccatgcagaaatgccaaagaaccttggccacatatacccagggacacatgtatacgaatgttcttagcagcaatgtttgtgacatggaaaattggaaacaggctgggcactggctcacacctgtatttccagcactttgggaggcagaggcggatgaattgcttgaggtcaggagttcaagaccaggctggccaacatggtgaaacacccgtctccacacacacacaaaaaaggaaaaattagccgagtgtggtggcacgcacctgtaatctcagctacttgggaggctgaggcaggagaattgcttgaacctgggaggtggaggttgcagtgagctgagatcatgctactgcactccagcctgggcgacagagcgagatcctgtcaaaaaaatgaacgaaagagagaaaggtgggccgggcatggtggctcacacctgtaatcccagcactttgggaggctgaggcaggtggattacctgaggtcaggagttcaggaccagcctggccaacatggtgaaaccctgtctctactaaaaaatacaaaaattagccgggcttggtggcaggcaccagttatcccagctactcgggaggctgagacaggagaattgtttgaacccaggaggcggaggttgcagtgagctgagattgtgccattgcactccagcctgggcgacaagagcaaaactccatctcaagaaagaaagaaagaaaggaaaggaagagagagagagagaaagagagagaggaagggagggagggacggagagaggcagggagggagggagggaggagggaggaaggaaggggagaaagaaagaaaagaagaaaatggaaacgactttaagtcagtcagcaagtcagcagcagaagagaaacactgtggtaataattacataatggagcgctctactgcagcttaaagaaggaaatagagctgcagataccaatgtggacacatctcagaaacctaaggttgagagggaaaaaaatgttgcagaatatgatacgttttttataagctttaagaacacatgaaacaacagtatatgaagccaagcacagtagctcacatttgtacccctagctactcaggaggctaaggcagaaggattccttgagcccagaagttcgaggttgtggtgagctatgattgccccagctgggacaacagagaccctgtttctaataaataaataaataaaataaagttacatttgaggcatctcagtactgagatcactaagctgagggtgtgggggagggatagatggatccagaaagtcccagttgtagtgctgtcactacaagagcaggagtgggacacagtggctcacacctgtaattccagcactttgggaggccaaggtgggaggatcacttgaggccaggagtttgagatcagcctgggcaacatagtgagatgccatctgtataaaaaatttaaaaattagcagggtgtggtgatgtaagcctgtggttccagctactcgggaggccgaagcaggactgcttgagcctgggaggtcaaggctccagtgagctatgattgcaccactccagcctgggtgacagagcaagaccctgtctcccggaaaaaaaaattaattaattaattaattgaaataaaatagagcaggctccttgttggggtgggggtggaggcaaggttaactctagaaaaagacagagttggactcaaataacagaagaggcctagcagagatcagccctgggagtggatgaccttgagaccaggagtgtcagaggctggttgagctgagaggagcctctggggtaatgaagatcccctccttgcagaaggagaagagctggagctggtggagaaaagctgtacccactcagagaagaccaacaggaccctgagctatcggactggcttgaagatcaccagccttaccgaggttgtgtgtgggttagacttgtgcaaccagggcaactctggtgagtagggcagcccttgccatccccaaccccaagccatccccagctcaacctcatcatcatcccaatcctattcttaactttacatcagctgaaccccaactccatgccttatccaagtcccaaccccaacccaacccatctctagctcagctccatccccaactcattcttgaccccatatccaaccccaactcaacttcacctccaatcctatgcccaacttcatgttaccctaacactgttcccaactcaaacccagccctgttccaagcacagttccaaccccatccccaaatcaaccccatccttatctcagactacccaaatccccaccccaacgacacaattactttcatccttaacccaatccccatcctgcatgtttgtatgtatggttgttatgtataacttgcaactctgcccttaacaagctcacacgcatgcatgagacatagatgagatgtctcagtgatgtttgtccatctgactgggcaggagatggtcctgcccaatccattgggacgggagatggtccaagcaatagatactgaggggccaggattcaagcaaagacttgacgttcttaagggaagtcgaaagaggggaagattaaatgggccgcagtaggctgggagaatcctctgcaatagatggtctctgacttgggcagtgaaaaaacaaatgtgaggaaatgtccataataggctgggtgtggtggctcatgcctgtaatccaagcactttgggagaccaaggcgggagaaccgcttgagcccaagagtttaagaccagcctgggcaacaaccataagcccctttgtcgaatttcatggcttcaggctctgatcattttaagaaaaagacttagaaaaggtcaaattttcctaaattcccacaggagaggaagggtggggaaggaatgggtccatggtgcatggatccatccgtgaaagagattcctctttctggacctggtgaggaaggaaatagggtaaggccagtctagtcatggttggtgacatcagtgagcagagtgctgcgtttgcactgggttttctttgttcttcattcatcctgattctgcctggttttcatccatcctgacctcaaacactaatccgctggtggggccaaatcagatgtttgttttgaggaagtgacgagaggatgtgggcttcccgtctcggtgagatgtgcttaaggaaagcaccaatacttgggtctaagtagtgcattcaatcagagatgatagcgaaaatatttaacaatattggtcagtgctgggacaaactcctggagtccgctgctgggcctggtgttgcccctttccatgatgggtcacagggacatgaagggtcctggggagagagttggcagtggtcagggatccaccaggagcttagagcagcagctatcaattcaggaatctaataactgagatacctatatcatccctttttcttttcttttttctttctttttttttttgtttccttttgtttttgttttttttttttgtttgtttgttcgtttgagatggagtttcactcttcttgcccaggctggagtgcaatgccacgatctcggctctctgcaacctccgcctcctaggctcgagcgattcttctgcctcagcctcccaagtagctgggattacaggcatgcgccaccacgcccagctaattttgtatttttagtagagatgaggtttctccatgttggtcaagctgatcttgaactcctgacctcaggtgatctgcccgcctcagcctcccaaagtgctgggattacagacgtgagccaccgtgcccggcctcatccccatttctaatgccattgtaccctgcttgtggcaacttgcatagttggttaaactgcactcagtacttacatgatgctgggaacacagcagggaccaagacagccttgtgccctgcctgactccatgggactcacagtcctgtgtgtgtgtgtgtgtgtgtgtgtgtgtgtgtgtgtgtgtgtgtgtaggggtgacagacccatccatcaccagacagtgactgattattaggttaatgcaaaagtaattgtggcttttgccattaaaagcaatggcagaaaccacaattacttttgcaccaacctaatagatttgtctgggctatgaagggggaaacacaggcagaggggtcagggctgggatgagggaagagtaggagctgtgggaccctagaggagatacctgactcaggtcagggaaggtttcctaggggaagcaacagctaagctggatcttgaaggatgagtaggaatcagactattaaacagctaatggaggctgggtgcagtggctcacgcctgtaatcccaacactttgggaggcccaggtgggaggattgtttcagaccagcctaggcaacatgactctacaaaaaaattaaaaaattagccagatgtgatggtacatgcctgtgatcccagctccttgggaggttgaggcgggaggatcactatagcccaggtggtggaggctgcagtaagctatgatcgcaccactgtaccccagcctgggtgacagagcgagatcctgtaaaaaaaaaaaaaacagtggaaagggttttccagcagagggagcagcagatacaaaggtggccaaaagcagtgtggctggacaaaggaaacagtacagtggggcgagatgagctggaaagcttggcaggggcatgttacacaggggtttctagacattgtcctgggagcactggggcatcacagaagattttaaacagcgaatgtcatgatcgcaattatttatttatttatttttgagatggagtttcgctctttttgcccaggctggagtgcaatggtgcgatctcagctcactgcaacctccgcctcctaggttcaagtgattctcctgcctcagcctcccaagaaactgagattacaggcacccgccaccatgcccggctaatttttttgaatttttagtagagatggggtttcaccatgttggccaggctggtctcgaactcttgacctcgtgatccgcccacctcggcctcccaaagtgctgggattacagacgtgagccaccgcgcccggcccccatttatatttttaacaaattattctgacctcaggacagaagatagactgaaaggaagcaagagtagatgaggggaaaccaacttgggggtgggcgaggttgtccaggtggagaagagggcagcaggactagggtgtcaggtgtgcagaggaagaaaagtggatagatttaagagctattcaggctaggcacagtggctcacgcctgtaatcccagcactttggaaggccaaggcaggaggactgcttgatcccaggagttggaggctgcagtgatcacgccactgcactccagcctaggcggcagagcaaaaccctgtctcaaccaaagccgaacaagagctattaagaagcaggccttagtggtggattagatgtgggaggggacctgcaattctggtcatgatggagtcacttgtatcagaccaacccttctgccaatgacagttgcaaatgctggacaaataataaacaattattggaagtcactggagagcagcaaatgaaaggagaaacttggctgggcaaagtggttcatgcctgtaatcccagcactttgggaggccaagacaggtgaattgcttgagctcatgagttcaagaccagcctgggcaacatggcgaaaccccgtctctactaaaaatacaaaagttagccaggcgtggtggcacatgcctgtggtcccagctacttgggtggctgaggcacaagaattgcttgaacccgggaggtagaggttacagtgagccaagatcacacgactgcactccagcctgggcgacagcgcgagactccatttcaaaaaaaaaaaaagaaaaaagaaagaaaggagaaacttgaggcgctacaatctctgaaataacagaagtgtagaatttgggttccacagacaacctggctttttcccggagtgcacttgccaatctgctgctgtggaagggaaatagagcccagacggaaagagagtcgctagactgagaagacggaggttggagtttggggctgccagaatgtctggaagatgagagttaaaatcctggaatggatgggaccacagaaaagggagttcccaacctgcaaacaaatctccctcaagtcattggcaagctctacatgcacagggtgagagtccaagaaacttggaagagaaaaatagcaactgggaagctacaaaagcgaacaaggcttccagcagacatgtgatgctggggacacaggttgccaagctgaagaggccttggtaagcatctcaggctttccccctaagaccaccctaggggtaagggccaaagtgaaataggccagccctaaacaagcctaggtccagtccttgacaggaatgaaaacctgactctctgtggaagaagaaaacatcgtttaggcccttgacagatttttatctagaatgtctggcgtctgatcaaaatttacaagatagctaggcatggtggcatgcgtctgtagtcccaactacttggaaggatttcttgagcctgagagttctgggctgtagtgtgctatatcaaccgggtgtctgcactaagtttggcatcaatatggtgatctcccaggagcaggggaccaccaggttgtctaaggaggggttgaagcagcccaggtcagaaatggagcaggtcaaaactcctgtgatgatcagtagcaggattatgcctatgaatagccactgcacaccagcctggacaacatagcaagaccccatctttaaaaaaaaaaaaaaccaggccgggcatggtggctcaagcctgtaatcccagcactttgggaggccgaggtgggaggattacgaggtcaggagttcatgaccacactggccaacatggtgaaaccccttctctactaaagatacaaaaaaaaaaaaaattagccgggtatggtggcacacacctgtaataccagctacttgggagactgaggcaggagaattgcttgaaccagggaggtggaggttgcagtgagccgagatcacaccattgcactccagcctgagcgagagggcaagactctgtctcaaaacaaaacaaaacaaaacaaaacaaaacgcaagactctgtctcaaaacaaaacaaaacaaaaaacaaaaaataaaaaacagtaacaaaaaaccttacaaggtatcctgaagaaaataaaagggaccaattgaccagaaaccaagagaaaaatccaactgtagaaacagaattgtagcaactcagatattggattataggacaggaaacatgaaaattgctacaatcgatatattcaggaaaacagaagaaaggatatgttttagcacctggaatccattttttaaaagagtccaacagaaaatatagaacagtgactcaaatgaagaactcggcagttaggcttgatagaggtcagaaacagcagagcaaaaggattaaagagctagaagacagaacagtagaagcatgtcggttgatgcacagatgtggaagataagggggtctgccaggtttctgccccggggactggatggggccgccttggacgcgtggacttcaagaaaaagagcagttgtgggagaagatggggagttttgtttaggacaggtgttagaggtatagccatggggcctcgaagagacagttgggtgtctggagctcagagagaagtctagactagagagagatttgtgagtgatgagcagatagatggaaatgaagtcatgtcaatatttaccccatgagagagtctatactgtgagagataaaaagggcttaaaacagagccctggccaggtgcggtactcacgtctgtaatcccagcactttaggaggccgaagcggcaggatcatttgagtccaggagttcgagactagcctgggtaacatagcaagaccttgtctctacaaaaatacaggaatcagccaggtgaactggcacatgcctgtagtctcagctactcagtaggctgagatgggagaatcacctgagctcagggaggtcgaggtggcagtgagccactgcactccagccttgggacagagcaagaccctatctcaaaaaaaaaaaaaaaaaaaaaagaaaagaaaagaaaaaggaaaatagccctaaggatcattggcatttacaagagttcacaccagagacccatgagtgaccacccagagtgggcagaactagaaatggggaattcaaggggcagtgggagctcagagcaggtacccgttccaggctgatgggtcagggagggcttcctagaggaggtgaaattgaagatgacagctgaagaatgaataggagttagagaaagtagggctcaaggaaaaggtgttctaggtgtgaacagctatgttggcaatggtgagaatttgtgttttcattttcatggaagtttgtgtgagaagacgtgggtggccttgtagttatttttctttgagggggacgactgggctttggatgtaaatgattcgcctaattacagctagcggcctgccagttgagaaccttggctgacatggtcctctcacttttttaagacttggcctggactcagcttagatgtgtcttgggtcaggacggggagggcatgccaagcatgggaaatggtgtgagccaagggctgggtagaggaatgactctggtgtttccagggaaaagtaacggatccagttggccaacaccacaaggttcgtgcaaaaggcgaagtgatcaggaatcagtcaagtgagtctttgatccctgggacaattaggtagtgtattatctattgcttatctattatctattgctgcattacagattgcagcaataaaataagcatgtgttatttcacaaagtttctgaaggtcaaaaaccctggagtggcttagctaggtggttctggctcaggatccttcatgagcctgcagtcgagatgtcagctggggctgcagtcatctgaaggctcctaaggtagcttcactcacatgaatgctcccctcccatggctttggcacaggcctcagttctgccacgtgaactttcccatggtgctacttgagtgtcctcacaacatggctgctgcttgccccagaaaaagtgatccaagtgagagagccaggcatgtgttctatgatctagccacagaaggcatacaccatcatttccataatatccagttgactacatagggcatccttattcttttcttcttcttttttttttttaatttaaagacagagtcttgctatgttgcccagactagtctcaaactcccagactcaagcaatcctcccacctcggcctcccaaaatgctgggattacaggcatgagctgctgcacccagccagccctattctttaagggcatgaataccagggagcagagattattgggggccattttggagacaggctaccacagggaacaatagaagggttttaagtaattgctcattcattcattcatttaacaaatatgcattgaatatcttatctgtccctggccatgtgccaggtggtgttgggacacagtagtgatcaagacagcccctggccctgccctcctgggggctcacagtccagtagaggagacatacctgtcaccagacagtgaccacccagagtgggatgggggagtacaggggtgtgtgggagcctggtggatcaggaagggcttcctagaggaggtgaaattagagctgacacctgaagaatgagtaggagttagggaaggcagagagcaaaggaaaggtgttctagacagaaacaacggcatatgcaaaggcctggatgccagggaacatgtgtcgtcgcagactgtgggaagtcagtgtggagcagagtctcagggtgtagtggagggagacgaggcaggagaggtgctcaggccccagtatttgataggctttgaatcccatgctgaggatcttggaatttattttcagggcagtagggagctatggaagagtcttgagcagaggagagacagggtcagatatgagtattagaaatatccttctaagggcccgagtgcagtggctcatgcctgtaatcccagcactttgggaggccaaggcatgtagatcacttgaggttaggagttcgagaccagcctggccaacatggtgaaaccctgtctctactaaaaatacaaaaattagcccagcgtgatggtgcacgcctgtagtcccagctattcgggaggctgaggcaggagaatcacttgaacccggggagtggaggttgcagtgagccaagatggtgccactgcgttccagcctgggtgacggagtgagactctgtctcgggaaaaaaaaaaaaaaaaaggaaagaaatgtttctagggccatgtggagatgctgcactggggtgagtagggggtgacaagaatggaaacccagaggctagggaggtagctggagttgaaggaggtctgagctggactggtccatggggctggaaaggagggggtggattctagaaagattcagcaggcagaataggcagggctcaatgactggctgcagggtgggataaggaggaattgattttgagtgagtccttgcagagctggggctccaggactgtccccatggagtctcactcccctccccctcttccaaacaggccgggctgtcacctattcccgaagccgttacctcgaatgcatttcctgtggctcatcagacatgagctgtgagaggggccggcaccagagcctgcagtgccgcagccctgaagaacagtgcctggatgtggtgacccactggatccaggaaggtgaagaaggtgagccccaacctgctggcaactcctcctccctgctctgctcctccctaagactgcacttaacaaacaaccccaaagtaacagggatgtcagcaagggactaagttctctcatacacaagaggtccagtgataggaagtccagggccacaaggacaggtccagagtcaccaggaacccagatgccttctcatttctttttatttatttatttatttattttttgagacagagtcttgctctctgtcacccaggctggagtgcaatggcatgatcttggctggctgcaacctccgcctcccaggttcaagtgattctcctgcctcagcctcctgaatagctgggattacaggtgtgcatcaccacgccttgctaatttttgtatttttagtagagatggggtttcaccatgttggtcaggctggtctcaaactcctgaccttgtgatccacccgcctcaacctcccaaagtgctgggattacaagcgtgagccaccacgcccggccaccctcttgtttcttacacattacttccattctcaaaatgcctcatagtctaaaatggctgccagagctccgggtctcacatctaagttccaggaaggaggaagaaggaaagaagggacaaaaaagggggcactcctccttttgtaagggttctcctttctggaagtcccataaagcacttctatttatatcacattagtccgaacttcatcacatgactacctggagaggctggaatatgtagttttcgacaagatctatgactgttctagataaaatgagggtcttatgatgaagggtgaagtagagaatggttgaatgcctgctatttcgggcaaatcccatcttagtccctcattcacaatctgacatctgacctctgtcccctggcccccatagggcgtccaaaggatgaccgccacctccgtggctgtggctaccttcccggctgcccgggctccaatggtttccacaacaacgacaccttccacttcctgaaatgctgcaacaccaccaaatgcaacgagggcccaagtaaggaacgggagacacaggcaaggcctggggtcgggcaggggcatgcactcaggcagacagctgcgcagtcactctctggcaatcaagtcctctctgggcctctgtttgcttttctgaaaaatgggagtatcaggcctttttttttttttttttttttttgagacggagtctcactctgttgcccaggctggagtgcaatggcgtgatctccgctcactgtaaacttcgcctcacgagttcaagcgattctcctgcttcagcctcctgagtagctgggattacaggtgcccaccatcacccctggctaatttttctatttttagtagagatgggggtttcaccatgttggccaggctggtctcgaactcctgacctcaagtgatctgtctgcctcagcctcacaaagtgctggggtaacaggcatgagccactgcacccagccaggcctttcttcaaagaagaacttcgtaaggattcaatgatactatcagccctcgccaagacctgtgcttcctgtctcttttgtctctctcaaattttcccactcctcccctgctccactgccaccacctgggctgagccacgctgacttcttgcccaggttgttgcaatgacctcctctctggtctccctgcttccactcctgccaccctacagccaaggctcaacccagcagcgagtgattttttggggggtatgggggggacagggtctcgctctgtcacccaggctggagtgcactggcatgatcatggctcactgcagcctcaaactcctgggctcaggaattcttcccacctaagctactggagtagctgcgactacaggtgcatgccaccgtacccagctaattttgtatttttggtagagatggggtcttgctttgttgcccaggctggtcttgaactcctgggcttggcctcccaaagtgttaggattacaggcatgagccaccatgcaccaccaattttttattttttaatgtaaatcagatcatgtcaccctcctttctcaggcacttcaatgacttccccttcctcttagaataagatccaaagaccttattctgttggcctatgtaatctggcacctgtctgcctcacagtctttgtttagattcgtttttggggttttgtgttttctttagacatagggtcttgctctgccacccaggctggggtgcagtggcacaatcacggctcactgccacctcaaactcctgggctccagtgatcctcccacctcagcttcccaagtagctgggactacagatgcgcatcattgcacccagctacattttttttttttttctgagatggagtcttgcgctgttgcccaggctggagtgcagtggcgcgatcttggctcactgcaagctccgcctcccgggttcacgccattcccctgcctcagcctcccgagtggctgggactacaggcacccaccaccatgcctggctaatttttgtatttttagtagagacagggtttcactgtgttagccaggatgatctcgatctcctgacctcatgatccgcctgactcagcctcccaaagtgctgggattacaggcgtgagccaccacgcccggccgcacccagctaaatttttaaaacttttgtagagatggggtctcactatgttgccggggctggtatcaaactcccaggctcaagcaatccttctgccttgacctcccaaagtgctgggattacaggcatgagccgctgcacctggccttcatttagtttctttctttcttcctttctttctttttttagatggagtctcgctctgtcagccaggctggagggcagtggcgtgatcttggctcactgcaacctccgcctcccaggttcaagcgattctcctgcctcggcctcccaaagtgctgggattacaggcatgagccgctgtgctgacgttcatttggtttctataatcaccaaagcccatctggtctcatggcccttgcagatgaatatcctcccttagaacacatcttccccaagagttcaccctgctggcaacttctcatccattaggcctcagctttaatgtatcatcttcagggatgctttcactgtccctcccctccagtgtaatctagatccctgtctctattacccagcactgtcaacagatagaaatgttccctatctgtcctgtccaatattacagccaccactgtatgtggtcagtgagcacttgaaatgtgaactgaattttaagattcgatttaatattaatttatttaaatgtaaacaaccacatgtggccagtggctaccagattgggtagtgtagctctaaattgtaaattctggctgggcacagtggctcacacctgtaatcccagcacttttggaggcggaggcgggagggtcgcctgaggccaggagtttgagacaagcctaggcaacatagcaagactccgtctcaaaaaaaattttttagtaataataatagtaataacttgtaagttctggccaggtacagtggctcacacctgtactccgagaacattgggaggctgaggcaggcagattgcttgatcccaggagtttgagaccagcctgagtaatgtgtcaaaaccccatctctacaaaaaacagaaaaattggctaggcatggtggtgcacgcctgtagtcccagctactcaggaggctgatgtggaagaatctcttgagccggggtggtcgaggctgcagtgagctacaattgcgccactgcactccagcctgggcaacaaactgagaccctgtatcaaaaataaataaataagttgtaacttttgtgagagcaaggacagtttcatcttacatagttttacccagcacccagcacggtgcctggccagaaatgggactcatggggagttgaaagttggggtttctctcaagccctcgaaaaccatccccctccaaatgccattcagacgcctgaccacaaggtggctccatgacatctctggctcggagtggaagtcctggggaggtcattcaaggaagtggagatccaagcactaattttcttggtctctgtgtctctggtcttctcctaagtcctggagcttgaaaatctgccgcagaatggccgccagtgttacagctgcaaggggaacagcacccatggatgctcctctgaagagactttcctcattgactgccgaggccccatgaatcaatgtctggtagccaccggcactcacggtgaggccctctccgaggctgggagggaacacttattgggggtggagagttccgcaagagattgacttccagttaagctggagttaactgtggtgggtctccctgtggaaaaggtgggatttccttcaggtgggtgaatattattgtaaggaattaggacttgtccatcaggatgtggacatttttgccatggaaaagtggaattccggctgggtgcggtggctgaagcttgtactctcagcactttgggaggctgaggccggaggatctcttgaggccaggagtttgagaccagcctgggcaacatagcaagacccccatctctacaaaaagaaaaatggaattctttggtggatttctcgtgggttgtggggatttgctgaagacatcttgggctttcatcctgtggtgtcctggaaaggtctctgtattccagtggttctcaaactttttggtctcaacttcttcatgcttttaaaaattatttttggccaggtgtggtggctcacgcctgtaattgcaacaccttgggagggtgaggaggagaaccacttgaggtcaggagtatgagagcaagcctggccaccatggtgaaaccctgtctctacaaaaaattacaaaaattagctgggtgtggtggcgtgcacctataaccccagctactcagggggctgaggcacgagaatcacttgaacccaggaggaggaggttgcagtgagtggggatcaccccactgcactccagcctggatgacagagggagactttgtctcaaaaaaaaaaaaaaactctttattgtttatatcagtgatttctatagataaatgccacattaaaattaaaactgagaaccaggagtggtggctcacgcctgtaatcctagcactttgggaggccgaggtgggtagatcacctgaggtcgggagttcaagaccagcctgaccaacatggtgaaaccccatctctactaaaaatacaaattagtcgggcatggtggcacatgcctataatcccagctactcgggaggctgaggcaggagaatcacttgaacctgggaggcagaggttgcggtgagccaagattgtgccattgcactccagcctgggcaacaagagtgaaactccgtcccaaaaaataaaataaaataaaattaaattaaaattaaaactgagaaatcttttttttttttttttgaaatggagtcttgctctgtcgccaggctagagtgcagtggcatggtctcagctcactgcaacctccccctcctgggttcaagcaatcctcctgcctcagcttcctgcatagctgggattacaggcatgagccaccatgcccagcttatttttgtaattttagtagagacggggtttcaccatgttggccaggatggtctcgatctcctgacctcatgatctgcctgcctcggcctcccaaagtgctgggattacagatgtgagccaccgtgcccagccaaaactgagaaatctttaaagatttatttatgaattcatcttataacaataaaaactcattacacattaagataaataacattttaatgaaaaataagtatagtttccaaagaaaaaatgtaatgatagccaggcatggtggctcatgcctataatcccaatactttgggaggccaaggtgggcgggtcacttaagcctagggatttgagaccagcctgggcaacatagcaagatcctgtctctacagaaaatacaaaagttagctgggcatggtggtgcatgcctgtagtcccagctgcttgggaggctgaggtgggagggtcacttgagcctgggaggtggaggttgcagtgaacggagattgcaccactgcactgcggcctgggcaacagagcgagaccctgtcttaaaaaaacaaacaaagaaacaacaaaaaaaaaaccagccaggcgcggtggctcacgcctgtaataccagcactttgggaggccaaggcgggcagatcacaaggtcaggagttcgagaccagcctggccaatatggtgaaaccccgtctctactagaaatacaaaaattagctgggcatggtggtcgcgcctgtagtcccagctacttgggaggctgaggcagaagaattgcttgaacccgggaggcagaggttgcagtgagccgagatcgtgccactgcactccagcctgggtgacagagtgagactccatctcaaaaaaaaaaacaaaaaaaaagcgtaatgagaaaactggcattattttgctgtgttgcacatctctttaatgtccagcttaatagaagacagctgggtcctcatggaagcttctgctttcagtctcttgcaatatcacatgtcctggagtttttggaaaagcccattgtacacttatgagagtgaaaaagccatgtgaaatcacagatctcctgaaagggtctctggggtccctgagccacactttaagaaccgctgctcgcttcctttctttctttttttttctttccttttctttctctgtctctctttccctttctttctttctttcttccttccttcctcccttccttccttctttcccttctccttccttccttcctccctctctctctctttctttcttttctttcccttcttcccttcctcccttccttcttccctccctccctccctcccttccttcctttctttctttttatttgttttttgaaacagggtctcactctgttacccaggctggagtgcagtggcgtgatcataactcaccacagcctccatctcctgagctcaagtgatcctctcatctcagcctcccaagtagctgggactacagctgtttttttcttttttatgtttgtagaaacagagttttgctatgttgtccaggctggtctggaactcctgggctcaagctatcctctctccttggcttcccaaggtgttgagattacaggcatgagccaccacacctggccctgagaactgctgctttctctaggtggtagtgaaggtggcacccactgcaaggtggcaggtcacctactggagaattccagtcctgggcccaggagctggaagtctcactccgtcttctctttcctcagaaccgaaaaaccaaagctatatggtaagaggctgtgcaaccgcctcaatgtgccaacatgcccacctgggtgacgccttcagcatgaaccacattgatgtctcctgctgtactaaaagtggctgtaaccacccagacctggatgtccagtaccgcagtggggctgctcctcagcctggccctgcccatctcagcctcaccatcaccctgctaatgactgccagactgtggggaggcactctcctctggacctaaacctgaaatccccctctctgccctggctggatccgggggacccctttgcccttccctcggctcccagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccagtggacaaggccaggtatgcccttctttgtagtgtctatctttgggaggataaatggtgggggacaccttttcacaggctcctggaatcaggggtcatgtttgaggcccctgcctaggttggaagtcctcctgggggctgcctccacatctatttctggactccaaatgctgacagagcaggagcactgccatcttgaacaaacaccaccattcttagttcctcttgattaaaaatcggctaaatccggacgtggtggcgggtgcctgtagtcccagctattcgggaggctgaggcaggagaatggcgtcaatccgggaggtggagcttgcagtgagccgagattgcaccactgcactccagcctgggtgacagagcaagactctgtctcaaaaaaaaatcagctaaatccagccccaaaacatcagcctaatggctaccatcagcataaccagaaacattccaaccctaagataaacccctctctgaccagaaacatgccaacccccagatagcctcccttccgaccagagactttccaaccccacaataaacttttcctcacatgaaaacattccgaacctagataagcacccccttccaaaactcttaaatatccttagtctgtaaaaaaaaaaaaaaaaaagggctctctaacctaactcagccaaaagcccccctcaggttggttttctctaaaataaacctgtccttcaccgtcaagccacatttcatgtttctttccttttcctttttcttttcttttcttttctttttttgagatggagtttcactcttgttgcccaggctggagtgcaatgacacaatctcagctcaccacaacctccacctcctagttcaagggattctcctgcctcagcctcccaagtagctgggattacaggcatgcaccaccacacccggctaattttgtatttttagtagagacagggtttctccatgttgttcaggctggtctcaaactcccaacctcaggtgatctgcccaccttggcctcccaaagtgctaggattacaggcatgagccaccgtgcctggcctcctctttctttaattcttacaaatgcaagcttccagatcacacactgaacactaaccttctagtcttctcctaaacttcaaaggttgcaactattttgttgttctaaggagacatccccacatttcccagcatgctttgggaaaggagacggatagaagataacctgatggccagaactccctgcatgcactgcagtgaggaataaggacaggagtgcacttcccctgatgtgctggggaccggggataaaggctgggctctatttcccgggatgcctcaggactgtcagaaaaagagacagaactaccatttcaatggcactctaggagcacaatattgaaaaattcatgttcttctcatcatttgctaaggcaacccatggagacaaaaattacattccccatcaaatcttgtggctaatgaagaaaaaataagatatcttcggctggctgtggtggttcacgcctgtaatcccagcactttgggaggccgaggtgggcagatcacttgaggcaggagtttgagaccagcctggccaatttggcaaaaccccgtctctactaaaattacaaaaattaaccgggtaaggtggtgggtgcctgtaactccagctactcggaaggctgaggcaggagaatcgcttgaacccaggaggaggaggttgtagtgagccaagatcacaccactgcatgacacagtgagactatccccaaaaaaaaaaaaaaaaaaaaaaagacatcttccatggtatttgggggcaggtgagggacaaggttcttgtttagggctttctctaatgacatatcaccacctgtcactgtagtggcttaaagaagtgaggtctgtacttctgcctcttgaatatgagtgactctgtgactgctttgaccagtagaatgtggtggaagttttgctgtgctatgttctggaaccaagttttaag

SEQ ID NO: 633 - DNA, 72347 bp, Human
gctgaaagcactaagctggtgctctccaagccttggtatcctcacctgtaaagttagaactggaatcagaatcgatgtttctcagtggaagtgctgttggcattcaggggtggaggggtggatgtcagtggatgtgctctgggcatttgggcatggaggtgggaatgctcggtagaatggttagcaaatccggccctacccattaaataccagtaatgactcccagtcaaataaggtgaggagggcagtaccatctccagataaggaccacgggccttgttttcttagatttcttcccaatctgaaattctgtaagtctatggttgttttgttcctggacccagtaaaaacatgcagaacagaattaccgaagatctgacaaattatcagaatcttgagtacatcttattcaaatgtaagggaatgtttaactaaacagcaacaataggtaacatctgttaagcaattactatgttctagacccttggcaaatttccttcattagaagtctttacaggcgatctgattgtttactatttcagatcatctgtgtcccctaatttgcccccttaatttcagagcattgagttgactatcgtttttgcttcatttatctttgcagagttgtgcgaagttcagatagcaaagtgtctctataggaggccctgcgatatgagaataaagcagcagtctgccaagttcatgcctttgtgttggatacagtcttctttctttgtgtgtctgtggtctttatgaacttagaaaacctgccagtctcttagacgctatgatattaccttacttcagagatctgaatttacatgtctagttttgcagggtttttcctccccacttagttcctatacctgtaatttgagtcaacagccaccagagggcagggacagtgaagtttagatttgacccattgctttgaagagcgaggtcacattgtcagaaagaatacagctcaccatgccagttttgatatagcactgggaactctgcaccctggtttctgggcaaagagagtccttttattataggtggcaacattatttccttgtaatttggtacatgggcttcttcaacttacgtggaaagcaagagatacaaatgtcattacatcttagtccctgtgaaagcctcttaaaatgttcaaagacatttgtaaaagaaggaagaaaaggaacccaagtgcaaaaacacgagtatcgatcctttgttttctgtctgcaactcattgctttctactctcacccttcctagctagcgctgatgtgtgtgtttggagagcataaaacaaattaattttccgaaggtcagaagggataattctccaccgtaatttgcacatgttaaacttgggggagcaggcactgacataagaggcacagcatctgatggtcttatcaaatcaatccatcttctgtctcttccaggggagtgctacgcacagcaggagggtggctgggcagtgcaaagccccggaatcccctgagcaagcagtgtttcagctggctggacagatcaaataacacttgggctggttaacaaaagacgcaagtgggaaggtgttggaagccggagtgtggaaatttacccaacgttatttctttgacagggaaggagacttggtctgaaagatgccacattcctgcagcctctcttggtgcagtggaatacagtcttgggcgaggtggcgtggatgagctggtgaaagaggatgctgcccacatccaaaggctccagaggatcctggcctggcagctgagctcccctgcatttggaacctcaggcgtaacttggtgtagagctcatgaaaggtgcttgtgtttctccagcttttttcaccagtgcttaccagactggctcaggttttggaatctaaggtgagctggtagaaacaggagaggtagaaagaagcccctggatgcctccagaattcattgatgggatccctgcatactgcttggaacacagaaagaggctgtgacacagctgagctttggagcatcttaaggagctcagctcagcaaacaactcttgcatttcagccagaaagagcctcttgtaacaaagtattcaaaggggagagtttctgcatcttttactttgcagtccactatggtagaaaacttgacattccatagataatgatactgggttttctttccaagatgccagctttaaaagaaatatgagccattctaagctttaagaagggttcaggaaacacaggaattagtagacagccctcccaatgcaggttaagacgacagcctgcgcccccaactagcacagctcagcgagcatgaccatatgccattctcgtctccagagagctggtggcagtgacctcactaggagaaaacacatccctcagccgtgggacttgacagaatgaggtgcgcgagggaggccgctagccgagacgtggcctttcctgactgcccctgtgttacctgggcagctccagatcactgagcccacaatggctgagaagggtgactgcatcgccagtgtctatgggtatgacctcggtgggcgctttgttgacttccaacccctgggcttcggtgtcaatggtttggtgctgtcggccgtggacagccgggcctgccggaaggtcgctgtgaagaagattgccctgagcgatgcccgcagcatgaagcacgcgctccgagagatcaagatcattcggcgcctggaccacgacaacatcgtcaaagtgtacgaggtgctcggtcccaagggcactgacctgcagggtgagctgttcaagttcagcgtggcgtacatcgtccaggagtacatggagaccgacctggcacgcctgctggagcagggcacgctggcagaagagcatgccaagctgttcatgtaccagctgctccgcgggctcaagtacatccactccgccaacgtgctgcacagggacctgaagcccgccaacatcttcatcagcacagaggacctcgtgctcaagattggggatttcgggttggcaaggatcgttgatcagcattactcccacaaggtatgtctggctggaatggcggatactggtggtccacagaatccccaagaatacttgcagcattcccaagctattcctagctccatggtagtcagaggactagagttagtaattaggggaggctggagggtgctaggaagatcactagcctgaaaagttgttggaggcgtggagggagatctggttcttggtcttggctctgctatgtggctttgatcaccctgagctgtgcctgcagaagctggactagacgatctccaaaatttcttccagctctaaattctatggcttgaaaactatgtggttggtgaatttgcctctagcatcttcttatccctgctgtccacttagccatcccatgtccttcctgtgtgctcaggacacaccctgaggcttcccaccctgtgagcctcatgctctggttggtctcacctccctcatcccatccaagctgacccattcggtgtccatttctctcagtcagtggacagcaggcacaaattgttgatctgatgagctaatccttcactgtaccttatccagctaatgactctgttctcctgggtcccgtgatgctcttgcttctcagtgtgatgtgaaagccatgggtggcagacggtactattgcgattccccgtggtgggtgctaaatgctccaccaactgcagggatcagagctgacccggccactctgctggagacaaatgtcacactgagttgttctcaagggcccagacctcctcttacctgatccattcctctcttcagaagctgggagtcctctgacattcccttccttcccctgccccgggttcctgccactttaggggtgcctctgagcccctcagcatgagcatgttgccatgtaccctgcaacagagctgggggctggctgtggcttccagcctgctgcccaaaccttgatgctacaaaaaatgttattagaataaaacatctccttgggattaggtgtacagtagtctgttatcatccaaggggctggggtgggtcatgaaaggggagggtggttttgaccttgaacatgctttggctgtctccctgagccccattcctctgccctcctttagcacccccacatagaagggcactgatctgccctctacagctgcagtgcagggcatcacagggggcagggagcagggctccctgtcctaccctccctggctggaacttgggctccagcccaggtttcagaccccaaatcagcccagctggctctggctccttggtgccacaaattacttagtgaccttaaccatgagcctgccctctgccccactcctgcagccaagccatctgtcaaaactgacagccaactctgtaggaaggaatgtccatgggctggggcctggggaggcagggagaaacagtgcccttgtatctctttctaattccttgaactgcttcttttttctctttcttctaaggagcaatgactccaaaccaccaaaccaagggttttaatccaaatctgttcttacttggtaaaaaacctagaaaatccacaagactcttatatgtgggatgcacaaaaactaccttctgaattggaataaaccggtacatttgagtatcatatgatgaaagaacctgattaagtgagctgcaacaaggaaagagcttaagacagcacatagtagggctttaggaaggtccaggaagatggtttattgtggcgtaaactggctatcgcaataattctttgggggtgacatggtgtgagcaaaggaccctttaggaggagtcagaggtctgggttccttctaacagtgctagcttggatgtagatagtcacttaccccctgggagcctcagtttcccctctttgacagggataataattgtgctctgtctgctcctctggcttatggttaagaatcaaaatgatccatgaatgtaaaattccttggaaagcagtcaggactgcatccattcatttaatggatatttgctgagccaacatcaaacccaagctcagtgctgggagctggagagaccaaggctcacacgatcccccagcaaccctgagggctgggcttagtgttatcctgtcacttgggactggaagccacttccctggttgagactttcattttcccaatgtagaggaattttgatgttctgacttgctcttatcgggttctctttaataaaattcgctgtgggaggttaaagaaatcactggaggcagttatgagcccagtaggtgctcacatcatccctgcaaccccgtgtttggcagatgccacccacccctaccccacctcctccctcatacactttctgcttttagctttctgccctctcttcccacagtgatgatgaaaggctttatatttggtgcttttatttatccaatgtgcatttaaatcagttctcgtttaatccccataatgctgtgaagcacttagggcaaatggttcattttaaaacagagagaaacggctttctcaagcttacacagctgatatggccaaaggacacaggatctgaggcctcttcctctcctgatggagggtctctctgagcgctgtctccttcatgaagtctttccggattctgggttggaattaatcattcctttctctgaattcccatggcactttccccatcccatcatgggtatcttctaagactcatcactctctgctctgtcctaggagtatttgagtctgtctctttgtactctcccaagctgagagtcccttggccccttgaaagctgtctctccttctttatggttcccctccatggattctgatcactgtacctaagacacggccctcaatcaattttgttgactgtattgaacagatggaagaatagtcatctactagcacattgcagaaagggagctgttgggttcattgattttgtgtggttggaagggttgactctcagaaaaagagcacatacttcttccagacagtaggttggttgtggtcagatgtgtacatctggggcatgcatctgctctctccagtgtgcttggaggatgctgtctacacacaaacttctcgaaacttaaccccttctaaagttttatggatctccactccctttgaagaagaccatgctcacctgggctgcagcgagtgcctttgtgtgggacaaaaaaatgccccttctccctggctgagacagcccagggccagcgataggcttagtgatccaactggagccttgtttggaaaaactctcagaacatttttcctctgctctcacaccacaacaacatacccagaagacttctgtgacctcaaaaccttggggatttctccccaccggcaagctagcaatcagttcttcagtggacaccagctgggtgtcccccaattcaattccaacactatttacctggagatagcatcagatcccacatgttgagggacacaagactgccccctccttcccacgagtcatattaataagtccgtgcctccggaacttctgatggactggcttcaagttggggttcccatggtcccctctttgagtttaattaatttgctagaggagctcacagaactcagggaaacacctatttacatttactgtaagggttagggttaggttcatgtaacacttccttacatttattatgaaggacattttcaaggatacaaataaacagccaggtgaaaagatatacagggcatagtccagaaaggtcctgagcacagaagcatctgtccccagggagtgggggcgcaccaccctcctggcacatggatgaattcttattcgcccacccagcagtgtgcagcagcctggtcctcatgcctcccatctttctcatgggtggacagtatgtctcatttgctcccacatcccctcctctagcgcagggcctgacactgggcacgtgcccattaggttcatttagtgaaggagataccaaaggaaatggccttctcttctctagtgagcaactggccacgtcgaggtttcaagttgcagtcaggatgcatgctgggtgtgtgccccctactgcaccacccctgggggtcttggtctttgcaaggtctaggggccatgtagaggctcctgcagcccacacttggggagatggtgtgggtggcaatggaggatgttccctttcaacaggggcagtctggaaaacactgcctctgtgttattctcactcatctcgccaactgcatgaccttgggcaagtccttttgctcatgtagtttatccctagaatagatctgtaaaaagacctcacacccatgttgtccatccctggcttttcacagatgacaaaactggaagggaaggagactcgctcaaggtcacacaatgagtggctgagcctgggttttgactccatgtccactgttttctcagagcttcacttcccgattgtcttttctgccaaatcgggagagtcaggccattctgcttatttcataggattcctgttagagtcaaacgaaaaagcgtggctgtcaaagtgcattcagatgtacgcagggctaaatcactaaccaaactttgcccaaagagatgccacggcaatgccaggcagacaccagatgtcagtttccccttcactgagatacggaccccactcctgacccagtggccttggggcgagtcttgcaaccccacctgagggtggcttctcagcccgtggtcctgtgacaagccctttctaccgcttcctctgcaggcccgctaatgagttcttcgttgtttgtgttgagaagaggcagctgaaggattggagtgtgctttcttctgaatttatcccattaggaagcagactatctcaaaagagaaaaaaaatgtcattaagacttcactgagcactgtgtaaggcttaagaaaggtcaggaaccacctcaagagtatgcggaggtcctgaggagcacgatgacagcttgactcacggtgagagtgtgttgctccaggaagggccacctctcctcctaccatagagtcctcgctggggctgctggggggaccacccactacccttgcttgtagcacttattttaccctgggctcactaaacctgctcatctccactacaacattcaagaaccgtcaaactcctgatccagtaaccttctatgactagcgtgcatcatggcatttacagtaaagctagccctctacagctcacacctctgactgccaaaggcacatatagaggccccattgccgggtctatcgttcttgcagcagtacttctaaaattaggtgggtatggtataatacaagttactttaattctaatcccctggcagaatttatagcatatccattcctcattctatctctctaagggataatcataacaagttctatttgcttctgacagactgacctaaaatcactcattgcagccgggcacagtggctcacgcctgtaatcccagcactttgggaggccaaggcagatggatcacaaggtcaggagttcaagaccatcctggctaacatggtgaaaccccgtctctcctaaaaatataaaaaattagccgggcgtggtggcgggcacctgtagtcccagctgcttgggaggctgaggcaggagaatggcgcaaaccccggaggtggagcttgcggtgagccgagatcgtgccactgcactccagcctgggctacagagcaagactccatctcaaaaaaaaaaaaaaaaaacactcattgcctattttttcataagccacatggcgcttgtctttcacatatccgcctttcaaaggggcagtaagcagaaaatacccaagaaggaaaggaagaggaaggtcccatcagaatttgggcaaaggctcatgtgttttggtggatcattcaagcaagtctgtttcctgcgggactggcctgcctttgagcctttctgcttcatagccctctgtcttctttcttcgttcaagatcagactgcttccatgctttgcctccatatctcattaggatgccttaaaaattaactagcaggccgggtgtggtggctcacgcctgcaatcccagcactctgggaagccgaggtgggcagatcacttgaggttaggagtttgagaccagcctggccaacatggtgaaaccctgtctctactaaaaatataaaaattagccaggcgtggtggtgtgtgcctgtagtttcagctactcaggaggctgaggtaggagaatcgcttgaacttgggaggtggaggttgcattgagccaagatcacaccactgcactccagtctgggcaacagagtgagactccgtctcaaaaaaaaaaaaaaaaaaatcaactagtgtagtggttctcaaagtgaggccccacaccagcagcctcagcttcacctaggaacttattagagatacagattcccaggttccatctcaaacaacagcccttagggtgaggcccagcaatctgtgttttcacaagcctccaagggattctgatgctcctgaacttttaagaaccattgacccaaagacatgggattgcttatctcaggacagaaagctgatgctcctgatgtgtttgctgacgcttggagctgtggctctcaaacttcagcacaatgaaggagactaagaatgcctcccagagaacacaggtgtgtctgaagcaggtgccttaaccagaagggctgctaatggtgggaatctcaggctctgtgacaggggtcatgtggattgttttaagcatgatgactttggagggcctcactcacatcaccttggaaactgcctgctaccccatggcacgagtttactggaaagctacacacaccagggacctaaacccataggaggactgtttatgtttaggtttgatttttaacaattaggtgatacgaacaataattttggaaaacataggcttttcattctggtgtgaactacttcactagatgttatttaaaagcaaaaacactggtttcacagttcagcaagattgaatgtctgattgagggctcagcaaattactgcagtttgttaagtttgtggttcaatttgaggtcccaaaggaggaaaagaggtacatgatgtcaaacacatgcagccagcttccagtggctttgcgtgggagctctggtcagcggggtttacatgggtttaatcatgctgaggccagatgcagtggctcatgcctacagtcccagagctttgggaggccaaggcaggaagactgcttaaggcaaggagtttgagaccagcctgggcaacagcgagacccccatgtctacaaaaaataagaaaaaattagccaggtatagtggtgcacacctatagtcccagccactcaggaagctgagatgggaggatcacttgagcccaagagttcaaggctgcagtgagctatgattataccatcgcacttcagcctgggccacagagtgagaccctgactcaaaaaaaaaaaaaaaaaaatcatgttgatcaacttcatttcctccctctcctgggcactctgtctttctttgatggcttcttgcctgagaaaaacacacagaaagctctcctaaagcacaaattctctccaagctgaaactaggaggagaaatattcaatctgtgactaaaatggggtctctgccggtgatcaagagagtgcccttttagtgtctgtgtgtttatattcaggtctccatagtgcagatggcaacccacagggtgcagggagtggagaaggattttcccaggaccccagagtaggaatggggtccacagggctggtgctgggagcagaacccagccatccgcggaggctggatttcatgggaaaatgagcttgtggaagggcactttctgagggctcagctagcaggaaaggtcactttcttctgaagccactaagcatgttattccaaatcagtggagctgaaaagatttatttaaaaggctatgaaatatcccttttttaaagggaaaaatatgatcaaggggattagaacggaggctgtacttgagagtcaggtgtccctgaacacccaggcagacttggaaagctcattgtgttggcgttcagtgcctccctgtccccttcccatggcagaagaggatcccgagaagaggctcttccctctgtccctgggtctctggggtcctcttctacccactctcagaagaacaccacacccaggccacccttccgggaagcaaccccactgagcttggggtgatattataaatctttaagcacaagcctggcctgggagatgaccaatcagaaaggaagccagccagggtcctgaagcagggtcctagaggcgtcctgcttgccaccagttcaccctttattgctggatcaaggggaggagcaagggagtcaggggcttggagtagtggctatttaccagtcagcttgcagtatttcattattcagcaactggcccagctatctcagtgcacatcagccacgctgtgctgcttccctcatatcaaagttccccctttccaatgtgcctgtgggtctggctgtccactaggggtaagcagttgattaaatggctcaaagtgctgggcatagtggctcacgcctgtaatcccaacactttgggaggccgaggcaggtggatcacttgaggtcaggagttcaagaccagcctggccaacatggtgaaaccccatctttaccaaaaatacgaaaattagcctggtgtggtggcagacacctgtaatcccagctacttgggaggctgagccagaagaatctcttgaacctgggaggcagaggttgccgtgagccgagattgcaccacttcactccagcctaagcgaaagagtgaaactccgcctcaaaaaaataaataaaaaatgcctcaaagggatcaacagccccctcttcggaagcccagcctgctcactcacctggtactcccctcaccatgagagctgccacctcctgtggcaagtgccaaagctcctgaagaattcaacaggcaggaagtctgcagcccgctagggacgctggagtggagctagtgtgtttcatgcagtgcaggcttgctggtgacaaatcctttgtttacctagaaagtatattttttattctcatgtttaaagtttattttccctgggtgtaaaatgctgaattggccgtcgcggtggctcacgcctgtaatcccagcactttgggaggccgaggcaggcggatcacctgaggtcaggagtttgagaccatcctggctaacatggtgaaacccagtctctactaaaaatacaaaaaattagctgggcatggtggcgggcgcctgtagtcccagctactcgggaggctgaggcaggagaatggcatgaacccaggaggcggagcttgcagtgagccgagattgtgccactgcactccagcctgggcgacgcagcaagactccgtctcaaaaaaaacaaaaatgctgaatttaccattttttttcaatacttcaaaaatgtcattgccttatttcctgtccatgttgtttttaaagagtagttggtcttcattcataggattgttcccctgtatgtaatgtgtctttttttctccagctgattaatgaatattattaaatggaatgaagtgggagggcctcggtgcataagtgttgaataatgagctcctccttccttttatacccaagatttgctggtgagagaactcactccctctcagagggtgttttcagtcctggtgtaaaggacccgaccttcagtcattgctccagtctctccacttgggtacacccaagttgtaaacatctcaggaacaggacactgtcttattctataggcagatattctttggtttatatcgaagaaggataattagaaaattgaatcaaatccttttccgttttctcctgaaatgtggtttcttgatttagctttgctgcggtagcctgttgagaagacagtagtatagaaatagaaggctcggtgggggtgtgggcatcgcattgctgtgatgatcctgccttttgtggttaccttctatttcagtctcacacatctgtgagctgggagagaccagcccttatcctcgcctcatccgctgccactccactccctcgtgttgtaactgacttgtcaccattccctggaaaataccatacccagtgacagctctggtcccacacactgttccctctgttcccacataaactcctgcggaccctgctcaaatgtcccacctctgtgaagcttcacccagcaacccagggaagagttaatcacaccttcctctggctgtgcaaagccgttatccccacgttactgtgatgatctgtttacatgcctcttcccagacagacctggcagggcccctagaaaaacatatgtatctctttcatttctatattcctggcacctagcatagtatctgatccattgtatgagttcattcaatgctaattggctaatgaacaagccaagcctctgcctttctattgaataagcatggtcttcaagcataaattctcttcctcagggcagcattcaaggatttgaagtcatctaccatgtccctctaaatctcggtaggctagaagcccccctatacaaaaatattcaggtactcttctaagtgcttaatgggtgttaacctactaaatcctcataacaacctaataggtgctgttgttgcccccattgtctagatgaagacactaaggcacagagagtaacttatccagggtcacctgcctggtcaatggcagcgttggactgcaaagcccagtggcagctcagagactgtgctctcagccactgagctcagctgctttgatggccattcaggtgactgcatttccagagctcacactatcctgactgccctttcattgacctccttcttggcaaaccattttttttttttttttttgagacggagtttgctcttgtagcccagactggagtgcaatagtgcagtctcggctcactgcaacctccgcctcccgggttcatgcgattctcctgcctcagcctcccaagtagctgggactacaggcgcctgccaccaggcccagctaattttgtttttatttatttattttttttgagacagagtttcactctgttgccaggctggagtgcagtggcacgatcttggcacactgcaacctccacctcctgggttcacgtgattctcctgcctcagcttcccaagtagctgggactacaggcatgcaccaccttgcccagctaatttttatatttttagtagaggcggggtttcatcatgttggccaggatggtcttgatctcttgacctcgtgatctgcccgcctcagcctcccaaagtgctgggattactggtgtgagccaccacgcccagcccatttttttgtatttttagtagagacggggtttcaccttgttggccaggctggtcttgaactcctgatctcaggtgatccgcctgcctcagcctcctaaagtgctgggattataggcatggcagaccctttcttaaaatgtatcttccagaacaggtgctatgtgatttagctagcacagcatcagtggggatgcgacattgctgctctgtacacatcacgctgttcatgttgcccatggtctttcggtagccaggttgcactgttggctcattgagcctgtagtcaactaacttctgttagctctgtatactctattttacatgaatatggttgatctttttttagcccaagtacaggactttctttaccctcatcccttgtagatttcatcttcttggcttcctgcaaatattgtaacctgatgagatctttttggatctttgttctgtcacataatcttatcccttatagcttcataatttataagcctgtcttctaggacttcactcatttcactggttaaaatatgtgtaaagagattagaccaaaggcctagccactagacacgcccctccagagtgacactgacattctttggatttagccgtcaaaccagttatcaatttacatagttatatactttttacccaaattttttcattgtccacaaagatgtcctcaggggttttgtaaaagtgttttgagactcagggacactgtaatatcctttcattctatctcaatacaatttgaaactcatcctaaagttaaaaagtgacattcaagctgcatgaccagctgtaacagttttaattcctagatacatggagcacagatgttaggaaacatcaccactttagagagaacccaatgcatgaaaatctaaacttacaaaattatattggaggctagggtgtgcttaggtaaactatcattcatccactaaatagaattgttacacgagtatgttctatgatgtttttgaagagtttgcaataacatagacaattttgtgtaataatagtaagtttgaaaagcaagatacagaattatgaagatggtatgatcataagtttaaaacaaggagaaaataactaaacatttttttaaaatagacttgagtaagggtccccaacccctgggctgaggaccaggactgtctgtggcctcttagaaaccaggccacacagcaggaggtgagtggctggtgagggagcatcctcacctgagctccgcctcctgccagatcagcagtggcattagagtctcataggagctctaaccctattgtgaactgcgcatacaaggaatctaggttgcacgctccttatgagaatctaatgcctgatgatctgagtgtaacagtttcatcccaaaaccatctcccagctcctcttcccggtccgtggaaaaattgttttccacgaaactgatccctggtgccaaaaaggttggggactgctgggctagaagtaaaaactccaaaatgttaacaatggttcgacaaggcatagccttctttcaataattcccaaaaatatgtaaaatgaacattcatggttttatcacagtaaccttttcaggtgggaagttgggaaagtttgctgcaacagtttacccattgcaaaaagagtggtaaacctggattattcggttactgaaagaaaagggtcaagcaccccagcgtgtggcccaggagtccacggacagggaccctcaactgccttctgctctgaggtgcccactgtgtcatgtgtgtaaggtttttttttgttgttttttttttgagacagggtcccactctgttgctcaggctggagtgcagatcatagctcactgcagactccatctcccaagcaatcctcctgcctcagtctcccaagtagctggggctataggcacatgccaccatacctggctattttttattttattttatttttagtagagacaaggtctcgctatgttgctcaggctggtctcaaactcctgagctcaagcaatcttcctgcctctgcttcccaaagtgctgggattataggcatgagcccctgcacctcccaggtctataaatcttacctccccacccagagtggctgctctgcctcaggctgcagcctctgggaagaggagacttctggacaggctggtggggtgagggtgggttccatgcccccgggaaataggacaacctcctcataggtagagtgggcaggtactaactagtgccatgtgagcctaagcaagttacttaacctccctcaggctggctccatcccctcataataactcaggtttctgtgttctcagatacctaaaattgtaccactaatagtaaattgtattggagtggttgaccatgtattagtttctcttctaagataccgataaagggagtgaagatgagtgggaacaagtcagaaaattcttactgtaatgaacttgtcaaaatggattaattaggaagcactgggctaggggaagggagttgaactcaaaaggagaccagaatacagagcccccttaaatgttgacacatttgcaatttggccaaagcctgcctctagtactgtggttatacactacaggtgatattcaagatatttaacaactggtaagctttgggaccaaccaatctgaacagacatcggcagtgaccaatcagagtagatactgtctgggagccgccatcacccctccaccctgtacagactggagagcgggccctgtcttcccagaggtgttcactcaagggtccaccagcgacttccctgttcaggcactcagagcagcaactgagaggtctgccctggcacagtcactttgggaagaatacagctttttttccctccctttttcaataattcccaaaaatatataaaatgaacaggccttggtcccacagctgcccccacactcttattcttgctttcttctcttccaagataacacgtttgccctctgctgtccatcatgcacctggcaggatccccttgttttctgggtgaaggcagcaggaaagggggagccattccttgccctcccttttgtggcatggcggccccacctttggctttcagatgacacggccagcaggttttctggggtatgggagacttgagggtatggtcatgaagattttttttgcagcgtcttctgcatacaaatactaccatctgtaggaaccatgcaaactccagcagtaagctcgatgaagccattgtgatccgcaggactcacctgaggtcttcttggggtcaaattttccccattgtcaatccctatgccttttattatggaattggagtctgagttccccatgaaggagagcaagcccgggagcacagaatggcctgcgtggcctggtttcacaggcctgaggcatcactgtgtgtgaaggtggttttcagtagcccacttgctgagctgggtggagcccaaggccaggaggactgagtcatgggtgtgcttccgtgcaggtcttttgtcttagccacgttttcttgtccccagctgcccttccaagcctgactctaaccaatttgcaaatgctctgggtcggaagctagggaaggagtgatcagccaatggcttctgtagctggaagatcaataccctcatatctacccagaaatatttcctacaattcacaataatgcaccctagggagttctttcccacccataactctggatcctcataccaaccctctgagagaagcgagtcaggttaattactatcctcctttgatagatgagcacaaaggagcccctagggttgaaaagctcatctaaggccccactgctaatgagagacagagctgggacaagatctgcctccgggaacctggaacagcagctgatgtaatcaggctccgttccagaatttgagaactttcctggtaccctctgtgatgagaagagggagtaatcatggcatggaggcgctcgggcttccgctttgcccaggtggaagcttggagaacaaagcagttctgtgacctccctgggccccactgtgagcagagatggggccaggacaggaaagcctcctccctgccctccttcctgtgtccctcctggtggcctctccccgtgctcttacgctgtcctcctctactgtccctcctcactggagactcactgaggcccaaggcctgctaactagcaacatagattcccaccaagggacccagcgctcgccgccccacacacagcgagttaggaaaaggccactacccagagtattcctttcagtagaacagtgcttttatatttgcttttaaacttttttttttttttttttttttttttttgagacagagtttcgctcttgtcgtccaggctggagtatggtggcgcaatctcggctcactgcaacctccacctcctgggttcaagcaattctcctgcctcagccttccaagtagctgggattacaggtgcccaccaccacgcccagctgatttttgtatttttggtagagacagggtttcaccacattggccaggctggtcttgaactcctgacctcaggtactccgcccacctcagcctcccagagtactgggattacaggtgtgagccaccgcgcctggcctaaactctttttaaaaacaatgttattgagatatattaacataccatacagttcacctatttaaagtctacaattcaatgacttttaatgtattcagaaatgtatgtccatcagcagaatcagttttagaacattttcattacccccaaaagaaacatcatcccatcccccttcagcatcacctgtccccacaaggtccctcatcccccaaccttagacaaccactagtcagctttctctatctatggatttgcctagtccgaatatttcacataagtagagtcacacaacatgtggtcctttgtgacttctttcactcagcataatgttttcaaggtttatccatgtgattgaagcaggtatgagtacttcatttctttttattgccaagtactatttcattgtttggatatgtcacattttgtttgtccattcattagctgatggacatttgggttgttgctactttttggctcttatgataaagctgccatgaacattcatgtacaagtttttatgtggatatgttttcacttctcttgggtatatacctaggagcgaaattactgggtcatgtgctactgcttgaggagctaccagactgttttccaaaggggccacactattttgcattcccactagcaatgtataaggattcaatttatccacatcctcaccaacacttttttttttttaaattttagccatcctagtggatgtgaagtggtgtttcattgtggttttgatttgcatttcccagatggctgatgacgttgaacatcttttcatgtgctaattggccattagtatatcttctctggagaactgtctatttagaccctttgttcatttttaattgggtttttaaaattattgaattataaaagttttttaaatattccaaatgtaagtcccttattagatggataattgcaaaaaaaatttcaacccaaattttcaactcaagttcttttgtgttgtctttttcacttccttgatgttgtcctttgaagcacagaagtttttcattttgatgatatctagtttatgtcctttttcttttgctgcttttgtttgtggcatcatatctaagaaaccactgtctaatccaaggtcatgaagatttatgcctatgatttcttcaatttttgtagttttagctcttcagtttaggtctttgatccattttttagttgatttttatacattgtatgagatagggggtccaacttcattcttttgcatgtgggtaatgatcccagcaccatctcttgaaaacactattttttcccattgaattgtcttggaatctttgcaaatatcacttaactataaatgtaagagttatttctagacttcattttttgttgctgtatatatcgctgttattccagtactatgctatctcaactactgcagtttgtagtccgttttgaagtcaggaagtatgaatactccaactttgttccttttcaagattgttttgactattcaggccttagaaaggaataaaatgctgatacaggctataatgagtgaaccttgaaaccattatcctaagtgaaagaagccagtcacacaaaggccacatattgtaggatgccatttatatgaaatgtacagaataggcaaacccatagagacagaaaatagattagtggtgcccagggcagagaaatgggagaaaatggggcatgactgctaatgagtatggagttttttgttaggttgttgaaaatgttctggaattagatagtagtgatgattgtattaccttgtgaataaactaaaacccactaaatagtacactttaaaatggtgaattttacgacgtgtgaattatatcttgaaaaaaattttaagagataatttgaataccttatatctatgaaaagcatcgtatatgtagtttaaaatcttcccacaaagaaaaaaataccctccaggcccaaatagcttcattggtgaattctaccgctatttaggaaataaataatatcaattctacaaactctcccaaaaattgaagagaatacttcccaactcattctaaaccttattgtgatagcaaaacatgacaaaaacctgtataagaaaagcaagtgacagattaatatcttccattaatattgatgcaaaaattctaaacaaaattttagcaaattgaagccaacaatatataaaaaggataatacatattgaccaagagtgttttatcccaggaatgcaaatttcatttaatatttgaaaatcaatgttataaccattttggaaaatgatttggcagtttctttaaaagtaaaacttacatctgtcatatgatccagacatttcacttctatgtatttacccaagagaaatgaaagcatatgttcatagaaagacttgtatacaaatgttcatcacagcttttccataaccaaaacctaaaagctacccaaatgtccatcaacattcaaatgaaaacactagtctttccataaagtggagtcaccactgggcaataaaagggaataaaccattcacaacactacagatgtatctcaggagagttgtgctgagtgaaagatgacagaaataaatgaagtaaattctgtgtggttccatttatgtaaaattctagaaaatgcaaactaatctacagtgatggaaaacaaattagtggttgcctagggatggaaagggattacaaagaggaatgatgaatattttgaggatgatgaatatgttcttttttttttcttttgagacagaatcttgctctgttgcccaggctggagtgcagtggcgtgatctaagctcactgcaatctccatcccccaggttcaagtgattctcctgcctcagcctcccaagtagctgagattacaggcaagcaccaccatgcccagctaatttttatatttttttagtagagacgggagtctcaccatgttggccaggctggtcttgaactcctgacctcgagtgatccgcctgcctcaccctcccaaagtactgggattacaagcttgagctaccactcctgacctaatatgttcattatttttattggtgatggggtgtgtgtgtgtgtgtgtgtgtgtgtgtgtgtgtgtgtaaacttaccaaaatagcacactaaatatgtgcagttattgtatttcagttatacctcaatgaagctgttttaaaataaatacgtttattcaattaacaaatatttgaatgccaactatggtctaggtgttggagatacaaggctgaaacacaagactctagacaaggttcctgccttcgtggagtttatatttaagtggaaaacttatatagaccagattatttttaagagtcctggaatttacccacacagctctttcagccccagaggagaagtttcctccctcccagagctgcaggagaactggcaacacagctggatgtagggtggcatggagctgggtgtagggtggcatggcgctggagtccagtgatagactaacagtggttagattgtctcgcttctctctggatgtcccccttaaggcgtctgatcaccatccatgctcccactcctgaccagcaggaagtgggtcaggtctgagaacagacccctgtggtcccttgtagtccttcatgtctgagaacagaccagatggcaccacggagacctcctgagccagagagagccaggttgtgttgtgcagatggagggtgctaaggaaagaagggaagtcggagtagagagagggggctgccctgttgctagagcactttctggctaatgttttcattcctttggaggcttgattccattaaataacctggtggagccccttttttgcttaaacttatttgagtggcttctgttattgcaattaagaagagctttgaccaggcgtgatgactcacatctataatcctagtgctttgggacgctgaggtgggaggattgcttgaggccaggagttcgagaccagccgcagaaacatcgcaagacccctttttctaaaaataaaaaataaattagctgagcatggtggcgtgcacctgtagtcccagctactcaggaggctgaggcaggaggatcacctgagcccatgagtttgaggctacagtgagccgtaatcaagccactatactccagcctgggtgagagagcgagcccctgactcaaaaaaaaaaaaaagcttttattccccttcactcccttgggtgagctctgccttcggggggtgaggagaagacacctcctggcctccccatcacagtgggctgtggcttggacccattcattaactacagcagctgccaccctcagagagcaggctgtgtgggaagggagggaggtcagattgctccaaccaccgaggaagacaggtgaaggcaggcctgggtgaacagccttgggaactctccagaaggcatcagtgggaaggcactgggatgaatctaaataggatgaaaaaggaggctccaggcagacccatagggattgaggccagagggccgggagcagtgtgttaggtgccctgcagacgtctccatgtttcggtggcaccgggccccatctttgttcacctggctgtcctccatctccttctcttctcaccccttcttgttttcctgtttcctctctaagcctcctagctcacagcactcatgatggatgttccatgcccaccagaaacacacagtactaaaaccattgctcctttgggaacaaaaccttggcctgagattcaggtgatctgatttctagtctccattctgctcccaactcaccaagtgaccaggagcaaacattactgcctgtgccttgaattccccacctagaaactttcttctaaaggcacagaagcaaagtggaagaaaggccagttggctggcatcaggggcctgggttccagccctgcctcctgagtgttaactgtgccacctcaagcaagttgccaagcccggtgggtcttggcttcctcactcactgtccaatgagagagaatatggccagcatcccacacgtggctatggggaagatcctgcagttccctttaagtcttaagcagagggaaactttccttcatccagcgggggcccaatggacacatctgctttaccaagtgagattttcctgtcatctacaagaacgcgtagagaaatgaatgtgcagtgcatgtgggggaggcaccgggatggcataaagccagccgtgggattgcttatccagccaggcaggactcctgtcctggcatcttcccttgccacccatctggagaccaagaccccaaattccagatgtgaggctctgtgagatcaagccagtcctcacaccagaatgacctgcatccttcgccttctcaagggaggccagtgctgtttacttcacaccttccgacggtttgggaagagaatccaatgttgtaaagcctgccatcttcttgaatggcaccagatactgacactcggtacacgcagctctctggagcatgctgttttctcggtggcactgatctgctgccttcacagagagttctgatacaatcatggcatgcagaaaagagcaaaatatcaaggggccagagcaccacggttctcagacacacaatgggagagccaggtaaggacatagaaatcagccagccccctagaaaggccccctagaagtaactcacctgaggtgatggtagagactggatttgctttcaggagtaaaccaaggaacagcaaaacaaaaataagcctcgttaggagtcgtgttactctttggtttttaacttcaaattaatttctcttctgaaccttctgcagaccaagctgccaaatgtaactccagttttccacacttctgcctatagccttgcaccgtagtgaactaaaattcagaaagactggaagctaaggaagtcactcagtcatcaaacattaaattctgttccctggcagctatgtacccaggcaggagattgaatgggaactctttggagagatttccagcaacaggagttgaaacaaaaagtcttttctgcttaatcctcatttagccagagcactaaactgcttcctaaaaagcaccaaaactttgtccacatgatattctttacaatggtgcgtcctttctgaacaatggattttcttctcagatgtggctcccgatttaagcaaaccaaaccgacacaacttcatacctgctggatggctaagggatgtttgctcacattacaacactcatcttgccagctggcttcctgtagcttcctttaaacagatcgagatttttctccatccaatgtgagcccagtggacacgtctgctatgtgaagtaagactgtcctgaaatccatgtcggttatttacccttgtggtactcacggccatccagaagggtattgcctccttaagctcaactctggctgactggcggagaagaaagcagagattagacagaggtcacagattctgagcagtgagaccaaggaggcaagagcagatggatctgaggtccctggcaaattattctctgccttatactctgccactagtgttttccacaaagcccagatggagacggccaaggattgtgtgtgtgttttatatatgtatgcatctatacatatataacagctttaatgatatgtaattcacatacatataaaaacatagatgaaaataacttagaattcacataccttttgcccatttaaattgtacagttcagtgtcttttagtatattcccagagttgttcattcttgccataccaattttagaaaattttcatcatcccaaaaggaaacatcatgtgtcaccatgcctggctaattttttttctattttttatagagacaggttctcactgcattgcctaggctggccctgaactcctgggctcaagtgatcctgtcacctcagcctcccaaagtgttgggattacaggcgtgagccaccatgcctggccaatggtaggatatttagaagcatccttggccgctacttactagaagccagtagctccacccctcaagttatgacaactaaaaatgcctctagacattgccaaatatccttgggggcccaaattgccccccagttgaaaacaattatgttatcctaaagtagctcactcagtttgcgagtttttgtggaacactgtaaagctcagcctgacctctttgtgccacccagcaagttcccagaggcctgcctcgctctttccctggtacacgcctgcaggaggtacctgcttaggaaatggatgcttccattccagctgaatcagcacccgggtctgaagtgcccactcccagcgagactctgcggtgtgacctcgcctggcaactcgagaagagcagtctgctgggcaaacacttgggcaggacaagcaaaacccccacagaaatccttctgggccacgtgtctgcttgcctgtggtctcgagggccctgtgttgccactagaatgccgtcagctgctcctttttggagagatttaatggagggactggaggcagggactaatttcaggtgtctcctgggtcctaggaaaaaaaagagaaagccctggtttaacctttagcgagatcaggactgaccaggcacgaggctgggtactgagaacagatgactaaacccattccctgccctcggggtcagggattctgctgaaaggtgatcatgggcagctgcctcgccctcatccccagcttggtgctggcacttctctggggtatagacatctaatgactgagtccctgccgttgagaggctacagtctggtgggggaggcggcaggttggcaaagcttacagaaatgaaatggagattgcaaaagctctctgaagagacgaggctgggctggggtgatcagggaggcaggagccagtgcaactgaagaaagatggagtttggaggtgctgagttctgcagatgagtgttccaggcacagacggccccaaaagctgctttagactggaaatgtctgggctccagacccctccccagggccccaaacagcagtaagcctatctctaaagagctgaggtcagaaaaggcatgtggaggccccactggggaacatgacttgagttaacctctcatgaaagtacttgcctggcttctgactcttcaagaaaggcaaatagaataaagaggcttcccacagaatttcaagatgacagagaatctgtggatgaattctgctagtgaaagacagtgcatatcacaacctggatggaactggagactattattctaagtgaagtaactcaggaatggaaaaccaaacattgtatgttctcactcataagttggagctaagctatgaggatgcaaaggcataagaatgatacaacggacatcagggactctggggaaagggtgggaggggggtgagggataaaagactacaaattgggttcagtctatactgcttaggtgatgggtgcaccaaaatctcacagatcaccactaaagaacttactcatataaccaaataccacctgttctcccaaaaacctatggaaataaaaaaaaaaaaaaaaaaaaagaaagacagtgcatatcccttctaggactcatagagcaaaagaggctcgcataaagctatcctgctggcctggtgcggtggctcacgcctgtaatcccagcactttgggaggctgaggcgggcggatcacatgaagtcaggagtttgagaccagcctggccaacatggcaaaaccccgtctctactaaaaatataaaaaattatcccaggtgtggtggtgcaagcatgtaatcccagcactttgggaggctgaggcgggcggatcacatgaagtcaggagtttgagaccagcctggccaacatggcgaaaccccgtctctactaaaaatataaaaaattatcccaggtgtggtggtgcaagcctgtaatcccagctactcgagaggctgaggcaggaaaatcgcttgaacccaggaggaggtggagattgcaatgatccgagattgcgccattgcaccccagcctgggcaacaagagttttgaaactccatcttaaaaaaaaaaaaaaaaaaaaaaaagctattctgctgcctggaattctgattcctcatgcgctggtgttccacctttgaggagatgggcagggggaatagatgttttagagaacagcactgaggactaagtcacaggatgttcaagttaacaaaattgcacatatttgctgacttttccttcaagggcctctaggttaaaaatgaggttgtccagccaggcgtggtagctcacgcctgtaatcccagcactttgagagaatcgcttgagcccaggagttcaagaccagcctcggttgggcaacagagcgagaacccaccttgacaaaattttaaaaaaggggggctgttcttcttgaagactcaagtacataagctaataaaggctctgataagtcctgcaatttacaaaccagtttaactatatctcagatttctccaaatttgacatgaagtctattcactaggtaacatccaataacaataacaacaacactttaggaagattgagctagtgcaacctcttattgtaaatggtgtcttaggaattaataccgtgggtcctagaatctggtcatccttattagaaaggggtcctagaggtctcatatcaggactccaggttcccatctggacagtataggcaggaagagtttggggaaggggctggcttttccctctcacctgagctagagccccagaaggcttgccactcccaggctggctctcctgccaggtggcaggactcccttcacctgcctcagcaagtcattgaagtgacctccctggccagaagctctggccttgcttcttcccagggctttttccttacaaatagtagaaaaggaaaatggtagctgcactctgtattttaatgtgatacgttcaggttgagcttttatatttctaacctactcccacgcctactctttcagatccaggtgtgagtttaaatgcaaaccataccaatttctttctcagaagagcatcttactactaacagctcaataccatgagttagcactggctgaaatgttttagagaacccaaacttatttggagagcaagacattcagaacaaaaacgtaaagagctttgaacagattttaaatgacaaagggattctgtcctgtgcaaccatttaaaaagctcttttaacactaatatgagaagtcatctgtaatagatgaaggagaaaaagtaggttccagtaaagtacaataggatcatttcaattttggaaaaagaaagtctatgtgtttgtatgtggagacagggaaggaaagacgggaagtaaacctacttgtcattcctcttagggaatggaggtggggagtagcttgagaattgaggaacgacattcactctgaagtgtacttctttaattattgaaatttttaaatgaacctgtgctacttttgcaattaaaaaatacaaatctgccttgctggatggcaaaatgaagcctccaaaaatggactggccaggaagtcatagtgtgccctgggaatggcaggtaccaaagaggtgtgaaggaacaaaagtctgtcttaactgggggcacaaaggaaggattcatgctcagttgaaatttgcctctttttattttgagacagggtctcgctgtgtcgcccaggctggaatgcagtggctcaatcatggctcactgcaacctccgcctcctgggctcaagccatcctcccacctcagcctcccatgtagcttggactacaggtgtgtgccaccaagactggctaaattttgtatttttggtagagacagggtttcaccatgttgtccaggctggtctcaaaactcttgattgcaagcaatccgcccgccttggcctcccagagtgctgggattacaggtgtgagccaccacacccggccaaaaaatacaaatctaaatgcaaatctgccctgctagatggcaaaatgaaagctccagaaatgaactggccaggaaggcaaagcatgtcctgggaagggcaggtaccaaagaggtgggaacaagagtctgacttaactggaggcacaaaggaaggattcatgctcagttgaaatttgacatgttttgctttctgataagaaaacgtaaagatcatgaagacccgtgccattcaacttaacaaatcctgaggcatattgtgtatacctactctgtgtcgatacagttcctacacacatatatgtggtcatttaaatgccatatgacatccaagttgaggcagttttccagaaccaatcattctcaagtcagggcatatggaaaagagacatttagcctggagaattcctttgcaaaatagcttatcattttcaggttttgcctaaagattttcagcaggctctggccccagtgcacctttgtcaagggagcagctccaatagtttgtcaagagaataaaagtatcggcagccaggactggttttagccaaaactgcagagacggcagagtcttttcttgtaatctcccagtctcccatctgtctaccccttccctacctgagcactcagatctacactttggttacccccatctcctttcccatcccccctcacacccaccttctttcaaaattctttgatagatcttaaaaagggagctggtgccagcctttacactttagtatgaatgtaactcagggtcacatagcttagaatgtctacattttaagttttattttggattatgaaaggggaggttgaatccctttccaggtaaaagattcttcaggcatcagctagcaggtagaggcagtggtttttgaacaacccttctgctgttgctccagaagccacactgcctcactgttgttagcctgtagcccaggtcctgggcattctcacccagaggctccatgcagggcctctctccgcgctctggagggaattggccctcattctccgtggaccaaatgatgcatatgagatctctggtgcaggccactgcattctttgtaggacagaatttcgacattcaggatcaagcagggcctcagattcactgttgagagcccaggggaaataatgctggacagtagcagggacgagccctggttctgttccttaagaattatgtgaccttaggcaagctatgtatccctctctaagctcagttttctgacctataaaaaggaaacaacagtgttgattttacagggttgttctaaggactaaatgagataaagaatgcgaagtgcttagcatagtgctgggcagggagagggccctcaataaatatgagctgtttgcagctcttattacttggtgggacagagctaggggcctgtgggaagaaagaaaacaaaagggccaaagcaggctagaagctggggttggagaactcagaataatgacacctgtttccatcagctccagctttgatcgtgtccttttacaggatccccaggcaggagaacaccgagttaggaatggtgactggcttcccagtagagtctgggttttgaactcatgagtaaggacagcagctcctccgttttgcaggggcatccacctgaaccacaggcaaggcagaagtgatcctaaggcgttaaatagatagtgcaggctaggcacggtggctcacgcctgtaatcccagcactttgggaggctgagatgggtggatcacttgaggccatgagttcgaaaccagcctggccaacatggtgaaaccctgtctctactaaaaaaaatacaaaaagtagcctggcatggtggcgcatgcctgtaatcccagctactcaggaggctgaggcaagagaatcacttgaacctgggaggtggaggttgcagtgagccacgatagcaccactgcactccagcctaggcaacagagagagactctatctcaaaaaaaaagatagtgcacagtctacaagcaaagtgaatatattttacctgtgcctgtgtgccctcactttatacacaattgtaataaacttcatcatgtggttgtcaaatccgcagcggactacgagcagcaaactagggactcaacaggcacaccaagcagagagcagtgatagctgacagtctgacaaagagacagaaaaaaatacaaaggcagactgagaattcaccaagagtcacagctctcaggctctttagagaggtttcttccgcccttcgacttctgagtgctgcactatgtgatgatccaaatcataactgatgttcgaatcttgaccctgtaaaaggatattaaattatcgtcaattttaagcagccagttgtgtgaatgacagtagcctctgggtggagtggtgctttcaagcgtgcatgtgctttccgtgggtttgtttccacgtgtttgcttaccattggattcccgtggtaatcctgtggtataggaagggtgtgtattattttatagagagaaaaactaaggcctagagtggctaagagacttgcctgggcttatgaaacgagtgagtggtagatctgggcttgactccaggacttctgacttgaggctcaatgcattttccaccaaacacattttcaaaccctgttccttggatccccagggttctgccccagggccacaggagggttgcaggagctgctgtaggatgcagagaaggctcatgcacagggctgtggcttcttgcctctgattcagtgagaagcattcggtatttatctgaaagagacttgggatggggaaaatcaaaaaggtcctatgctgagaacatttctatccaaaatgactaaaatccaaagaaagtcgtgggctgtgtgcatactgcgataaatctgctgctctctgaaaaacttggccatcagaatgacctccctcaaggatgccacaatcttgctggacacagattttctgaggacagccctagatgactctcagcctccatcctccctcctcatgcacgtgggctcctcaggccacccagggccattactgcccttcataatccctatcccatgggccaaacacgtccccctcacctcagaagtcccctggctggtgtcctgttctctcaaagtcctgctgagagacaaatggcaaactcccaaatgaactccactaagaaagcatgtttattttctcttgtatcttctccatccaccggagccctatgttaagctatttacagtgggctcatggctgtatctccccagctgtgagtaattaatacttaatgaatgacagatgtcactctggtggacccagaatattaacccaaataatttattcttaatgtgggaatatcgggcccatgactggccctcaggaagttgtttgagtagagaggcctttggtgaccccatagaggtggtcacttattcatccaggaagattgggacctgcttgtctctttgccaacacccagctctccttgctcccttactctgcatccacaccaacctcagtgagagaggagagagcaaagaggcatccagatgttagtcattactccatcaccactgtcaccattgacagatgcttactgactgtgaaaagtctgtgctgggtattgcaggagggaaattatattattacttctttacctggccactctaagcattaaataaccctaaatggtaagtgcctgataactggcagtgtttattattattactgttgctctctgcctgtcagaagctgatgattgaaccggaaagacaagaacatagactcaggccaggcacggtggctcacgcctataataccagcactttgggaggccgaagtgggcggatcacttgaggtcaggagttcgagaccagcctggccaacgtgatgaaaccccgtgtctactaaaaatacaaaaattagccgggtatggtggcacatgactgtaatcccagctactcaggaggctgaggcagaagaatcgtttgaacccgggaggcggaggttacagtgagccaagatcatgccactgcaccctggcctaggtcaaggctccatcttaaaaaaaaaaaaaaaaaaaaaaaaagatagactcaagtcttagcacatcagggaaagtgtcatgtatagccagtgtgaagcgagtgataccgactgggtcttgtatggaacactttcctttccattcctacctttctagccctgttttcccctatataaggggtcatttggagctggagggcattccgaggacagggcgcttgacgtgagccttgtgggttgtcaagatttaaagagggagggaggaggaggcactccaggtcagggtgatgacaagacagaaggtggcggatgccacgcgtgcagtagagagagctagagagagcgcctggggagccgagagtgagaaggctgcataggatgaggacggaggcagagggagcacctgagaaataaggctgcaggatttggacaaaatataacaagcaagaggaaaccatcaaagtctctatcaaaatggagattgcgaaagggagggcagagtgacatctattcagagctgggagcttctcctacattttctgtttcattctgacagcaaccctatgaagtagatattggctcctttaatgcagctgaggaaactgaggctcagagaggttaagaaagttgctttaagtcaccagcaaataagttgctgactcaggatttgaacccagcctcagagcttgtgttttcagcacagtactcaagggatcctcatctgggagggcactgcaggatgcagtgggcaagatgagagccaggctcccctgattaaaaaaaaaaaaaaagcaaacaaaactgttggccctgcactgtgtacacccttaccctgtgctggagctcccaagagtcagggcaccagcggagccaggacatcctagaaggattcataaagaatttgatgtttgctattacaaaaaatcaaatactcattgtgggaagaaaacttgacctttgttggactcccttacacttattttatggtttgtattgcttttacttgaattgcatacaggacaggggaactgtaacagcatcagtcctgagtggctcagaacagctgcttctgccctagggacccactgagctgagcactgttggggatacagccagtgaggtcctgattttgaggtgggcggcatctcctatgcttgagacacaattggctgagtagcaagtagcgtgggcttccttggaaagaggcaaatgaaaaatgcagcagaacctgcaggtctgagaggatccgcacaccactcaccctgaacgcaaacccagagaaccccctcatcttccggctgaaagccagagcctcagctggtgtgattgatgtgtgttactcataacacagcctgagaaatcaggtgcaggaactgccctttttaacagcgtaacttgtttacacggattctatgtgagaacctatttaattaaggtaattatgcacacagacagatggtgatggcagcacacaccaacaccagctgatggcagtggggttgaggtcctgggacatacagggagtcttcctggtatggggtcccttgcacacatttggaggagagacacggcacttgagcacctggagagagaaaaaagtggggcctgaaagaggcaggagggaaggcgcagagacttgggtcctgaaagaggcaggagggaaggtgcagagacttggtggtggccagaccagcagcatcagcatcccctcggaactcattacacatgcacattgtctggccacacctgagacttgctgaatcagaaaccctgggggtgaggccagcaatgagttttagcagactccccagggggttctgatgcatgcttaaggttgagaattgctgatgtagagcatagcatagctgttcaaaacaaaacctgggtttattcagttttcacacttaactagccactctcaccttctctttcccaagcctgactttactcatctgtaaaataggaataagaacagcaaacctaccggcgtagcatatgggtgtcacagaatgggagcttctctgcttggttcactgctctgtcccagcacccagaaaagtacctggagcagagtagaagctcaatagatatttgctacattaataattcaataaatgtattcattgagatttttgatgtaaagtgttaacacagtgtttggcaggcataccgtaagtgcttttagtaatactgctgttattggtgatggtgatgattagttcctgttcagcaaaatgagagacttgactgaaatcactataacatctcttttagagaaggaggcaggtgatcagatccacagcctctgaggtttttaaccacacactaaaatatttaaatgggcaggggacaggggaagctgtcacttgggccacagaggggaaggtaggaagccgaataacatcagccacccctgagcctgggcctaccagtacagagccatgctcagccatctggagatagaaatgctcaggggtccccaggtagcttggatgtttcactggcccaagtgctcctatcagctgctccttagggcctgtggttttccagactgacttgtggaaagggcttgtcaaggccttctttactcacttcaattaggggagttcgctcttattccctgtcactctaggaaatactgaactgttgtaagcctacaaaaatcagctccttaggcaacaatgatactcttctcccctgaaatcaaagtggcagctgatcatgactttcattctactgaaggaataaatgaagaaacctagtctgggaccagattacatttattggccctgccccaaatacttctatttatgaccatctttgatcaacatcaaataaaatcaaatcgggctacaattcaacaagcttcagagtattaggccttccactgagtggccagggggcttctagaaccagaggcattcaaacagccctaaattatcaaggaacataactatagacacaacagagactcaaaactatggcaataccatgaactccatgctcataaatattcatttattaagtaaatacatatttatcaaacatatctaagtatataaaataaatatgtccttgtattttttgttaattacatgaaacaagttcttagcaaaatatatcatcaaattgactaaaaaagaaagaaaacacctaaataatgcagtcactactaaaattgaatcagtagctaaaacttctcagaaagaaaacctcatgtccaatagttttatcaacttcaaccagactttcaattaacaaataatagaaaatagaaaaaaagcttctacctccctgcattatagccttggtaccaaaaccagacaagtgtaatatgaaaaaggaaaattgcgggccagtctcacttatgagactatatttgcaaaagccctgaaaacaatattgacaaacaaaattcagtaatatagccaagcacggcggctcacacctgtaatcccagcactttgggaggccaaggcaggcagatcacctgaggccaggagttcaagcctggccaacatggtaaaaccttgtctctactaaaaatacaaaaattagctaggtatagtggtgcacacctgtaatccccgctatctgggaggctgaggcaggagaatcacttgaacccaagaggcagaggctgcagtgagtcaagatcgtgccactgcactccagcctgggcaacagagcaagactctgtctcaaaaaaaaaataaaaattgagtaatatataaaatatatccaaattgaactcatattagaaatgcaaagttggtttaacattagaaaaatctattcttttgacttaccagaaacaaaggaggaaaaaaagaccccatgatcatctcaatcgatgcagaaaaagcattctagcaaattcagtatctgtgaatgatataaccaggaataaaagaactaccttcatccaaaagaaattgtttctaccaaaaaccttctgccgtattatgtttaacaatgaaatgttaaaagctttttctttaaaaccaggaacacataaaggtgttcactatttctcagtacatcattgcactagtggtcctagcaagcaaaataaaataagactgttgttattcacagatgatttgatcgtttaaataaaactcaaccaaattagtgacttaataaaaagactttagcaatattgctaaatataagatcaatatacaaaaatcaatttcatttgtgtatactgggggctaaaagcaaaaaacataaatagtataccatttataatagcacccaaatgatatttggcaatttgtcaattaagttctgcctcagaattagggcaaactttgcaggttaagagcagtcccacacaagggtgctctcacctcagtcagttgccacaagcccgggggtccctaggtcacctgcacatctgacccaagagctacaaatttggagattctcatcttccctcggatttaatcattcacttgactggttcccagaactcagaaaagccctgcatttgttattatagttttattacaaaggattaaagtcaggaccagccaaaagaagagacctagaggatgaggtctgggaagctcccaaatgtgaagtttttgtgttctcaggacatgtcaccttcttagcacatgggtatgtatcatcaaccagggaagctcacttgagcttcagtgcccagagttttttggggagggtaggagttaggttcatgacctaggcatgattgatttaatcattggccacctaactgaactcaacctccagcccctctccaccccctggaagttgggctgataccacgtggctcaaagcccaagccttctaatcacagtcatccccatcctgaagccatctagggaccaaccatgagttgcctcattagcattaagtcagatatggttccaggagcccaccatgaataacagacactcctgtcactcaggaaattccaagggtttagaagcttcctccaggaactgagaataaagaccagccaaattctttatgatgtatcaggcagttagaagtaaatcaaacaacaacaacaaaatacctagtccctcttgacaaactctccatataaatacactggaatactctacaactgtgaaagtgaattagctacaggtgcacacatcaactgttgcatatatttcagttttgcaaaccaaattcactggcagcgctgtgtgattaatagtgacgcaaacatcagcactcttctgtggacccatctgctgagagtgggcaggacccaccaaccagggttgtggaaaactgtgaagcaggcagactttatcttcagagcccatacccacctcctgtgcctcttcccctcctcagagccgcacctccctccaagtgtctgggacatttgcattctctttgcttcctcagctcttcaaaaccctctcgggtgcattgctaagtgtgaaggagaaaatccctgcagattctctaggcgggagttgggggtgggggacagggaatttgcttctctagctattccactcaaagttgcaactgtgggttttggcccttggtaaaggaatttaagagagtaaggtgacagaggaggaaatcaaaccttttctggtggccgaaattctcaccagcttgtttaggtgaaggacagaaacacctttcaaaaccacaccagctccccctgcagccatgcccttcacgtgttccctcctctaaggaataccagggacctctttgcaaactctccagccctcgagatgattttcctccgcctattagaacatgggccctaccatggattagattacttcaaagaaggttcctagaatatgtttctgctttccaagcttaaattctaacaagacacccccacccccacccccatcctccttggccattatcctcttcttttgcccagcttactctggtcagggccagatttaccgtggagtccatgaaacttaaccccaaggcctctcctttgcacaaccctgaccaaggccctgggagggaccctaaccttgtgttcacatggtcatgtgtttttgtaatattcacaaagcaagttattttgagagcaatctgttagcaaatgggctattgccattcagactttccctcctgctggatgccgcttgcttggctgggcatttgggggagctgacttaggggaggttgcagtggagatgcttttagttttagtgggctatgtttacgtggtttgcagttacttctgtatgtgcagttaggttactgccagcattgtggtgtaggaataacttctagaaatcctgctaaggcccacggaatcaactcatgaggtcctcatgcaaacacggcccaccctacaactcataacatgtgactgcaactaggacatcatcaacaacttggttaatgagtgtcgttaattcaaagagaatagaagttgagtcaccacataagaaaattagaaacgccccccaaatcttataggtcatgtacaaaagaacactaaatagaattatttcccaaatttgataatccagaaaacttataaggtaaaagaacttataaatatcagccatacaaggctgggcatggtggctcatgcctgtaatcccaacgctttgggaggccaaggcaggtggatcgaatcacttgagctcaggagtttgagaccagcctgggcaacatagtgaaaccctgtctctactaaaaacagaaaaaattagctgggcatggtggtacacacctgtgttcccagctaccagaaaggctgaggtgggaggatcgcttgagcccaggaggcggaggttgcagtgagctgagatcacaccactgcactccagcctgggtgatggagagagattctgtctcaaaaaaaaaaaaaaaaaaaaaatcaaccattctaaagtatcaaccacactagaagaaagacttagttatctttttaactacctaactttcaaagactgagttatctttcaagctgggcgtggtggtgcatgcctgtagtcccagctactcaggagcctgaggtcggaggatcacttgagcccagaagtttgaatctagcctaggcaacatagcaagaccctgtctcttaaaaaaataaagaagcatattacaaaattgtcacagaagagaagatcagagattatgcagcatgtttacatttgctgccagcagtttgccaagcagctaattagtaaaaatgttatttttatgaatggtgtggtgtttgtagtatttgccagctttttataatttttaatttgctgcagttccttttctgattaaacataaatattcattttcatatctaattttgtgttcatgattttgtatttttaagaggctccccaaaccaagatccaccctggccccttttctgtttccttcttcatacagtgactgccccatcttcctgccctcatctggtgttgactgtgccctggtttcatgatagtctttgcagttgaaccagcatacttactgcccagagctggagtgtatgctccctgaagacagtcccctgattcagagtaccacaaacagggccggacctactggaaacactttataaaggcctgttaaaagagcatctgaaatgagactgtaattctctcgaacaggtgacccgggagctgcctcccagtatgtgggcacttcaaaagtggtgtatctgcctgcaacttgcaggttttcccagaatacaagagtttctgcagaaaagatgtggttccctgtgaatagtgtgatccaaaaagacctttcccaaagtcagggtcagacagggttactgagccaagagttggatttggaccctaacagaagcaactctggagacccctctcaaattgatctcaagacctttctgctgccctcctccccatgctcactccccttctccatccccactgcctgtacttcttccctgcctggccagcctgggcagtggtctcagtgctactcattcagcaggcacctccttcctccagtaacctgcactctccaccttgcccagcctccctttcctaaccaaaacatccctgcttttccaaggggccagagcctctgtggagtgaaagtagctggcatttctaatggcttttataacacgcagccacctgccttcagcatcttctgtctgcaggcaccaggcacaccaagaggtcccagcactcaggggctctcaggataagtgggggaggcagtgcgcctccattcacacagagcattcagcaggcgccataatattagtcttgctaacagaagacagtgggcttaacaggtcagtatgtttcctctcccaggtatcgagttgatatgttgacagggaccttacccagcattcctcacagcctgtcctgagaaagactggtccccatgatgcacttagaaaaaagtggataagtggtcaaagaggtttgacaagcactacatactaaatccccatctagaagattctgagactttataaataagcttcactggttgttgccagcctgtcccaagggtgtttgggcacacatcctatctcccctgctagctattaacatctttggaatatgaattcatttcaggaaacactaccttactatcttaactaaaaacagcaagtctgtaggtgagactcctgcacccagacaggcaggtggtcaagttcaggaggagcagggcatccccagtgttccacagggagctacttcctgcctacatttaggctggaccaccaggagcctcctccttccccacacctgccctttccaggcagaccttgtgacagagagacttttaaaacttcaggtaagctctctagggcccattccattccctcccacgccatctgtataatgagtctacctggagactccaaaatctgtcacgccctccagacccatctaagttctacctcatcccgcatcagtagaaaaaagaaaggccagacacggtgtcttatgcctgtaatcctagcactttgggaggctgaggcgggtgcaatgcttgagctcaggagttcgagaccaactggccaacatggtgaaaccctgtctctacagaaaacacaaaaattagccaggcgtggtggtgcatgcctgtagtcccaactacttgggaggcaggaggatcacttgaacccagaaggtcaagccactgcactttagcctgggtgacaaagtgagaccctgtctccaaaaaaaaagcaagacaatcatgtgtgtctctctcttatttctcctagtctactgattgcatcacaagcattgtgggtcacattccagagccttctgagaagggagaagtcagggaagttccttttgttcttctgagcgttctctgcaagtcaaactggggagagttccagtcctgtggggtgggagcagctgtgaagaggctggaatcggagggaactttggggcctggaggcctaatggaggactctgtgatgttggactatgttgtgtcgttaccctccctgcctctgcatcctcttctgtggagcagggacaatgacagcagccatcctgggagagcatcatgatgaccaaatggaaggaaacagagggtgaggagcaccccaagcacatggtcagcacctggcaggtggctgttattattacccactcctcaaaagtgcttttggactcacattttctttctttctttttgagggtggaggtgtagagaggtgaaataaagctctgagtctgacctccaggttggtcccaggcaagattagcagcctgaggggtccggcttccacacggtagcatgaatagcatgttcaatagaaaaccggacccataccccacacggcagagggctaggcttgagcacagacactacctttgtcctgagatttctacatggcaatgaaacttcgagctaattttctcctgactggtggtcagttcctgaatttcatgggcatatcaatcattcctttagctcaacgtttttactccattcattcacccgattgtaagtgagcgcctatcttgtacagaggtgcactgcagacagagggaaaacaactggctcttgccttcaggagccctcgctgcctcccctgctatagagttaatgaagttagatgaaggggtccaggaggctgtgtgaacacaaagccttgccagctaagtcagagaggagggtcctgcagtaatatccccaaatgtaaaatgaaaaataaataccttcaacagggttctcaggaggtgagctgagctactgctggcaaaatcccttgtacagagtggatgtcaacaaatattccctcccctccctaatgtgctctcagttatgtacctggatgttaataagggagctgagagaaaagtttgctaggagggcggagaaagtttccaccctcctcgggggaagaggtcggggacagaaaggggaggcctggggctcagagaccaacgtctcatgtcttctaccacatggccacgtggctcgccccttgactcactctggtctctgctcgaatgtccccttacatgagaggcctttctggaccacccaccccatcactctctatctccttaccctgctttatttccattccttgcacttatctccactagacatatcatccatttgtttgttcagctgtctttccatccaaagtgtgcacctcatgattacagggactttgttttgctcactgctgggatcagatctcagctctgccaattattagttaatttgatcttgctcaagttagccccatctctctacctgtttcacagggtcattttgataattaaatgcactattaataaagcagtacttggcacggtgcctggcacatcataatttctcaataaacgatagctattattatgatcagtgatttttcagtaaatttttacttcctgtggttcagccatctggggaaaacctctgcggctactcaaggatttatcttatcctgaggggaggtagaaatagaaacctgtactcatccaggaaccatgaaaatactacttacctttccaaagcaggtgaactcaagacctctagagatgctggttctcaaatacagctacaccttggagtcacctggggagctgtaaaaaaatcactgatgcctggttcccacccccccgcctccgcccccacagattctgatgtgattggcacagcaggagtcctgaacgtcagtttttttttttttttaagttccctaggtgcttccagcctgtagcaggtctgagagcccgtgctctagagtgccaccagatttccccttgaaagccagcgtgacagatgtctatttgtggcttgacagttaatgcatcttactaaaagaagccatttgcacaaggactggcctattaaaaattaatcactttggcctagcagggcttctcacttaaagattgctgtccattgtcatgcagcaccccaggatgctaatgccccacagaggagaacttgtagcccctccagcagcaaaatcagataaggaaactgaggcagaagcagcccaaccaaatcatccctccacccacctctctacccagcccagccactggtcctggtgaggatggtggtaatggagctgccagtcctggtacatcactgaacaaacagaacatgttatcctgtctttgaactgtaataggattcagagttcttgatttggaccccatgaggataatgtccaaagcttttatcagacggtgagctctagctgaattagaagacaaccacatttcaccgaagtgctttttaaaaagaagcccaactccattgctcccactttcctgctgtttaaaagtaaggagaagtacattacgctaaatgaaataagccagatgcaaaaggacaaagcctgtatgattctgcttctgtgaggtccctagagccatcaaacccatacagatagaaaggagcatggtggttgccagaggcagggggcaagaacaatggggagtcattgtttaagggggacagactttcagttttgcaagatgaaaagagttcttggctgggtacagtggctcatgcctgtaatcccagcactttgggaggctgaggaggcaggtggatcacttgagctcaggagttcaagagcagcctcggcaaaatggcaaaaccccatctctacaaaaaatacaaaaattagcaaggcatggtggcccgcacctgtagtcccagtcactctggggggttaaagcccgaggatcgcttgcaagtcttactgggagactgcagtgagtcatgatcgtgccactgcactccagcctggtgacagagtgagcctctgtctcaaaaaaaaaaaaaaaaaaaaaaagttctggagatggatggtggcgatggttgtacagcattgtgaatatacttaatgccactgaaccgtatgcttaacagttaaaatggtgaactttatggtatgtgtattttattacaattaaattttttatggcaattttattataatttttttaaagtcaaagaaagtgaccacacagggcctggagtgtccaacaagggcctgcaggcctatgggaatttatatgagcttttggttgatttccatggaaacctgggaagagatggtgaatttcaggatctgtccaggatcccccagagggtggagtggagaaggggcagccctgaaaggggatcagcagatcagcatttagggcatcttagaagtttatgaaaattcagtgcagctgatttagccaaacgatttcttcacccatgtttactttagctgcgtaatagaacgtgccagatgatttcccagtgattgcgatgtgagccaggctttgtgatgtgttccctccctcaatttgagagagtccctgctgcatgctttcctgcaaatgagtttaatggaatgagtttgctatttggctgtggtattattcctttttaaaaaaggtttctcacgtgcctcatatgtacattggcacaaataagaattatgccttcagagggagatgactacagaagagaggctgtatatgtctgcttcagcgggacctctgggaggatgttgttcttctaaatgatcttttgatgagtgtctgtaactcaaagaattaacccctattataggtcagtctgctgctcggtttgagaaatctgcctggcctgtaagtaaagcaaatcataatttcttagggcaggccagtatcataaagaccatctaggaacttgctggtccaagtgtggtcatctgaaccgcaacatcagcatcaccttgtttagactgagaaatggaatctgcgcttaaccagtcgaggtcctcaagggatctgagagcaccccaaagtttgagaagccaagctttagggtctccaccaggaagacggttttggcacatctctccacgagactgtctgttctgtgcttggaccctctgcttgtctagacagcccaggcccccacagaaagccctggcagccttagaagtctctcttatgtgcgaggcagtggagccctctattcaggtcaaaggagctacatctgcacagcctggggttgaattccagctgtgccacttataggctgtgtgagtatggacaggctgcttacactctctgtgcctcagtttcctccctgtaaaataactatgatgagagtccctacctcatgggattgctgtgaggatgaaatgagttaatccatataaagcagataaaactgtctgaggagctcaataaatgttagctggtattatcatgttgcatagatttctgtctcacacattggctctcggctgtccccagagcctcagagaacaagcttagctcctcttctacatgacagccttgcaaatgtctacaggcagctctcacgcccaccccttccatgtcctccagactgaaattgccaggttctcgtgtgacaggcctttgatttccactgctcctccaccgggagggctcctgggaacccagtcccctgaaagaatcacagtctccctgccacagcctcacttttcccctaagtttttcttcttccaaggaagtgcagtgccaggggccttcctgaggccttcctgagtccattaatcccctgctctccagactgcccggggaattgggggaagcgtgatggggtggagagggagcacagagcctgcagcctccttgctccaccagtgcccacctgctagtaagacttgcaagggccccactaggggcgcaggcctgcccaggctaattagaaaagcagagacacacatggcccttctgcaacctacgctgaaacgccttccgcactaggagggggcattcgcctcccctggggagctcattcaagatggagattggaggactccaagtcggcagctctgagtggtctgcacattcacaagcacatctcttggagtgcttgtgaattcacaagcatgtcattggggatgggggaaggcctggcagtatgaaagtgatgagtgcaggagccagacacccctgaccacttcccagttacagcaccttgaaccagtcattttattagtctgtgaagggcctgcatcaaattcatgtaaaatactaacacagtgctgggcacagggtaagtcccacagaaatgttggccatgattacttcctggtccttacattttttccatattaacatttcatctctctaaccatgtgaaatgctctttgaagacaagggatgatctgaatcattttcccatccttcacacagggacagacaccttaggctcccaggacacattgcagaaacttctggttgggaaggcgaggctgtcagagtctcttatcatcctagcctggaaacaggggcagccctaaacattgcttcagcatgaaaggaaaagcaacccttcccaccctgtcctcatcccccagagctaaagttgactgggcttttattcttggagaatgtcatctcatttaaattcaccataccataccaggccaggcacggtggctcatgactgtaatcccagcactttggaagactgaggtgggaggattgcttgagctcaggagttcgaaaccagcctgggcaacgtggcaaaactctgtctctacaaaaaatacaaaaattagccaagcgtggtggcgtgtgcctgtagtctcagctacttgggaggctgaggtgggaggatcgcttgaatccgggaggcggaggttgcagagagccaagatggcaccactgcactccagcctgggcaacagagcgagaccctatctcaaataaataaataggccaggcgcggaggctcacgcctgtaatcccagcactttgggaggccgaggtggacagatcatgaggtcaggagatcgagaccatcctggctaacacagtgaaatcccatctctactaaaaatacaaaaaaaaattagccgggcgtggtggcaggcacctgcagtcccggctactcaggaggctgaggcaggagaatggcgtgaacccgggaggcggagcttgcagtgagcagagatagcgccactgcacgccagcctgggtgacagagtgagactccgtctctaaataaataaataaataaataaataaataaataaataaattcatcatacccctaagggattagtaggcacattatcattaaagggtgtagtagaaagtttattggattgagccttctcccccaaccttccaactcccacacgcaagagatcaggcagtgggggcacagcaagggcaggcacaggagacttggctccagatcagaactggtgcccacccagcacgggcttgctggagcagctgggagtgcccacccttctggagtgactttgatccaggctgttctgaattccctggcaggcagctgggatcgagggctgcttccctgctccctctgcaaagagaatgctcagagctttaattataccttctctctatccttcaggggcccctaattatgctcctcacagggcagctgctgctagattatttcccaaacacctctgaagcttttaaagtcaaagcctcccatgggctctgcgtgactctaaagggacagcaaaatgggtggatgggagcaatagctgacgaaagtcccaaggccccttaaaagggtctagaaaggaaaccatgttcatctgcctcccagtgggaacaaggtggcaggaggaaatagacgattaggaaggggccactcccatcttgtttcttgtgctctgagtggtggtcacagagaactgtgggagtgtgcacttcatgtcttctcagagcagtgatgttacaaagcctcacacaagaggctggccccagctggcctgcaacagccgcgtgcagacgcacccacttgtgcgccaagtgtgcctgctgtcctgctcactccctccttggccaccctgtgcatgggcatgccctgcctggggagaccaggtctgatcacagagacatgttcctctctacatccaaaagaagctgaaactatcctcaccctgcaggcttgggcagagggctatttggagattttttttgagccaatatacttattgatttatgagctcttttaataaaattgggtctcgacttctgggtattctttaaagtttttttttttttttgtagaaaattatcctgaatttcaccccatccactcgactgcaactcctctcttgaattctgatcaccagtaccatgttgtgggccccagagcctctcccattcggacacccagggctcagctcagctgacagcagggccctggtccactgtgtctgcccccagacctgggaatggagcttcccatatattcccatctccccttcctggggcttctcttgcaccagcttggcagaagacactgcaccttcccaaattcttctcagccttgtggcttctgaaacatatcaacaaatcccctttaagtgtcgggcacagtggctcatgcctgtaatcccagcacttcgaaaggccgaggtaggcagactgcgtgagctcaggagtttgagactagcttgggcaacatgacgaaaccccatctctacaaaacatacaaaaattaactgggtgtgttggtgtgcgcctgtggtcccagctccttgggaggctgaggtgggagggtcccgtgagcctgggaggcagaggttgtagtgagccactgttgcgccactgcatgtcagcctgggcgacagaatgcgagaacctgtctcaaagaaaacaaaaacaaacaaaaaatccactttatgtttttttaaagagtgtgaagaacaagtaaccataggaagatagctagtagttaaaaattcagcaggctcttgtttttcattaaaaaaaaaaaaaaggaagagctggaaagcaactttcttagctcctatcatgacctggtctgtaattctggcccaagggcagccttacccatgtcaacatctttcttttactttcagagcaagtgtttcagaagaaagccccctgtccccactgttctttaaccctagactctgaggagaggcagatgtcaattccagaccattctgtttcataaaagactgtgcatttacatatcagagaaaactcccctgaagctacctcccctctgggtactcttgctttagtcttttccctgacaatctcaccctctgactgaaaataaaaccagactatttttttagaacccacccacctaaaaatgaacttctacagacagtatttggcttgttcctgtaacttttagaatcgaacttaaattcctaacagcctactgtacacacaccatggatgagtctcagatgcattgtgctaagtgaaggaattcagactcaaaaggctacatactgtcattccatttatacagaaggtaaaattagagagacagaaaagagcagttgctaggggctgggactaggggtgaccaaaagagggcatgaataaattgtttgagatgatggaattgttacgtatcttgattgtgatggtggtgacatgactatgcttttgtcaaaactcacagaactggtgaattttaccctatgtaaattatacttcaataaacttgacttttaaagcaattaaactcttataaaaatgacattggcccatcctttgttggaacaagataaggcataagtggctatcaacttatataaactccacacccaccttggaaagtggaacctggaccaccttgtagtcaagtgtataaaagaagaggatcagtggtccctgcagaaggtgcctaaatttgggaggaggttcagaccatatgagatgtttccttttcattcattcattcaacagttcagcagtgtttactgaacacttcttaggaggcatggggctgggctatgcgcagtagctgcataacaagacacagctgctgcccatgaggggcgcacagtctagtggtccttggaggggtggggatgcagagaagtaaagaaacagcaacaaaacaaggaaacttctgagaggaagctggcctgagcgtgtcagccggtagcacgatgagtacggggatatccctcatggaatgtacactgtcaaatgcacaaaggacagaagaagagggcacattctacaaattttaaggagttcattttggtgagagtattgaggccagcgtatgggatgctctatgatttccagctgaagggtgtcttctgcttttcctccttccttctaccagtttgaggctctactcggaggaaatatgtgccacagaggggaggaaactgctgtcctttccaaaggttttagacatttaataaatctttgctgaacaaattaagggatttcagattaataggtcaaaagctcctgggtcctggccttcttaacttttcatctgctttaacctgagactgtgatacttctgcatcagtagaaaggaaagtgtgaatgctaaactgcgaagtaaaagaccatccctggaatctcccattggatctccttggtcctaactgtctcgccttgacccccaatggatctatacattttttttcttacattagaaagactgttctagggaattcaaatggacatttcccagatgtcactcttggcccagttttctgaattatgtagaaaacaatttctaaattccctgggtatattttcctaaatcatatatgggtatatgtcctcgctatataccataaggagggagtccatctcagaccacaaatcactgagccatgggcaaaatcagctagaacatttatcccccagaaagacacagtcagactccgagaatctcatggaccaacgaaagctgtgtccactttgttgttcaggactgcttccacatagcattttcctgcatccattatgaagatggtcttatctgttctcagcaagagcctggtgcctggctttgtggcagcattaattctgatcttcagtgtcaaagcaaccagcttgagttcaagcatatggctaattctgagattcatccactggatacagaaaacgccagagtctcatggttactctgttgctagcagtaatgaacttgagcagggctcctgtttctccatcttcttactagacaagggcagagttacatcaaggtggggtgggaaatcatttcttctaaaatattaataacctgaattcctttctataaaggagaaccctcggatctcgtaagattctctcaccaaagcatttcaaccccacaaaccaggcccagcccctctaaccagacgtctgttcactcatgctccttcaagatcaatgggaaaggggcaagaatgaaagggaccctgaaagaggtctgtttcatgggaggggaaactggaagaggcgtgggaggaagggtatccaaaaatgactgatcagtggaaccagaaattttgtctttcagggttatctgtcagaagggttggtaacaaagtggtaccgttccccacgactgctcctttcccccaataactacaccaaagccatcgacatgtgggccgccggctgcatcctggctgagatgcttacggggagaatgctctttgctggtgagttgctaactatgccaccttccttctcatctggcgtcgttccatagaaaggggaactgagtgcaaaacacttacaatcacaaaacatgctcatcttttgctgaaattacttctgtggcttttatgacactatttggaggcaccttattatattgtcaggcaaaaatactggagaggctaaaaaaatagtagccttttgagcacagaagtttttgcaatcaagtaactactttgctatgacctaaatgcttgtgttcccctaacattcaaaggttgaaatcctaacccccaaggtgatgctattaggaggtggagcctttggaaggtgattaggtcatgaggatggagccctcatgaatgggattagtgcccttgtaaatgaggctggagggagcttgtttgccacttccactgtgtaaggacacactgagatggcatcatctatgaagtatgggcctctcaccagacaccaaatctgccagctccttaatattggattttctagcctctataactgtgagaaataaatgtttgttgtttatatgccacctaggctatggtactttgttatggcagcctgaatggacttagacacacttctactcaaacatcttgagactgatggctgcaaacacacccaccctacatttttagccccttcctcctccctccctgccactgttccctgtccttcggccacaccaagtgacccactgttttcctaatctatcatcattttttgttcactttggcacaaagacctccttctctgcttagaaaactcctagtgaaccttcaaaacccagcttatgtcttgtcctccatgacgtctctcctaattccccagggcatgagtcatccttcttggctctcccattgcacttcatactcattctcgcactctccctctttgctaggaagagcacttgctctcttcactccctctcttccattctctcctcactctgcagcatggttcacgccccctccatctgtctgaagctgttcccacccaaactgccgtgttcttaatccagggaacccatttcagcctcattctgtagcagtagtcagcgacgactgtcacctccttcttgaaaccctcttccctgggtctcctcctccctctctggcaatcccccctcagttgcttctcacccaccatgagctctacttcctctgcactatgtccctcagcccttcccaagtttccacactcagccctaaatgctgctgtcacttactcaaagaattttcatccatcccctccacccaggctaactttgtagaggctggaagcccagaaatgttccaaaccaccgttggtagaggaccatggtgaggccagtctccacacgctctggctgcagcatgagccccgtgggcctgcctccttgccacctgtcctctgcctggattccatgcccctacagaactccgggcctcatatccggtcctcctggctgacctctcttctcagtgcttgcagccccgccctgtcctcctaaccatgctgtcttggcctcagcctccctgtgagtgctctccccacctcctcagcctgccctgcttctcctcaggggcaccgtctcccctcagctctgttgagttgaggccatcctttctcccatgccctgtacacagagcgggatagagcctctgcatcctccttgctcaccattgcttgcctgctattaacaaagcagccctcctctgtggcctaccagatggcccctcttcttctctatcttgtcctcccgtgccagcacctcatctcatctcccatcatcccccacactgaggctgttggcacctacgtcatggcctccctctccacaattggtcccacatcattctggctgtgaggctgatgtgactcacttatctactatcctgacacagagccccacatcctcagttcctgggacactcactgcccttgttgtcagcctgtcctccccacatccaccctggactttgtgtcatcacccagagctgctcaggggaggagagatctgaagcgagtatcagagtggcagacgctggggagctgagtgtccagggaatggaaaagggcacgaaagctggaaggcctgagaagtacccacccacctccttgcttgatcatgactgcagtgtggcccagggggagcgtgttttctctgggcaatcagcttacaggaggcatggccagcactcatggcctgcattggtaggcctaggctcctggggctaccccacccttccatgttgggaagggagggggagagtgagggagtaggatagccttaccccagccccctttcagaaccccaagacctagtaagattccccccactaaagcccctgaatcccacaaaatataagacagcagtggcccttctagtatcccctaagagcaaaggtgtgtccttagcatccatgtgggctccctccaccctgaaatctctgtctacaaacctgagcctgcaagtggcagggctaatcaagattccctgtggccccacggggagccgacaatctcagttgctggcctgttgttcttgttcactgtagagtgaccacatatgggcagctggtgtaataattagctcatgggcactgcagaccacctaagcccacaggtgaaaaggagctgcccactcacctgtcaaagcccctggctctcacagctgctcatctgctgtgtgcacagaacatagtgctaaggatggggagagggattgctgtgggacaaagggacagtgaggaggcagggggagaaagtcagacaagggcctctccagggaacttatggtcttgagacagaattttagatgccagccctagaaggggcccaggacagcccacctcttttttaacaggtgatttggtttcaaataatgcagggtgggaaaatgagcccagagaagaagaaatggctaacagtggcctttctgagggaacaccagcaggacattaagagaaagccatgtctgaatagctaagaaagtctttattgtgttttgtttttgagacagtctcgtgctgtcccccaggctggagtgcaacggcatgatcttggctcactgcaacctccaccccccatttcaagcgattctcatgtctcagcctcccgagtagctgggattacaggcatgtgccaccacacccagctaattttgtatttatagtagagacggagttttgccatgttggccaggctggtctcaaactcctgacctcaaatgatccacctgcctcagcctcccaaagtgctgggattacaggcatgagccactgcacccagcctgccaagaaaatatttatattgggcacagttaaatcttaggcaccataggagcagatttatctaataaggagtaatgagagacccagaaaatgtaatctctcaatcacagcaatgagggaattattcagtgctatgctgggctagtcactctttcattcatgatgctaacttcttccagtaagtatttaaaatacatgctatatataaaacatatattaatatgatatgttaatattaattatatgttaatgtaacattaagtaacaagaaaaggtaaaataggttgggcatggtggttcatgtctgtaatcccagcactttgggaggccgaggtgggcggattgcctgaggtcaggagctccagaccagtctggccaacatggtggaaccccgtctctactaaaaatacaaaaaaattagctgggcgtggtggcatgcacctgtaatcccagctacttgggaggctaagacaggggaattgcttgaaccaggacggtggaggttccagtgagccgagatcgtgccactgcactccagcctgggcgacagagcaagactccacctcaaaaaaaaaaaaaaaaaggtaaaataaaaacaatggcaggaaagtcagatgaagctgaagtcagggcttatgtccaaacatttaggccctgagtacaaacgtcttcatttgccccctggactctcaggagcccctacagttttccctctggtggattttgtgctttgggtggatccttgaccacgtgctggggatacaagtctgagtaagacatagtctctgtcctcaaaggtctgatggtccagcaggggacacaaaagggttaaaaacaaaacaaaaaaaaatacacagtgaacctatctgtgcccagggtgagccatcctgctatcttatttttccaactgaaattgcacagacctcccagttccgtattttccagccaattcaaggcaggggagaaaggaggaacaggtgggagggaggtctcgccctggactctgactcaaagactcttcccaccctagccatagccactaaaccctggatggctcaacatctctggccctgccaccacgatctgggtcataggtgcctggctgcctccgttctcccagccttgaaccctcagctcacagggctgtgctccagctgcccttccaacaggctgacaaccttcaggccagacggagaagagctgggcttctccatatcacagcaggcaggtgactcactgagagcccagacgagactgtataatccacagtctattggcctctcatcttcaggctcactgtctgtggtcacgagatggtcgcaatcgctttcaggttctcatgcagaagtgtccaacgaagaaaggtagggaggggtcagccagggcagccaaacagctctcctcacatttctctcttaccagggaggaacaccttccccggaagtccttccaggagattcctgtccctgtttgattgaatcacatggcctccccttattgcaagagaggcagggaaggcaacagctggtgtgacatggaaaggaccttctttcagtaggaaagggacattgaccatagtatcctccatgcttcacaccttctcccattttcagtggtggcttagtagactcagtgttaagatgcctcccccaagtgacgtctgtcacaaagaatcactcacggatgattaggacgtaaatccccaaggtggaattattccatcagcttctctcaaagccactcttccccactcctagaagcaaaggaagtcaagagttattaaacatctgctacaagcaaggtatttctcccggagccttcatctgccaacacacttgactccttataatactcattccaagtataaataatcatcctcattccacaaggggtgggggagctaggtctgcctccagggctgtctgccaccaaagctcttgctttccgccccaggccatggattcccagggaggccccactggctgcctcccatatgacaccattgatctcgggcaggagcagacaagtgaaagaggctcattctctgcccccacccccgctgtggttgaagaagctactccaagcagaaggttgtgtattactagtttgtgtgtcacacaggagaggggtcaggggcttgggagcaaggtcccaccatctctgtctgcagcttgatcacccattgacctcatggtcccctggtgggtggtgtggagtacacatttggagagaggaccccacagggggcttccagagccctgaactgacccaatgagtccactgcagggagaggccaaaaggacctcttcaggagagagcctgaggctgcaggcacttcttcggtcagtattcacatgtgcttagggccacacagggaactgtgggggcacctgggagagccctcatcctaggctggatgactggaagactggaatcccatgggaattcatggcaaggggagggccctctgtgcagctggatgggcagggaagacttcttgaggaaggagaggtatggctgaagttttaacctagtacagctaagtggaaaggcaactcaatcaaaaaagagaaaatggaagtacagaagaacagcctggaggtcagagaaggacagcaaggagacccatctgtccagagccagaaatgccatacggtggccagtggttgtctgggtgtgggaggtgagttgagtttctgagacaaagactgaagcttcttatgaatgaaaactatgcctcaccgattcccagcagtcagcgtgatgcctggcatggagaaggtgctcgataaataactatttatggaatgagggaataaatgaatgtttgagtccatcctgtcccaccaaagtgcccctgcaaacctggcatagcctggcctgccttccttctcccaaggatcacagaggccatgtgctcaagatacatcccaaacccaatttgttattcctgatttgtttttctcttgaaagtttcctagatggaaccctcttaattagaaaccaaaaggtatggctcattcccagccttaaaactgtttccttccccatcctagtaaagattgtgcagagaggtctatgggaagttgcacttggaaggccttgagccaggctgttcccattctttagtgctgacttatatccagctggtctgagacacagaatgctaggggaatagatggggccttgcagactaccagattcaactccctttttctacttttgacaaagccaagccccagagatgtcagccacctgcccacagttgagcagcaaatgaagaccagaaccccggtcccagcccagtgctgccccactgccctgtgttgtccctcccagaacacctggcactgcttttgggctactgcacaccacagccccttggacagcacacttaaccatctggcattgcctccccaggggcccatgagctggagcagatgcaactcatcctggagaccatccctgtaatccgggaggaagacaaggacgagctgctcagggtgatgccttcctttgtcagcagcacctgggaggtgaagaggcctctgcgcaagctgctccctgaagtgaacagtgaaggtacctgagcctggcagccaggccaagtgtcctgggaggatgagctaggctccaccttgcggggtagggggcaggcaggtctccttccaaaagggcaaagcatggtccttggatataaaagtcaaggctcccctgccagtgggcctttgccctaactacttccaagctgtggatgctgggcctcaggagtccattaggggcagtcattagtgttctacccttgtttctgctgccttttgcttctcatcttccttgctcaccttcctccctctctttccttcatcctccctcacatttttgtcctggaaggcttggtgtgctgcaaagaacaggagcttcctcagcctgagggcaagacccaggtcccattccaccagtgatgagctgtgtggcctcaggcaaggaccgcccttcactcctcaggcttactccctctactgtatattcaaggctcagcaggcctgggaagaggccaaaggctctagctgcctctagctctcagaggctcaggagacccagtctcggtgacagcatccctcagcagccgaaacgtccatcttgtgacaggtgcagaacaagggaggcaggccccaagaccacactgggggcattaattctgagctccatttattacaggacagaaatagaccaaaggtgatgaatctgatgacaaaaactcaggtgcggcacaggtgaaaggcgggctctggatgaagcagggttgaggggctcagtgtcctgcccacctgcctctcaatctccagacatgctcctgagaacccttccagaacccctggggctctgagcagctcagtttggaatccactgggccagaggaaggtgacaagattgtacagaagcttcattatctaagaaatgacttaaaaacatccggggagggtgagcctagggaggaggagtttctgaggggcggtggcttaggagttaaggtgaagcttgtacagtagcagataaccctgaaatctccgtggcttaacccacttacagtttattcattgtttacttcacatccaggcagagttgggagcatggatgggcaggggaggatgagtggctgtgcccgggacccaggccatcaggtctgccatcttcagcaggtggctttcaaggtcaccttgggcattcccttccagccaaagccaggggaagagagagcagagactcttgcaggaggtttttctgggtcaggcctggaagtggggtacacacagcacttccacccccattccatcagccccaggcacacagccatttctcactgcaggaggggcttggaaaggcaggtcagaagggtgccaggatggatgtcacatgggacatgactgctgccttgaaacagaagaggggaaatcgtgggacagagaggacatgctgctttggggaaaccactgaaggcagaggtaggccctagggtagaagttaaagggggatttaagtttgataaaaggaagtattttctggggcaggtgtggtggctcaagcctgtaatcccagcactttgggaggccgaggcgggcagacctcttgagcccaggagtttcaggccagcctgggcaacatagggagaccccatctccactaaaaatataacaaattagctgggcatggtggcgcacacctatggtctcagctacttgggagtctgaggcaggaggatcacctgaacctggaaagttgaggctgcagtgagccgtattcccatcactgtactccaacctggatggcaggagtgagaccctgtctcaaaaaaaaaaaaaaaagaaatgaagaatttcctagtgtttgggcttcccagaagtatctggggacctgcaggaggatcagctgtcagggagagggaagagcagattttcatccgtgatggagtctgtggagcagctttggggttggtactcgactttttttcttttgcgacagggtctcacttgtcacccaggctggagtgcagtggtataatcatggctcactataacctcagcctcgagggctcaagtgatcctcccacctcagcctcccgagtagctggcaccacaagcatgcgccaccttggctggctaattttaaaattttttttgtagagacaacccactactggcccacctggccaactactactcgtcttgctagaaacaagcccagggtgatctcaaactcccaggttcaagcaatcctcctgccttggcctcccaaagtcctgggattacagatatgagccactgccccagtggtggtactcatcttttttaaagatgatactgcctgcctcaatctttacagctttaattctctcatttccttgtcaaaaggtcaagtcatggctggggccaaaaaaggggccagaggcccaaagagagaaaaacctgcccagacttgaagctgggccccgcactagactggcccgattcttccagtcctaggaatttgtcaggcagatcctcttttaagtttgcaactccagacccagaaacacgctctgagcatcagactgttgggggtgatcagagttactgctgcttaactaatttgggggtctagggttacactgcagcactgcgtcctcctgggaggccagtgaccttctgaatccatcgatttcctcaatcactgatgaattttcttgcaaagagatacagggctggtgtgaggggcaggttaatggtgcaggctgaggcccacgagggagctcctcggagggatgggcagcctgggccttgagctcagctccatttctccctctccatgtgggctgtaacatgaggagccaagtcatgatttaagcggacctccagagatgccagtgctgagaaggaatccaaacttctaggctagtccttgcgctgagataacccagggcagagctccaagagcagagctcccagggcacccacccctgctcaagggaagggccaccagtgcctgtgtgcagagctgctatctgctgaattttggcatacattcatgctggttagcaaacagcctctcgcacaaggcttctgagtgtcccttcccttccccaggttcccactgcccagaactcccccttgatccagacatgaaaggactactgcttggcagagcaggggaattcagcctggttgttcagtatctgtaatatctatccatccatcaaggctgtctgcctttgttgaacttccaggggcagcatatggtaggaagagctctggattcggacccaggagctctgggctgtggagaccctgtcccacccctcgactgcagcattcccctttctcactaaggctttttactgctgcacctggcactccagcctcagggcttcctcaggagcaggctcctccgtcccattccagcagccccttaagccatgacaaagggaagttggtatataaatatcccagcttccctgccccgcaaggggaaccacctctgagtgtggcccacactgtctctggaggatcccagatgcccacaggagtaacctgtcatgagtgtgccttgttctggttccccctcactcccccacctgtgcttgctgggatcccccaccacataaactacctacaaccctaagccttgtctctggttctgtctctggagaaacccaggctgaggctggaccttgagcaagtcacttgatcctctgagtctgtttaattcatttacaaaatctagaaggcagcatctgctttgcctttgtcactggattgtgacaagggtcttgagaaagaaaatggctaaaaaccttttaacaaatgcagaagcacagacaccagcacagaatgtcaccgtgctgaggaatctccttctgagctcaacaagggcaacaaatgaccttcatgtccggctttgctccctgcagccatcgactttctggagaagatcctgacctttaaccccatggatcgcctaacagctgagatggggctgcaacacccctacatgagcccatactcgtgccctgaggacgagcccacctcacaacaccccttccgcattgaggatgagatcgacgacatcgtgctgatggccgctaaccagagccagctgtccaactgggacacgtgcagttccaggtgctcgcagccctgggttccagagcccacatttccctgtcctcccatctctattttgcctctaatcctccgtgaccttcccctctgtctcccaagttgcatagctcattggacgacttctccagcttagcttcctgcctttctcttgtgcccagacactaccagtaaatgaccagtgtgagttgcatgtgtgggtcagaggccttcctttgtgcaacacccccagcttccctcaccatgactctactgaacatggggttcaatacagtgctccgcaaggatttagtgaacaccatggtaggagctcacttctagcagcctgggaacttgcccttgaaaagtaaactgcaacaaggcgaggcaaaaaaacaaagcagagattaccattacaaaacgctatctcatgtttcatgttggtaactcttaaaaatgccattaaaaaccaggttcggtggctcatatctgtaatcccagcactttaggaggccaaggtgggaggatagcttgaggccaggagttccagaccagcctgggaaacaaagcaagaccccatctctacaaatttttttttttaattagccaggcatggtggcacacggctgtagtcccagacactgggaaggctgaggctggggaatcccttgagcccagaagtttgaggttgcagagtgagaccctgtcaaaaaaaaaaaaatgccattaacgggggctacattattattgcccattgacacacaaggaagcttcagctgcaaggttaagagactggcatcatgtcacacccctgatgggcctctctgcaatctgcatccatgtcagacgctgctaagcaattataggaccatttcctgctaaactgggcttggctacagaatcctcaacaggtgtccctggaagccactaccaatgaatcagcgttgggtagaagatgtatttttaaacaatttctgcctaggcacgtaatgatctcttagatcttttcctgttctgacgttcttagatcaggcagctaaacatttgggcatcaccatctgctaattctgggagggagtgctggtagctgctcagtttagaaacagcagtcgagggctcaagcagctaggactccgagggggcctaactgggagtcccactgccgggggaatgtgacagctagttacataagtgacagatgagcaatttctcctttttagtcatttgacagatgatgggtttcagattaaggaggcactgagggagggccagggcgacgctgctatttttggacaggtttgctggcttgttgttgtcaattgttgttttcaagcattgccaacaaatagagattaatgaagactctgtcttctgccacccctggggcagccctgcccttgactgtggttcctgcggcagcttccccttcctccagagagcctggaggcaaagaacattggctcagggagagtcatcctatactttctgcgactgtggcatagggttgtgccaggaaaaactgtcacaggatttgttgctgcctgtccaccctgaccacccctaaacctggtgcacctcacctgtgctcccaacctttgccatcacacctgcccaagggaagaggatgacaaaggaccttcttgctgtgggcaagctccttaccctcttggaatgctagtttcccaactgtaaagcgggggtgataacacaaagtcccacagggttgctatgaagactacagataatgtatgtttggcacttggaatagagcagccaagggtcagcgtcttcacacactcttcctcctggaaatttctgcccaaggccactcaatcaaggaggcagggttcagctgtaggagcaattcctgccctagcagcgtcactgggaggcgggcagtgctgaggccttcctgtgcctctccagtcacactctgtgggctacagctgccaggtctatcccacacagccgaatctgcctctccttggtctatctgttgggcctgctcagggagtagctggctgcaggctgatgtcctctgtgctcctgcctgccccacaaccccagggttctaggtagagcacccgcacaaggaagggagggctccgccagagctgatggcctgcctgtctgcccatctgcccttcatttgctcttggctagctgacttcactctccatggctgcagagcagtcgaacggggcagaatgccaaagatcttcagcttctctggagggtgtctgtaatctttctgtaggtcccacctgccctgcgtcaatgcaaggtgctatggggcccccaagcagatccaccagggcaggggttctcagccctggctgtacttagaatcacctgggggatcttcaaaacatgcttaatcaggtccccaccctagacctactcagtcagaattggtggggggaagcagtgaggcagacatgctattttatttttaattcccctatgtgactctaatctgatccagggttgagaagcactcactggagccttgctcctcaaaatgtgggtccaatgcccagcagcatcagagcagctgggagcttgttagaatctcaggccccatctcagatctacagaatcaacatctgcattttagcaagacccgcaggtgattcgtgcatctatcagcttttgagaagcattgcacaggtggatcccctagaaagtttcacgaggacagggacgtttgttttgttcactgctgtattcagtaatgtctggaacagtgagtgctggcacatggtaggtgcgcaggaaatatctgcagggtttcgaatgcgtacaaaagaacacaagagttaagccgaacaatccatgtccccagctgagcccccaaggctcgccattacctgtccatcaccctcccaccttgagggatgggggtcgaaggcaggtgtgtgagtggcaaacagggattagagggcttggctccctcccggaagctacctggcttgggcatccaatcaccgctctgtttgtacccttgcaggtaccctgtgagcctgtcgtcggacctggagtggcggcctgaccggtgccaggacgccagcgaggtacagcgcgacccgcgcgcgggttcggcgccactggctgaggacgtgcaggtggacccgcgcaaggactcgcacagcagctccgagcgcttcctagagcagtcgcactcgtccatggagcgcgccttcgaggccgactacgggcgctcctgcgactacaaggtggggtcgccgtcctacctggacaagctgctgtggcgcgacaacaagccgcaccactactcggagcccaagctcatcctggacctgtcgcactggaagcaggcggccggcgcgccccccacggccacggggctggcggacacgggggcgcgcgaggacgagccggccagcctcttcctggagatcgcgcagtgggtcaagagcacgcagggcggcccagagcacgccagcccgcccgccgacgaccccgagcgccgcttgtctgcctcgccccccggccgcccggccccggtggacggcggcgccagcccccagttcgacctggacgtgttcatctcccgcgccctgaagctctgcaccaagcccgaggacctgccggacaataaactgggcgacctcaatggtgcgtgcatccccgagcaccctggcgacctcgtgcagaccgaggccttctccaaagaaaggtggtgagggcggaggggccgctccaggccccacagagcaggagacccccagagaaagccggggctggcaggaggcggccgcccttcccgcccctctctgctgccttggggttggcagaacacgtgaaggatccgaggagcgagaggaatgtccatttcttaaactgccttaataactagcctttaacctgtgggagcgggtttgaacaggaccctggcttaggggttgatcactttcctagcaaaggggagaccacatgtggtgcacagggaagaaacggctttagacagcagtctgcgggccccacctgggtggcaggatgccgagaaatcttgcagaggtagctccgaaaccatctggcccaactagcctcaactgacagctgaggaaaggcaattaggcccagagaggcagagacactcgcttaagatcacaggcttagtgtgaggacgagcttgaaatcccagtctcctggcccccaggccagggtctgtccaccatagaatgtcttcctctactggggtcgttctggctttttgttagaaacttggtctgagatgtttcttccctgtccattaccattcgatgttcttttattcagagcaatgtttcttgtattctgaaactggaaactgaaccagtttgtttctcctagtcaccaagcatactttcctggctccccaagtacttaaatgttctcatctgtcgcacccctgtatttgcctcacccctgcatggtcggaaatcttcgtttcaggtcagaacagcctggggtctgtgggtaaaatcagcccttctcccaggcctgtgcacacaccccctcagcactccctatgcactttcctgacacgcaaagacacagccctctttccccactgggcgtcctaccccagtgaggttgaaggcaccaattccaagaatccctccaacctccctgccagcactcccccttcaccccacacccggcccccccacctaaccacagcgcctctccagacctacctcgggacctaatgttctctacatgaactgctcatttggaggacagcagtgaggtcctgccatagagcaaatgtgttaggagagaaggtttcacatgggacccaacatccttcatcaatactttcctgagtttgatcatccatttagccttgacaaacagcagaccctacagagatgtgttggagagcacgtcgtgaccttgggggcaaggaatccagaaaggtaggaagatatgaaaagagaggtgtcaacagcaagggctcttaggggtcaggcaccagcatggagacctcatgacaaaggaagggactcaaagcagcaatgcccctcatagtgtaggctaaggtgagtttggtgcatgcaaacctgtgtgctcacccacagagcatggggtaatggtgtgtagacacaggccctctgcagaagcgtggggtggggacactgacagcccctatctggtccccaggaacattctaccatttctgccactggtgttcagctccttctcttcccccaacactcccaaagatacccacaggaagtccagccagtttccaggtagaggattccaccagttggtcttgggctgcgttcaccctcacatcacagcaccttaaatctaatcagcaaactataatttgtacgttgaaacctgcaacacattagaaacttatatttaaaaacagaattaatcacactgaccaacttttaaatggaaaatatgtaaataggaagtgtttgggttttgttttttctttaagaaaaagaaatgtacaccactcctcatgtgccattttgtcctcagagggcggctttacttttttggtaaaggaacaagctgctggccttgaccaggagttcatatataactgttattacagaggaattgttataactactaatgtttttaaaaaatttattaaacattattaaacttgatcaggtcaggccaaataaagttttattggaacacagatttatttatgtattattcatttatgtattatctgatcctgtctttgagagtgctaagagcctagctggcttctccctgtgcccatgaaggccactgtatttgggggtgggggaaggactcgggaggggacaatctacagagattggtaatcaggaggtgattccagaatcatctggtgagacctggtgtccatattgtgaatttcaaactatatcttggcgctaacaccaaaacttctgaccagggctggttctctcctctagtcacaaaaggtgccaacatcatgagattggggggaaccaactacctaaaaatacccacccgtgctacccctcacagatgcctgagatcccatccatctgaagtcgacccctttgtaatattaaactgttagtcttcatttgtaattcaacaaatacagttgacccttaaacaatacaggtcttttggctaaaagaactttctactgttgaaatgcacctgagccaagaggagcagcctattaagccaattatcagattatttccaaagtgtctgctgagcgtggccatgctgagtggatgcaggtgaagggaggccagagccaggccacacacctggttgaaattttatattgaagaagacttgaagcccaatgtgaggcctgggctgctagaatgtaggaaatggagtgtggagagagggaattgagaagcacaaacagcaaacagcaccaaagaggaaggaggaccgaaaaaggaggaaagagggcacctcaaaggtaatagttcacaatctcatccagccacctctgattctaagatgaaaacttctgttaggaggggtcctaggtctaccctatgtgaataacatagggatcagcaaactatggcctccaggccaagtggttgtattggaacaaaactacgcttattcatttatatatttgtctgatcttgtctttattttatttatttttatttatgtatttattgagatggagtcgtgctctgtcgcccaagctggagtgcagtggcacaatctcagctcagtgcaacctgcctcccaggttcaagcgattctcctggctcagcctcctgagtagctgggattacaggcaccccctccaacacgcccagctaacttttgtatttttcatagagatggggttttaccatgttggccaggctggtctcgaactcctgatctcaagtgatccgtctacctcggcctcccaaagtgctgggattacaggcatgaaccaccacgccaggcctctgtctttactttaaattgtgatattttatatcatggattttttgcaataatattttttaaatattgcattcaaatatttatcttggttaccgaggctttcggcacccttaaattttgtgcccaaggcaagtgtgcctcactggccctcaacctagtcttagccctcatctatggctgcctccatcctacagagttgagcggttgcaacagaaacctcatggcccacaaagcctgagatatttattacctggccctctccagaaaaagtttgctgaccccttgtgtaagatgctatgtggcctccacgtctttgtgaataagtacacaacttgccttgtcttttctagccactgacattccagttcagaaatgccacatttccatgacattttctaattacacatcctattttcatgacatgattgtctcattacacatcctcgtttactttccattctttagggaaatgtcttcatttgctagtgagaagtttctaaaagtgtgggaaccatcctacttgagctgaggctgaggggacattatgccagaggttactaccatgattagaaaccaggctttttgctaggatggttagaacaggcaaaagctcgacttgaaagctgtggttctcgattgaactagtaaactccacatggagagggaaaatgtctgatgtccccaactgctcgattatgagtcaaactgtagcaagggtgtgtcaaacagcatattctcttc

SEQ ID NO: 634 - DNA, 9428 bp, Human
gctaatttttgtatttttcgtagagacagaggtctcagtatgttgccccggctagtctcaaactcctgggctcaagcagtctgtcctcctcagcctccaaaagtggtgagattacaggcatgagtcgctgtgcctggcctccaagcactttcaaatgtatcaacttaatcctcacaaaaccctgtgaggtcggtactgttttcatacctattttatagttgaagaaacagacacagagaagcaaagtcacttgctcacagtcacgtggctaggagagcaaggatctgaagcaaggcgatctcttaattaccaagtgatgttcctggagtaaggctctgtttgtttcctttcctgtaaaatgctgcatgcaaaagtataacacagtaagtaaagaagtcagttagcctgcacatactaagacctaaccaaaggagcttattgtttttctccaacttccatgataggtaattagatagtggagacctctgctggccaatatggtagccactaaccgcagctggctcttccaattaaaattacataaagccagaaatgtaactcctctgtctcacttgttatatctccaaggctggatagccacatgtgactggtggtggctggattagctagtgcatataaaacatcactgcagaaagttcagctgagcagcactgagttagatggcctctgaagaggatgtcccacggagagaatccagaactcaggatctttttttttttttttctttgcgacagagtcttgctctgtcacccaggctggagtgcagtggcgtgatctcggctcactgcaacttctgcctcccaggttcaagcaattctcctgcctcagcctccctagtagctgggactacaggcctgtgccaacatccccagctaatttttgtgtctttttagtagagatggggtttcactatgttggccaggctggtctcgaactcctgacctcgtgatccgcccccccttggcctcccaaagtgctgggattacaggcgtgagccaccgcgcccggccagctcaggatcttttgggatggtctgttcacctcgcagaagtggctggcatgagcaataggagcccagagtggaaccagggccttctggttgtcaagtggacttgctgtgtgacctcctgtgagtctctgccctctctgagcctctcactcctcacctgagatgagggagttggctgaggtgatgccgatgcccctcacagctttgacctcctatgattcaggggcctgtgtgtcacctggtggcacacagatggcagggagggtgtgagatggccacacatgggtatgaggcagagccacagccccccccaacacgcacatgggctagtcactgggacacacacagagctcactcacggccacagagtgggcgtgggtttccctttttccttgtttctgtttctcttagcctcggcgcctccctccctccctctctctctctctctctctctctctctctctctctctggctcttttagccttggtttgttacaatctcccttttcaagccagcctctgtccctcctactcaacctgctttatctctaggccttcctccttcctcttccacagtctggcttctcacattgtcactctaggtatgcacttcccattgatttcctcttgctcagtggcctctcatcctgccacccctagccttgctggggacgtgaaccctctccccgcgcctgggaagccttcttggcaccgggacccggagaatccccacggaagccagttccaaaagggatgaaaagggggcgtttcgggcactgggagaagcctgtattccagggcccctcccagagcaggaatctgggacccaggagtgccagcctcacccacggtacaattagacagagggaaagggagggagcccgggggtgggggtaggggagggtggagaagcttccggactccttggggttaaaagggaaggtcccgccaggggtccctgggcagaggataccagcggcagaccacaggcagggcagaggcacgtctgggtcccctccctccttcctatcggcgactcccaggtgaagctacctgcaccccacccgggttggggtggattgcgagaggatgggtggggacccccgggccacaggcaggagccggcttagagcctcggtttctccacctgcgggacgcggaagtccccccgctgtgaggttgagaaagaggctcccactggctccgagcctcggatccccaccccgcgcgtgaaggagggggaaacctcgggcgcggcgtggctgcagccagggtagctggggcgcggagagcgctccactcgggcacagggaggacgggaagatgccgcgaggggcgtcattagggtaattgtgcccattaccgctgttccagcccgaatctcccgtctgccagcccctggggttatcggctgcaggtcaaaagggtgcttgcgggctggggtggcccaggctgggcggatgagcgcggcgaggtgggggtctctaacggagcatctgttttaacccgcccctgcacacaccccagcagatcctggccatgagagctccgcacctccacctctccgccgcctctggcgcccgggctctggcgaagctgctgccgctgctgatggcgcaactctggggtaaggtcgggggcagggggcggggagaggcgccggtgggaggcacgggcgggaggagaatgtgttcccgtcaccaagccccgcgcacctctcctcccccgagaccccagcacccacccagcgctccggagcacggcccgcccccaagtcagctgggcccttcttctggctcggcccctgggtgacccgccccactcaggccctgtccgatttctgccacccggatcctcgctcttccgtggactcttcgccgcgttctttctcctcctcttacgccgccccatcccggccccgctccattttacactaccgtgttttgttttgtttgtttgtttgtttgagacggagtctcgctctgtcgcccaggctggagtgcagtgacgcgatctcggctcactgcaagctccgcctcccgggttcacaccattctcctgcctcagcctcccgagtagctgggactacaggcgcccgccaccaagcccggctagttttttgtatttttagtagagatgggatttcaccgtggtctcgatctcctggcctcgtgatccgcctgcctcggcctcccaaagtgctgggattacaagcgtgagccaccgctcccggccacaccaccgtgttttatcctgagtcttgccttaccgctttttgccctctcccctcactttttttcttcctctttccctttctctctcttttttctttttctttctttcttttctttctttcgttcttcttttccttccttcctttccttccttcctttcgtttgtttcttctttcttgttttactttctctcttattttttcttctttctttcttgtttttttctttctctctctttttctttccttcttttttttttttttttttttttgagacagggcagtgctctgtctccgtggctggagtacagtggcccaatcagagctcactgcagcctcgacctcctgggctcaagcgatactcagcctccagagtagctggtaccacaggcatgcaccaccacatccggctttttttttttttttttttttttttgagacagggtctcactctgtcgcccagactggagtgcagtggcccaatctcggctcattgcaacctccacctcctgggctcaagcgatcctcccacctcagcctcccaggtagctgtgactacaggcgcatgcctccgcgactacttttttgttgttgttgttgttgtttgtttgtttttgtagagactgggtcttgctgtgttgcccgggctggtcttgaattcccgagctcaagcggtccaaccgcctcggcttcccaaagtgctgggattacaggcgtaaaccactgcgccccacccctctcctggttttcaatcccgttttgttattcacaccccttcctctccccgatccccgagttctatccccgcacccttacctccccgccgcgttcaatccccgcccctctatcgaccagcgacgttctagccagctctccaggcgcgctgcgttcagtccctgccctccagacccaccctattctgtctcattactccacgctaccctatcccagcttccttccactttcacgcgcttcttctcctcccattcccttcggtgcacgcgaaacccccaatatttccctaccaccctcgcgttctggctgcgtcccccgtccccgaacgcagtccagtgccacagcccagctccaaccccaaacccagaccctgccctccgtgctttgattccgtcccctttctttctccagccgcagaggcggcgctgctcccccaaaacgacacgcgcttggaccccgaagcctatggctccccgtgcgcgcgcggctcgcagccctggcaggtctcgctcttcaacggcctctcgttccactgcgcgggtgtcctggtggaccagagttgggtgctgacggccgcgcactgcggaaacaagtaggaggagatccatccccgaggacgccacggggggctgtggaggcggcctccagggaggagcgggcagggcggggtctctcggaactcccacagctggaggtgcggtccccggtgtccttccagcaggaggagagaccgggcttgcgctgtggccgccagggggcggtgtggtccttttccgcatttctgggcccgtcactcctctcccgctgattctccttgagctctaggaggaggtggttgcctgcaacggatagaagccagggtccggtgtggtcaggaatttagaactaaaggaaaaggttcacttcgtgagtccccgttgaaggaggaagggttgggtattaccacagagaaaatgtggagttgggctgggctcggtggctcacgcctgtaatcccagcactttgggaggccaaggcgggtggatcacctgaggtcaggagttcaagaccagcctggccaacatggtgaaaccacttctcaactaaaaataaaataaaataaaaaataaaaaattttaaaaaaattaaaaaaaaaaaaaggctgggtgtggtggtgggtgcctgtaatcccagctactcaggaaggaggctgaggcaggagaactgcttgaacctgggaggtggaggttgcagtgagccgagattgcgccattgcattctagcctgggtgacaagagcgaaactctgtttcaacaaagaaaagaaaaagagaaaagaaaatgtggaaggcttacctaggtgtccaggcccccagccctcctcaattcctacagatcctcagagctcaaacaactgattcctcctccccatgtccactgaggtccccttctcccacaaggccctcttccctcagactcttcctatctccaggccctgcttcactgcccacctgctttcccagtccctgtgaagggtttgccttcacatgcctcttccttcccccaggccactgtgggctcgagtaggggatgaccacctgctgcttcttcagggcgagcagctccgccggacgactcgctctgttgtccatcccaagtaccaccagggctcaggccccatcctgccaaggcgaacggatgagcacgatctcatgttgctaaagctggccaggcccgtagtgccggggccccgcgtccgggccctgcagcttccctaccgctgtgctcagcccggagaccagtgccaggttgctggctggggcaccacggccgcccggagaggcaagagctggggctctgaggccggaacctcaggaggagggggctgagggcctgaacccctgggtctgaggaaggatgggctggggactggattcctggatctgagggaggacgggctggggtcctagatgcctgggtctgtgagtctgaggggaggaggggctgggggcctggactcctgggtctaagtggggaggggctggggccaggattcttgagtctgaaggaggaggggctggggcttaggatagaaacggtcttgtatctggactcctggctccccaaggattgggggctggacccagggattactggcatattctcccttcagtgaagtacaacaagggcctgacctgctccagcatcactatcctgagccctaaagagtgtgaggtcttctaccctggcgtggtcaccaacaacatgatatgtgctggactggaccggggccaggacccttgccaggtagggtctgaacagggagagtctctgactcctgggagggaggacagggaggttatgggaaaagagcagaccctgtgcccgatccccaactccattcccaaacccatccttgaccccaactcttacccagacctaaccccctcctcatccctatcctcaatcccatttccatcccaaccccaccccattcccatctccaagcccattttcatcccctcaccttccatgaactacaatcccaaccccagtctcactgtgccttcattctcatcccccagcccaacctcccataacctgaagtccacctccattcctaccttccagctcatacctaattccaaccccatcccatcctcgtctttatcccaacccaactccttccttccccaccactgccccagatcccaaagtgacagctctcacgttggcacatttatttgatctctccttcctgccacccccagagtgactctggaggccccctggtctgtgacgagaccctccaaggcatcctctcgtggggtgtttacccctgtggctctgcccagcatccagctgtctacacccagatctgcaaatacatgtcctggatcaataaagtcatacgctccaactgatccagatgctacgctccagctgatccagatgttatgctcctgctgatccagatgcccagaggctccatcgtccatcctcttcctccccagtcggctgaactctccccttgtctgcactgttcaaacctctgccgccctccacacctctaaacatctcccctctcacctcattcccccacctatccccattctctgcctgtactgaagctgaaatgcaggaagtggtggcaaaggtttattccagagaagccaggaagccggtcatcacccagcctctgagagcagttactggggtcacccaacctgacttcctctgccactccccgctgtgtgactttgggcaagccaagtgccctctctgaacctcagtttcctcatctgcaaaatgggaacaatgacgtgcctacctcttagacatgttgtgaggagactatgatataacatgtgtatgtaaatcttcatggtgattgtcatgtaaggcttaacacagtgggtggtgagttctgactaaaggttacctgttgtcgtgatctgaccacgtcccggtgaaagcgtgtgtccagggaagaagtgcacagggtagcccccaatcccaaccttccatccccaacccttagggatgatggaagaatcattttcctcaccctagttccaagtcccaggaaacaccttttaaccacttccttctcatctcccactgtttcccacttctggttccacccaacaccagttcctcctgccttggcacgagctaggctggccctgagtcattagcaccttttctgccttcatgaggccactgaactcaagggacctcaccttgcttccatcccagcctctaagaccagagggccgagggggtagtgaagattggggaacccttgccacctcaactgcccagcttgtgccaagaaacctccctctgacatttaggggaaaatctttggtttgtctgttattaattggctgtgagattttcgtcctgaaaacttgggaggaggaattgtttgattctccctgaaattgggggagggaaggggagttaatacacagaatccaggtaaggctaatagaagcttcagtgtccgctgggtgtggtggctcacgcctgtaatcctagcactttgggaggccgaggaaagcagatcatctgaggtcaggtgttcgagaccagcctggccaaaatggtgaaatcccatctctactgaaaatacaaaaactagccaggcgtggtggcaggcacctataatcccatctacttgggaggctgaggcagaagaatcacttgaacccggggggcagaggttgcagtgagccaagattgcaccattgcactccatccagcctggacgaaagagcaaaactccatctcaaaaaaagaagaagtttgagtgtctcagcttatcctgaactttgaagaagtaacataagctagctgaatataggcacaacagaaatttcccattaagcacggggtttttgtttgtttgtttgtcctttcagttaccaatttatggagcatctattatgtgccaggcccagtgctgggtgctggggacatacgtaggggtgatcacaaggtcccccaccctgcagagcccacaggaggttgatgtacaatgtctgagcacacagctcccttccgtggcctctttcccattctgcccccattagcacacgcaggaaatgtcagtcaggcgtatcagctgggtttgtcatccgaagaccagaagcgaggtcggtggaaacttgaaaactcgattcattattaaaggcaactcacccgtccctttagtcactccacaatgtttatcgagccacgtcttatgccaggcctcaaagatgaatcagaccaggcactaccctcaaggagctgctagttaggtcagggagacaggccagtcttacattcctgtcattcaggtctccactcaaaagtcacctcctccgggaggccttcctgaattgcccaggctataggagtccacttttggtcatccagtcccgatgctctgttttttgtttgtttgttttttttttaatagcacctgttatacctgaaattatctcatttgtgtttacttgataatggtctatgtcacccttccccacaaattccgtgagggcagtgattcagatatttgttcactgtgattttctaagctcctgtattgtgcccggcacacagaagtcacccccgttgctgtgtgaacacataacacaaatagatcagtgctgtaacagaagggggtatggggtgcaccacaccaagtccacaggctgtgcctgaaggagtcaggaaaggcttctcaatgaggggacatttgtgcaggagtttaaaggataagtaggagttcaccaggtagagaaggaaatgcatttcaatcactttgctgtatgactttgagcaaattacttgaatgctgtctcttcctcagttttcactctgtgaaatggagacacctgcttaattagactcccgtgagagttaaatgagataggctgggcgcagtggctcactcctataat

SEQ ID NO: 635 - DNA, 40975 bp, Human
gcctccacaaatggtggggttacaggcgtgccactgtgcccatccagattcctgaaaatttaacaattttatgagttggtacatgctgactcgagcacacaccactgggaatagttgtgaggaggacagttgagtgctggggaaaggaaggaagaaaacagtgaggataaagttcacatatctcaccagcttttattacctgatccccatggggaggcccatcagagagtgcctatgacctgttacaatggactctaaaaacacttccctactctttcaagtctccctgtgagcattggttacacttccagtatcccattcttatagtttaactcatgaaaaagggcgggatcctccttctgccaatactagttccttctcctcaatgaaaagttagacacaaactccaaaataaaggcaactcccagaatacaacacagccccaattaaattaaaatggcttttatccaaaagacaggtaataacaaatgctgacaaggatgtggagaaaaagtacccttgtacactgttgttgggaatataagttagtacaaccactgtggagaatggtttgaaggttcctcaaaaaactaaaaatagagctaccatatgatccacaatctcactggtaggtatacacctaaaagaaaagaaatcagtatattgaagagatatctgtactcccatgtttattacagcactattcacaatagccaaggttggaagcgacctaagcgtctatcaccgatgagtggataaagaaaatgtggtacatatacacaatgaagtactattcagctaaaaaagaattagatcctgtcattcacaatgacatggatggaattgaagatcattatgttacgtgaaataagccaggcacagacagacaaactttgcacgttctcacttgcttgtgagaggtaaaaattaaaacaattgaacttgtgggcatagagagtagaaggatggttaccagaggctgaagggtagtgggggttggggaagaagtggggatggttaatgggtacaaaaaaatagaaagaatgaataagaactagtatttgataatacaacagtgtgactatagtcaataataatttaattgcacatttaaaaataaaaatataattgcactgtttgtaacacaaaggataaatatttgaggtgatggatatcccatttaccctgtgtgattattacatattgcatgcctctatcaacatatctcatataccccatacaaatatatgcataccccatacatatatatatacatatacacacacacacacacacacacacacacacacacacacatatatgtatatctactatgtacccacagacgttaaaaattagaggagaaaacacacacacaacaaggagactgagctggaaggatggagctctgggatagatttgtcctacatccctgcctgggagggaatccacacacatgcaagaagacaaactaggagcatgggctactaaattataccacattgcactcatcggggtcacagggtttcttccaagtgacccgcacatgcccttcccatctctgtgtgacagtggcacctgcaccagactgcatgttgaggtgtcatctgaaattatgaaataaaacagaagtaagaggtctattagctcatcaaaatgcagttatctaagttcagctgtgaactgccaaatttgaggagtgatccaatgaaacatcttttctttgcaatccaagaagacttaccggagagaactgctcagagaatctgcaacatccggttcctggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgagtgttcatctgcctgatggtttgagtcccatgttagctgccaggaatcagcgtatcttcgtggatggagagaaggtgcagggctgggtattgtgtttggtcactcttccttagggactggctgtcagtttcaactgcctctttcaaagaggaaggaacattataagttcctgggcccttgggtttccaagactcagccccaccaaccccagtttccaaggaaatgaggggctctaagccaaaggctccagtcacttttctgaccagtcttagggtgacaggccctggtagaagtcttgcttgagtggttggttttacatgggcatcttctggcaaagacccagcctagagagactgagctggatggactgagctctgggagaagatttgccctacatccctgccctgggagggaatctgtgcacatgcaggctgacaaaccaggagcatgggtcaacagaaagcattggctagagtgggaagagagagtagaagtgaaaactccaggcttttggctgagaaccagcagtggccacagtgcggtcatactggtgtgtattttcttggaagagaaggtccaagaaagcaagagggaagaagttgggatttctgaaggctagggctggttacagtatgtgggaaatgcaaattgggaaccctcagagagtagctccagcaggaaggccagacaagagctacctttggatctggactctgttcctgtctttctgtctatcttcttcccaaggcaggctattgctttctgtttagaagtatcagggctatgagaaaaggtatttgagaaagaaaaagccaagcaagaagtggactttggactgcctgtgtgagtggggtgagaatctccttctgcttatttgtttagactgtgggaggtagcctggagtagaagaggtggcattacggacacggggggaaatcctgaggcccagggtgttttaagcttggggttttcaagaccgcaaatccaatatggacttttccaggaaaagcaccgtgatatgccagggatgtgggggtgctgcacaatggatgtgtcttttaccagacagccagacgaacagggcttgctcagcccactttcttttggaatctgcagatccatggctcgtacttcccaaggtctaggggaggaagaactgagctcggggctcagaaaaccaaatcgagccactttaagtggtcacagggaaagccaagcctccgttgttgcaaccaatttgtgactgcaccatttctggagcacctcttggtgactgtaaggtgtgatggagtgatggtgctgaactgtgaactggacttttccatctctgtgcttgctagcctcttggccagcctggcccatagcatcttaggcactgctgaccaatagctcgtcttattgaggctttggaagtcgccggtcagggagaagcaacccagccccacaaggcaagtctatccaatcggaggctgctcacttcattgcatgttttcttctttgaatcttcacaaaagtttttcagtgtttttatttttaaatacacacccttttgtgaagccccaataaaacccagacagaaatgctttgcaaatggggcaggttagtcatgacagatttgcccaagcaagaagcttgattcttgtaaaactggcatccactcccattctcatttctactcagctcaacttctaattcccagtcagaattgtaaaaatcaaaaagtccacatgtcccttccccaagtaaagtgaatttttcatttcccccgatgagatttgttttaatagactttattttttagagcagttttaggttcacagcaaagttgggcagaaagaacagagatttcccatatgccctctgccccatacatacatagcctcccctattatcaatatcccccaccaggatggtacatttgttataattgatgaccttatgtcaatgagttttttttattcctccatgcagttcctctgcacccccttcacacactttgggggaaggtgagggacaagtgcgtgggttctagacttggcctaaccttgcgtgttcagtggcccattctatcccaagatgtcaatctaggcacttctatttctcaaaaatattaatactgtgatgtgatgctgtcactttcactgtctccctcactggactggaaatcagagtatcagggctaattggtttaatccatagatttgactttgaatgatcccattcagcaactattaaggacacatgatgtggcagccactgtgcaagggtgcaaggtgtggggaaaacaaaatgaacaacagccactgcccagcacctgacactgtgtctgtactgagagcctgtccacaaatatttgttgagtgaataatactggtatatactgcatacttgccatataccaggcactgttctaaatgctttatgtgtgtcagtcatttcattttcacaccaaccctataagaaatgtatgtattattggtaccattacaactttataaatgaggaaaggggcacagagtagtttagcaatttctctgcgctcacatagctgcctgactccagaggcctcaatgagtaaaactggacaagcctatgtttgggaagcaggggtggagagaatgccaaaatttgtatccaggtcccatggtaaaaattagaatgtgctatctataattgaaaaatatgagttgaattgaattggaataaattgaagtatagaaatgtccaaaaggtgagagactgataaaaatcacagaagaacgtagagggcatataagaagtatttgacctggaatttggaaaatgaaaactttttttcatcatgcaaatgttcatttaatttttttttgttaactagtttgtttattgattatcacatctataaaacatgtcatgtctatgaaacttcaacagtacacaagagtatttagtgaagactaatttcccttccatacctcatgctggaggcaaccactgtgaccagtttcttgtgtgtctttccaaatgtataggtcttcgtgtttgatagatcagtacggtgactatagttaacaataatctattgtacatatcaaaataactggaagagaataattcaaatgttcttagcataaagaaaagagaaatactcaaggtgatacatatcccaattaacccgatttgatctttacacaacatgtgagtgtatcagacagcacatgtgccctgaaaatatatacatctattatgtatcaattttttaacatggcagagaagaaatcagagataaagagggtggggaaataaaacttctctcgacttttcagtgtcctggtgaagagtactagctctgacattttttcataccataagaattaaatctgtagttatttgcataggtaattgctctgatccaaacgaataataaaatttttcccgagaggagcaaatggttatagcctgaacaaggtccctaggtagagcgcccagggtgccatgaagcctggagtcactatcttcctaagcaggccagcataagcttgtgccatcattatgcaacatgcaagaaggaatgagccccagaacttggagtcaagtcccaggacttgccataaaagccaagacatgtaacggactatctggctcctggagagatttatctacctaccaaagtgttggaataaggagcagacctttaagacggggaggggggatagctgcctcctccctcttttataggtagggaaaataatttgtccttgtttcttacctatggagtgtctgtttactcacatagagcaattgaccttgctcttatcacatcatcctagggggaagggggggccaaagcatttactatttactgtgagtcatttaataagaaatttaactctaatccagtatatctcatgtgcacatttgggataaagttaataaaaatgaatattaaaaacttagccccaaataaatgggtccgatgggcttgatttttatggaacttgagaaggagcgttctagaaggaggcacaaatgcagaggtaaagggtttcaagtgttcttggcaagttgtctgttgtacctgaaacctagggtttatatttaaggcacttccatgtcctcagctggcaagtggggaaaagggtccccaccactttcttccataatatacctcttagggatactataaaggcaaatcagagtacattctgcttttggagggaggagaacttggactctgtgttgtcatttgctcatttttcattcatcccattctgttttattaattcacttgggcaacaaggatttactgagctcctactatgtcccaggtgggtgttagggatactgtagtgaataaaacagacacagtccctactcttggaagcttataagagtgggggattacaggcattgaaccagagttgaacacgtgatgaatgatatgaaggagtgcgttcattgtccattggaagtctgtgacaggaaaacccaacctaagtcaggagtcaggaaagtcttccctatgaaagagatgtcaaaatggagaccagaaagatggaagttgttagctaggcaaataaagagtggttatagcctctaaggctagggaacgtacatactaatagtctaagatagaaagacccagcagtgccaaataataaaaataggactttgactgatggggatacagtttaaaaagcaaacacagacaagatgtcttttctttctgagcctaaatttaccaaaagaactgtggggtctgtaagttctgttccttctgtacctgaaagaatactgtagcaagatgctaaaagcacatatgaaagtgtcagggctaggcaaaaaaatataatacaataaaacaaaaagagttatcattaggtagaagcccatcttgtgagagggttggctaaatcctactattaataatttttgaccaaactccataggcccatgtgaatcactcatttttcgaagtagaattacccatgaaggaaagtgagttggtgttaacagctacaaatgtttcctcccagactcttttagtaaataagggctggctgaatcacagacacactggaaaacactcatctagcaggatgtttcaggagcagggacgccactcgaggggttttatgaaccactttaaagcccccacttatttttccaccttgtgcttatgtgagggtgatctcaagtaccccctccagaccccaacactcacacactcaggtattgcgtcatcattctttatgtgggttgtggggtataagggtctcttcctgatgaagttttggttccactcctcatgactgagtgtgcataaaaccactcagcctctctcatctacccctcccttttcctcttcctctttctccttctatgttctttcgtttattttatttttttatttttttatttttttggttattccctacctctcttatatccctctttctcctcccccaatcaactccaagttctgaaagcaaccatggcgcaaagagtgtgcaaggttaggtggggaaggagtgcatgggagccattttggggagtggtggcgatgggttatggcctgaaaatgggattttttattctttttttctccctatcaaagttggtctttaaaaatcaacactacgctagcaatttttaatcttgttttgaatctcagatccctttaagagatggcatttatggatgtgctcccagaaaaatatgtatacgctcatctatacaactttttatacaaaagtctggaagttcatacttgcacatatggctttaaattttttctcatttctttatacacagaagtttaggttcaggattcaagaagttactcttttaggtactgtgcctacaagtcaggtatgtagccaccaaaggggtcacattatctagacagtcaggcatccataagtgtggtggaagaaaatccaacatgcttcccagtatattaatgtaaaaacaaccaccaccaccacaataactataatgttcctcatgtcatcaagcagcaggggagagcactctgttttaagcttaatatattcgcaatattttaaaagacaaatgcctaattgcctttctcacttttcctcaacaattaagaatttcaatcactctaggccagattttagcccagatagacttctttttcttcttccccaatcactgaatctctagtctactattagctgagccctttactgagcaacatggggatttcggggtattttggtgacaagaatatttgggccagtgtgtccaattttccaatagctcatcttagccacaagtcagttgtgaaagagtctcttctaggtagctgcattacttaagctgatggttctattttactctctgactttcttatcagctagaacaatctatgctctctttgagtcatgggctccttcttttatgaacactagcttatggttaagttcagatatatatatatgtgtatgtatatatatatgtatgtgtgtgtgtatatatatatatgtgtgtgtgtgtgtgtatatatatatatatatatatatatatatatatatgacaaacctaataacctaaataagaggctttggtcaggtattatggttttcagcattcattcattgaacagatatttattaaatgcctcctatatactaagcacatagcacctgtttgtaggtcttggggtcaaaatagtgaacaaaatgaagttcttcctcttgaggcttttgcattctagtgggagagacaaaaataaaacaaacaaatatacagtataatataatgcagtgataagtgcagaaagaaacacaaagctattttagatagatggtcagaggaggcctcttggaggagaaactgttttgagcagatacctaaaataaagtgaaagaatgagctacccaggtatggaagggaagaaattcttcagagagaggaacagcaaaagcaaaagttctgagacaggaatgttcttggtgggtttaagaaacagccaggagccagtgtggccgtagcacagtgagcaaagaggagggcaggaaatggagttggaacagtgccacggactgggcatgcagggcctttgaagccatatcaataatggactatggttttattctatcggtgctagaaagccacagaaatttaaaagcaggagagagacaaaataggacatggtttttaaagatgattccatctattgtatgaatgcagggagatcagctggaagaagacggcagtacccaggcctgggatgatggtggtggaaatgcaggaggtgaaaagggttcagataccagacatattttgaagtcagagccaggaggatttgctgttaaaatgagtgtggagtatggctgggcacagtggctcatgcctgtaatcccagcactttgggaggccgaggcgggcagatcacttgaggtcaggagttcgaaaccagcctggccaacatggtgaaaccccgtctttactaaaaatacaaaaaattagcagtgcatggtggcaggcacctgtaatcccagctacccaggagactgaggcaggggacttgcttgagcccgggaggcagaggttgcagtgagccgagatcgcaacattgcactccagcctgggcgacagcacaagactccatctcacagaaaaaaaaaaattgagtttggagtatgcgagaaagaaaggaatcaaggatgtttccagtgttttggcctgacaaattggctgaattataatgtttgcagaaggtgttctggaaccaagagtttgtttgctaagtttgaaatgccctttagacctccaagtcctgtcttgtgtaggcagttgggagtgcagtgaaggttttggttgggagatataaccctgtagcatcccagaaatatgtcagactgtgcaattgggtgagaaactggatgagtgtggatgagaatgagaactccgagtactgagatgctccagtatttagaagtccagaagagcagaaggctcctgccaagaaaactgagcagaggcaacctatataggataggagaaaaaccgggagagtatgttgttccctgagccaaatgatgacagcgtttgaaggagggatggatgaactatgtcaagtacccctgagaaagcaagtaagataagaactttgacttggcttagtggagtagacagtgaccttgacaaaggtggttccagcgagcagtggggaagaacacctgtttatagtgggtccaaggaaaaatgggtctggaaatgggaaaagaaactataaacacacattaaagcactttgctgtaaaggaaaacagaaatggagaggtatctggggatggacctgggatcaggggagatagttttaatataaggaaactacaagtttatatgttgtgtattgatggaaataacctagtaaaaaaaaacctgataatgtgagggacagaggcaattgccgaaacaaagccttgaagtaggtgagtgctccgtggaggaagaggctcgacttaagtgggaatgtagaccatccatccaggtaggtaggttgatttagtggtggtaataagtggaagttctctttttgtgttttctattttatacttcagtgaaacaaaaagcaaagtcgtcacatgagagaggagggggaaaggcaggttgtgggtttgaggagagaggaggtgtgaaataatcagcagcaggaaccctcatagtggtttgaaaggctcttggtatttttttttttaaccttgttgttggctcagcttttttggaaaagagaaatacagtaatatctcactgtcgacattattaactatctcagggtgtttggagagagaggattccacagtttgaacactgggcttatcacttcctgactccacattcctcagatttttctgttttcctcatgatctgaaatgcttcctgggctcatgagctcagaatcacttttatttgctctccatccttcatcctgtatattcaatggtggaaaaaaccctggtagaggaattagcagaactgaattctaatcctgactctgccacttactagttagggaagccatttaacttctctgtgctttttagatgcctgaacaataaatctgagttgataaagacccagtactctagttaatctatacaactctatcctaagtaatttgaagatttctattgacagttttgaagtattgagaatatagtggggatcctcaaggcagttcttatagaccacgaaggacttggcaaccccagggatagccaaagaggaagagggagagcctccagtctgtccttcctgatctgctgacacgatgttgtctaaaggccttaataataagggactctcttctcctccctcccacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatggtaataatggcggcttccccagtccacactaaagggccaaggtgctcctttgaccaagaatttaggtctctcttaaaagcaaagggtattcagaattggaagtaactagaatgatcttctagtttgggggtatttaaacctgctgcatggaagacgttttaaaggttgacatttttttttccaaattgcatattgatggtagctgattaagcattagttactcttactcccatttcccaaaggaaaggggcacagctccttgtgggctggagggccgatagacccaaggatcttggtttgcaagtaatattttatttgaaaataggatttttttctgattaaaagaagttgaataccacagatcaaacccagtctctcctacatgaggacagtgaaatctaaccagaagcggttagcacatttacacacatttgtgtaggtgtttcactgcactgggggttctggataaagatggctaaaattcagcccacacaccacttgttaagccctgcattccggcaccagatcatacctacttggtggaagaagtgccttttggcatttaaacaaaggctttggttataaagtcttttagttgctgtacttaaactaggaaccaagtccacctgaatccaaggccagtgcttttttgagcctttttaactaccagtccctcttgagtgcacccagggattgtgtctcttaggcccagagactcatctgaattcccagggatcctgatagccacatggggctttcctgcttcttcaaaatgacttccttatctctggggatgggacaggaattcccacctaaccagcatttctttgaaattctcaaatatctagagggaaggcagcaatactctcaccaatcctccctcaacccagcattccctttccttcaaacagtgcctgcggaattcccatggccctcccccaggtacctgagagtcatttccagcagtggctccaggcacgactgccatgagcgtggaggctgcacatgatgcattttccaaaacggtgtggatgccagacattctgtcctttggttcctatgtttcctgtttttgtcacatcttgtgatcaaattcttactttggaaaatgtggtctctgcaaccatggcatttttctcaagccaaaggaagagtttggattttgaagtcagacagacctaggttcagatcttaacttggccacttagaagctgtgagttgtaagatattccacctccctgggacttggctttctcatctataaaatggggaataattacaactagagttataattgttgagaagattaaaaaagatgatgaggtggctcacgcctgtaatctcagcactttgggaggccgaggcgggcggatcacaaggtcaggagatcgagaccatcctggctatggtggtgaaaccccatctctactaaaaatacaaaaaaaaaaaaaaattagctcagcatggtggtgggcacctgtagtcccagctactcgggaggctgaggcaggagaatggcgtgaacccaggaggtggagcttgcagtgagctgagattgtgccactgcactccagcttaggtgacagagcgagactctgtctcaaaaaaaaaaaaaaaaaagatgatgaatgtgaaacaccagcactgtgcttgtcctataatagttgctaaataagcaagaatttaccttttatgtggcctatttcatggccttagagtgggatagattgatgaggcctatggttataattgaggacctatcactatctcagacacacaaaagcacttactacacacccacccactcactcacccatgcgcccgtgtacatgcgcgcgcgcgcacgcacacacatacacacacacaccctcccacacacatcacgatagatgaaatcccaccactaaaaagccattcttttaggtctaggaagtaacaacgtaagccaactaaaaaccatggtggattagttgacagcaaactccactgataggagacaggagaatagcaacttaggtcaaggacatcaggaagggcgagtggagccctaacaatattggtagaagaggcctaaaaagcaaattcttattttctattttatcccaaggtggtcttagaaaggatgtagtggggcatgatggacagtgtgaagcaatagattccccactagaaataaatcacattgagggggagggaaaatgccattaggctgtactttgttctaacaaaaaggtcaagtgagaattcccaggggttcacttcagtgatggctcccttcctcccactcctgacagagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcaggtgagtacactggtggcagcctgtgtgccaccttaatgagcatgggctcagtcttcacatggtccaattgctccccagccatggcattcaccttagtaacaatactttacattttctttatagtttgcaaaagtttaccatgtgcatttagtgagctcactctcatattgaccagggtggcatttttatgctcagttcacagttgacgaaaccaacaggaggtgatagagccagacccagagcctaagtctccaaggcgtagccttctctgcctcttgccttgactccaacctgcaaggttggctgggtgagggattgcaggtgggagggcctggctcccaagtctatgctccactaatgctggggcagttctacaccgtcaattagtatttactgatcacctacctggtaagaaattgtgaataaatatgatatgtgatctctcctctctaacaattcattgtaaagataagacgtaaaacattgcttaataatgaaacacaggatatagtgaaggtcctcgttttatggaatggactgtgaatcccatagcagggccaggggagtcagaacgagagactaagacctggactgtgaagtttgaggaaaaataataaattgcacagcgcttcatcattagcaaagcactctcaactgtgtaatctcttttgatcctcacaataaccttgccagataggtgttatactttcattttacagatgaggaaattgacgttcataccatttaagtaccctcttcaagtttctttggcatgtagatagtggagttaacccctaaacctacatcttctgactgttcttcctctagaaagaaaagcatcattattctgtcagcaaaaggaagacagaacttactaagtaagcccatttaaccacttggatacaggacagaacacaggcccttttcactaacagatcttgtgtccctgcctcaggcaggttcagggactgtaggaccagggtgttgctctgcaaggcattgcttacaccctgacattctcctctctgcatccactggggggacataggaatcgttccaatgggtcttctgcctacagtagccatggtgtccatgtggagggctttcccaggtggtcatggttgagggacaggggaactcagccaagtaatgcccttccacatagcactgcctgtcacagagactcccctggagtattcccagatggactgctgggaaaatcccacctggcctccagtgtgcccctggaagttcttgaatgagtctaaccccctgcatgtttcctccccagacatttcatagccagagtcccccgtcctctcacttactggatatgtctggctgcttgcccaccttgcatacaaaccacattcagaggctaccccccagttcagagcgctctccccacccacagtcatttagaaggtgctggcaggacaagcaagctgtgcagcatagtgggtagcttacagaatgtgaccccggaagtcctagagccaatgctgccctttctacttacaagggcaagtgcctcaatccctctgagatttagattcttcatctctaaataacagcaactggcgggtcatcatggtttactatgtgccagttatgtggcatctcagttaatcctcacagcaacaaaataatattgatagtatccccacttcacagatgaggaaacaaagctataacatggttaagtaaggtcacacacagagcaagtgatggagctaggctttctgattctggaagcctcataggcattagtgaaagagataaagcacttaaaatgccttataaaccataataaaaatgtaatttttattataaaagctacaaaaatataatgtattttttaattgtaaatgaggaagcagtagcccttacctcagcacagccctctctgggtatagctgccctattagagtacaaaaacagggcactgaatattttaccctggcctaacccaaaaaaggggcagaactttcttcatgctcctcaatgtagtttaaaaagaatttaattagggcataccaaagtgttggtgggccataaagcttatactaagggcactcagctcaggacgttctaagaaaacatgtgaagatggacttacccatctaagccactctgaggaccaagaatgcaccagtgggaaccagatttactgagtaggaagctggttcttgtgaggagtggagggacaggaagcagtagaaacctggcaccacaggaagggccctgtcaggatctcggctcggtttgtaagagaactgtccagccgttcccctctcttgggtctctgtttcatccccagtaaaatgaaaagggcgaacaaatgaagtccctcccagagtagacagtccttgattcagtgtgtgtgtgtgtcaataagaactgccaatagaggcttgccactgtgtatgagtttgctaaggctgctgtaacaaaggaccacacactgagtggcttaaacaatcaaaatgtattggctctcagttctggaggctagaagtctaaagtcaaggtgtcagcaggattgttcttctctgagggctgtcagagaaggatctctcccaggcgcctctccctggcttgtaaatggctgtcttctccttgtctcttcatatcatcttctctctatgtgtatttctgtgtccaaatttcctcttctcataaggacaacagtcatattggattagggcccacctgtctcagtttgctagggctgccataataaagtacaacagattgggtggtttaaataacagaaatttatttttctcctggttctggaggctagaagtttgaggtcaaggtgttggcaggtttggtgtcttctgaggcctctcgccttagcttgcatatggctaccttctcactgtgttctcacctggtctttccttcgtgtactcacaccctgatctctctctctctctctttctctttcctggtgtctctttgtgtgtccagatttcctcttcttataaggacaccagttaggttagattaggggccaccctaatgacctcattttaacttaataacctttaaagaccttgcctccaaatacggtcatattctgaggtccttggggttagagcttcaacatagaaatttgggggaggggagacaaaattcagcccaaaacatctccctaatgacctcagttttactcaattaactctgtgaagacgctatgtccaaataaggaaatcaacatatgaatttgggaaaacacaattcaacatgtaataaaagtagagatgcctcctccccaccctgccagcctgcagggataggggaccagaccttccctgcctcagaaccagatcacacagctggtttgtggcctgccctgcgcagtataccagattgcctaaatactgaaaacagaattgtatcagtaccttgatttgtgtttgcgcatgaataacgaatactaccagttcttaaaacactgcacttagtttgacaaaacatttacactctacattgtgctaggggccagtacacaaagataaaaaagacatgatccttgccttaaggcagaagacagctgtataagtaaacaatgatccgagattagacagtgtgacggatgtaaaatggaaatatatgcaaggcaacaaacaggagggaattattaacactgtctcgggggattagagagagcatcccagagaatgtgacataaactgggttttaaaaataagtagaaattacccaagctgatgaaagacattccaggcagagggaggagcagatacagctgggtcttgctctgtattatcttgtaggtgataggaactaataaagagttttagatagaggagtgacaccatcagtcttgcttttcaaagaggaactccagtagtatagagaacagactggggcagggaagtggggaagaaagagaaaccagttcctgggggccattattgcagtcatccatcaaaatgatgggacccgagccaaagcagcaactgtcagttaacaaagacatttttcctagggcatacaaaggaaaaccccagccttgggatgaaagggtggggtccgagggtttattagaggttgctttgccatctgtcatcaggacagtgattttaagacatttttcattttcattaatgaaaacctcacagcggttaatggtgtgatgagacggaatgcaatgtgatgtgagcactgaatcttgacaggactcacttaagcgaaactgtgcaaaaacttatatgttccttgaaatctttttctttaggtgacatttgttcaggtcatgtattcatccttgttccaattgccatttcagtgtgttaatgtctatcataatgaagcatctttattgcaaagtccaattcttagggtgctatgaagtactctggctaggtcatgtgaagccagtggatgtgggtcagctgtggacagtgtgtgacttgctgccatcctcgatgactgtattctgaaatagatatggctgtgctagaatgaaggaatctagaaaggaatgcccctggaagctcatcttgaagagaggatctttttcagcagatcagcaaaccgctggctcagcacctctgagttagctcagtgaaagaaaaggctgacgcctgccagtgagctccggaggcttcccctttctaacaaggtcatttcttcaaatagggagttcccattgtttcagagtcacttagatgttccaggcactaagacaggtctctctctagggtcttcccaatttagcgagcgtaaaaacaatggtggaaaggaaaaacctggaaactttgcacagcccagagcctggtcatgggccacacccgctataagggaagctgagacacatagctcctagctgagcagctacatgcccagaaaagactcgtattaccacgaaagcatgagcgcaatctcactggagctagtagcctctgcaatgctgggtgggataggcaggttgtaagtgatttttctggaagctgtgaactccgtaaaaatgtttacttggatggtcccagaacttaaattagtatatggttcatgaggatccttccccacccccagttctgaatggaaactgccacgaacaagaatgtatctcttgaagatggcagcctttgctgacagaaccacatgaaaggcaggaaggagatccggcacgctcccaccgttacgctaacgtcgcagtatctcctaggtgaactgcatttgtttctcagattctttttagttttctttttcatcttccctaaaaaaaatattaataataagattttgggacttgagaagagagagagagagagagacacgcttctgtgtttctgtgacaacactttcagagacaagaaaaaaaacgccctctggctttttccttggatgtgtgactgtctgccaagttatcacgtttaaaccacagacaataggtggagagggcccagggtggagactcgagcaaagcactcttcccaaatggcatgtgagttattgaccagcctgctcggccgcctctaagagcctcgggagtagggggagttccaaacctctggttcagaaatgttcaggtagcatttctttgtgaatgaaggagtcaggagcttctagaccccaagacaactttgatttctcagcatcaccatccagagaggcctcactacatgactgagcaaagagaagaagagctggagcttctgccacaggaaatggtggtttgaaaatgggagcacaggtgaagcgccgatggcacagacacacacttgcctcctggctccatcttgttattgtaaagtataagccaagtgggtcacttctccttccctttgattcctgccttgggccattcagcaggtgaccctgcattccttctggtaatttttaaacagaaagctacgtgacagtctttttctagatccatttttgtggactctcatttaatttaacttagttcatcgagtgcatattgagtgccctcctgccctatattgtttccggtggaatggaggatacaaataaagaataaggtacagggcctaccttcatggaatttgcaatcaaagtgggacttctacatcttactagctagaaaaatataatatttaaagaaacatattataatcaaggaactgctactagaattcctctttgaaaaggaattgtatttgtttatgatagtaccttaataaatgctagaaggcaggtggagaccccccaggaatctgggtgtgggttggatggttctgtatgagaatggaggaagatgatacttgtgcagaaatgggaagagaaagagagagtctgaacctgctaggtggtgaaagctgcctggttcacaatggaatttgctccctgggacccttcaatcttcagcagagaacttaaacccacaaaattattggtgtaagtttttaaaaaaaagtttttttggtttgtttgtggaaactgattgtattagtccgctctcatcctgccaataaagacatacctgagactgggtgatttataaaggaaagaggtttaattggctcatagttccacatggctggagaggcctcacaatcatggttgaaggcgaatgaggagcaaaatcatgtcttacgtggcagcaggcaagagagtttgtgcaggggagctcccatttataaaaccatcagatcttgtgagacttattcactcccatgagaacaacatgggggaaaccaccccatgattcaattatctccacctggccccacccttgacacatggggattattacaattcaaggtgagatttgggtgggggcgtggccaaaccatatcactgatgaagtgactaaaccttgcacccaaggaagcacagagtagagcaagcagagttataggagcaaagacttagagaaccatgaggaaattactcccagaaattacagaaatcatgtgcagcttgacctgaacaaactgtaatagtagcacttttttcatacttatccaaatttctaagagcatggggtctctgacatttgatttccatgtaaatataattaaagaatagcaacaaatggatgagcaccaagtataaaaatacttgggcctactatacaggtagggaaactaagccataagtaaagaacagatgggactgaagcatctctggacactggtgaagagactcctttggacttaagatcaaactcattttcttgtctttccaatcaatcaacaagaatttactgagactctattatgtactgagtactaagagagctgttaaagtagtgtaagagatggtctctggcctcctagaacctagcaactatttggagaattgaggctagcagaagtaattgacacttactgaccacatgatggattccagatattgctctaggcactttccatacattactatatgggtttctcagaacaacactgtgaacttattgttatgctcattttacagatgaggaagttgaagccacagagggtatgagtagcttatctgtagtcacagagctatcaagtggtagacccagaatttgaacttatctatctggctccaaataccatcactgaaaatggtctgcatggtaaagatgatgttgccaaaactcaggttctaagatacatgacataaaccacaggtgctgcaggagtccaagggacagggaagaacaagagctgggatggtcaggaaaggtgacacaaagaaaggaagattggcctgggcatcaaggctaggcaggcatggtggacagcttagggtgcagcaggaaggagagtatggagtggagcctggggccaggaatgagcatgtgttggatggaggatgatgaaggatgggttggctgctcagagggcttttgactcaaaaggtttgagtcaaaagggctttgacatcactactgccttctttatggggaccgcatctccagaggctaaagcacaaaccacaaaatctgcagttcccatcttatccagctctgccactgactttttctatgactctggatactcctgtctgtgtctcagtgtcctcaaaataaaattagtgggttgggtgaaataagcactatactatagttcccttaaggttaaaaaggtctatgattcatatttgtatccaaagatgaggaaaaaaattagagtttatgaaatatctttcaggaccatggccaacttgtctctcagatctagatggactggcagaagcttgtcataggacaaaggtagcagattgctttcatcctctagagaccctagaaaagatagagagggccggcgttgtcatgtcctgaagccttggtgctgcacccagtcatcgttagtttctgtgagttggtgggcagcagagcaaccggcgtcgggcgcgagggagaggaggctgactcaccaggcattactggtgcagttttgtcttttattttccagttcagaggtactactttgtctgttggttttatttttttaatctcaagtgaaattggaaagaaatattatcttttaaaatgatataaatggtgggggtgtttcttctcaaatcagttgttgtattggaagttcccaaagtatctatgatagaagaagaaagaggaactagtcaaaatagtaagtgctactataatggtttgctggatcagttccataggctgacgaaacacaaagttcaggctactggctttgcttcttatcctagtattagagtgatttctccagtggttcctagtgtcgatatcataaaccttgaatgaatcaatctgtctcaaacacacacatacacacatacacacacacacacacacacacacacacactcctgcacagagggttctcagtgaccataagtcactcagagtggagctgctccttcctccagcatcagcaatgattcaaaatgtcatgctttatacaaattcagaactctctgcctgcctcctaacttttttttttaatcagagcataagactgttgaagttggtatctggcaaaattaaaacatttaatttaggggatagaacctataaccaaggtgtttgcaaagtcagttcagtgagattccttgggctaacttgatgtgtgaaaggcctaaggagaaaaagaatcttttcaaatccagaaggcaacttcttgccagctatcaggctggaggcccctttggatcttgtgggctgcattttatgaattcattgagactgtctgtatctttggtcaactctgtaaacatctgattgtgtccaccatgattctttcctttggaacccgactatttttctttcaatttctgccccacaaattcctcacaggttcaacaacaagcaggcttattccacaatcatccttataagtttcccttacacattaatgttaacatctggtgttactctatttagaaccttagtgcgaatattctacttagaaccctagggcttcagctcggtccccactgttcattaccccggtataactttttccaagcccataagtctctctaactctccaagaagtctgtctttagtattcagccacatttctactactaaaccaagctctagttcttgaggttctccaggctgttttccttctccataaaatgagaataatgagtgtacctaccttgtaagattattgtgaggattaaatatgttagtacacatgatgcactaaaaatatgtggcccattgcaagtgctcaataattgttcattataatcttattgagctacatgtcttgtttactgggggtgataattctcattcactgtttgtcaaagtgttgctcctagttcaaaaggatttgataaagtgggtaaaggagagaaaacaataaaagttttctctctgattttgagccttgatgattagttctcgggctaattttaaacatgaagatgatttagaggaaagactaaatactttcctttcagttcaggtctgctgggttcaacccagttatttgcatgaaaggacaacaatagcactattatgtttatttttaaaaaagataagtagatctttcttcctcccagtgtctcatgagaatagcgtgaattcacagggacggcacatggaaccattatattctctttacccaaaatggatacaggacacattagcaatcttaagatggagaaactgggcagagagattgacttaggagagatgaagataatttaatgttagacatgtggtagttgagttaaaaataaagcatttggatagaaaaatcttcatgaaattaagaatgtgaaagtatagtgagagaaattagaataagaaaacagatacaaaaattttcagtggtctaaagctgacctctaaaaccatgaaaacaaacgtctcccttgggagagaatgcagaaatagaacatgaggctccattatcccactttcatgtaagatgtttttaagctcagaatacttttgagattgctctttgacttctttttttttccagaaacaaaaccatgggcagtgtatgctgggctgttagggggtgtcatcatgattctcatcatggtggtaatactacagttgagaagaagaggtaggtgtctggcaataaatagattcttatcacactctctgtggtaagcaggggacctctctccacaggctcggacttgctctcacaactctggctttctgcatggggccacctttgcaaaaatagtagataaacatatcctgggaccttgcttaattcagtctaattcaacatgtcttgatcccctctactaggctgtggaaagaaatagaagagccacaggtttctaatgtgagagacattattcagataatttcagtttagtgtgactagcactgccatcagggtaaacacaggatgctgaagaagtgaacaagaggtttaagagtattcactgggaacagaattcagaaaattattggatctcatccaaaaagtcaccagggttagaatgaaaccaataaggcacaattattcccctgcagttgaagtgcctagaggtaccatcccctgtcctctcttccaaatttccctatgatacaatatctcagggcattgtgctcccctcagccaccttgactactaccaaccaatactggagtcaaaatgtcctgacccaagaccaggagagatgccccggctgccttcccatggtaaggatagaacttgatcctcataacactgagctgatgactgatttcattctcaagtagatcagtgtcatctacacacaaccttcttagaaaagcccttacctcagcactctgatgttggttttgcatatataaaaaaatctagatcatagcacagcgacctacttgtgtctcatttcctccatctaagagttagccaggtaggagggatgggtgattcagatagaaattaggttgacagcctatggggctcggggtagggcaatcacatttagctcatactataaggaaatagtgagatgacccaggatgagaaaactgaacttaacttatccacattaacctacctagtaaaattgctgggatcctacgccatactctttcctcaaccacacttggcttatcacatggttgtgctctaagggaatagtgctccccatcccacaattccccactaccttccccaacacacatacccatcctcacctcaaccccattcaccatttgtcccttgtaagttagcaacacacaaaactgcctcaaacttgcggtaaaatttatatttagttgctgcacctttcataaaaccttgctaaagaaattatattggcagcttctaatgctataatcatcagaatgcagcctgacgctgaaggcttttcaatttcatgactctttggcaatttcatgtccaggagaatacactgataaagaatgtgggtataggcattagacaaacttacattcagatgcagattttgctactgacaagctgtgtgatcaaatgacttaacttctcgtctgcaaaacaggggtaatactatgtacttcatggtattgtggtggagattggtatcaatacacagaaaacactgaacacagtggttcccatcgatgggtgatagatagatagatacatagacagatagatacatagacagatagacagatctcttagtgtagatgaattaaaatggcaatgtgtaagtgctatggccaggagaagctgcactggaagcatctggaaacaatacctagaacagattgaaaatattttaagtcatggtaacataagactttatgcttcaggtaaaagctgaaaaggatattagatactctatgccctcattttacagttatggtaagagaaaagacccattgagatgacgtgatttgtccaatgccacacagctaatgatggctacaatgtagatgtcctaattttaaggccaagactttttccttagagcctaagaccttgctgacttggagccgagttaagcttactcctaaaaacctgttcttgcactggggaaaataacctgagactaaattatcttggtccaatggtccttttaagcagcaacaatcaacctcacctcttccatctgtctgaccatttaggactgtccttccagttctacatttgactctgagctgacctgcaagactgaaagtctttgaggactgtagtctgttctctactctatttgtagccactacagcacctaggagagtgctgggcaggcatgtcttactttgcaaacactcgtggggactaacttgaacctcctctgctacctccaactgcttcttgagtcctcccctccattttacacacacacacacacacacacacacacacacgcactcacgcacactcctcagtcaggatcaactctgaccaaaaaagcgaagttgaaaccactaggcacaccgtgctcatacccacacacaaaaaatcccatgttgactttccttgaattcctggaacttcatcagtgtctgccccacatttcctccccaagactcacaccctcacgcagcacattccaccatgctcaccacatacacactgggcctttcccttccaaagaaaaatgtgcctctcctaaaaatgctatttcctcagagatgtgcctttttttttttttttttttttttgagatagattcttgctctgtcactcaggctggagtgcaatggcatgatctcggctcactgcaacctctgtctcctgggctcaagcagttcttctgtctcagcctcctgagtagctgaaattataagcgcgtgccaccatgcctggctaatttttgtatttttagtagagacagggtttccccatgttggccaggctggtctcaaactcctgacctcgtgatctgcccacctcggcctcccatagtgctgtgattataggcgtgagccactgcacccagcccagttttttaagagaataaattaactggtgttaaaataagtctaccttaaaggctgtgattttctgggtccagcctccattgcctctgcctggactttgcaataatcccataataaacctccatccttcagtctgccactttcccaccatccttactgctgcatgatgtatacaaaggatactgtgcaactttagaaagaatgagataggtctactgtgctaacatgaaaaatgtcctcaatacattttaagtgaaaagatcaagttacagagaagtgtgtgcagaatgacacctcttgtgtggaaaaaagtctatataagtatagcaaatatccaaaactgcattgtctaatatggtagtcactagccacatgtggctttttaaatttaaattaatttgaattaaataaaatttaaaattcagtgacattagtcacagttcaggtgctccatagccccgtgtctgtaagctgtattagacactgcagatatggaacatttccatcatctcagaaagttctgttgcacagagctgatctacagggatatacatcaaacttttaaaaatggtttcttcttttttttcccacttcttttcacaggtattgaaaaatacggtttcttttgggaatgaaattgggttggttaatggaagaaggggatttatactttttactttatactttatatatttcttcacaatttttattttatgatgagaataaattactcctataatttaaaaagaaagctttttaaaattggctaaaaattaaaatattctgcaacttattaatttccagagaccctaggccctgagcaaaatttccagatggtgggcaacagaatgacattgttgctttattttctaaatagtcccaggtggaacatccctcttacacgtccccccgcccttacctcccacacatcaattcccccagaaatagggaggtgagaaagctgtgagtgaagcaacatactaccagctggaaaatacaaaagaggtataaacaactagccctgccctcaaagaacttagaatcctattaggagaccagatatgcacattgagcaacagagattaaagtaattgaatggtacaccaatgagaaaaacacctaatgcgtattgggcatttgttatgcaccaggcagtgttctaaacactttacaagtggtatctcatttaattatcacaacagccccgtgaggcaggtatttcaaatcccatttcacagataggcctagagtgatcaagtaactaacctaagacaatatgacaaatgtgcaggggggctgggactcagggctttgtttccattgtgcccttggggaaagtgggtatgcaaaggacagtaaagaccaggtctgagtaaggagctcctgctggggaccagagggagataaccattatggtttcttttcaccaggtaaaacgaaccattaccagacaacagtggaaaaaaaaagccttacgatctatgcccaagtccagaaaccaggtgtaagttctatattttgtttgagatgaacctgtcatgtttcctagagtattcctggccagtctaccttgcctgttggacattcacagttttccatccagagcagaggaaggtagggaacaggagtcaagaacaagagttctcctaaagtcactaaacgtcagtgtttgaaataatgggcaacactggataattttctggtcatgagtcttcacaggaaaaaaatgaagaagctggaaatacatactgtatgactctttccagctctggcattgtaggagtctaggttccatgttagtcaattatttccttttctagggaaaagagtgcaggcttgaggagagaggaggtttggaaaagctattgtgtgacatgttggactgatccaagtttaggatttactaagtgcaaaagtgacaaggaaggtaggatcttcaaaattctagctagagtgtggttaaagagatgaaagatgagatggaagaaagaaaactgtgacagagtgatcactggactaagaagtgaaggatggaaaaactggatgcatggtgaagttgagaagcagatatgcttgaaggaagggatagagacgctaaaaggatcgtggttagatgtagagacactgtagtttttcaacatgaaggcaattcttggtattgtataggccagaatctggacatttggggtgtaggtagaggcaaattcttgagtaaaggatgtgaaggtaaagatggttttgatagtaccttagaaaattgcatgaaaagacagcaaatgcacttctgagaaccaggagatggactcttgaacaaagttcttatttctgctgtcccctagtggcctggagggcttattacacaacccagctccatccttcccccaactaaactccatttaaatagatgagaatcccaagagtaaccctttcaccccacgctctcatctgcctgtttaggtaaccaggttcaccttgaccatagtgtcttccctcactactctatcctatgctgctagcatccctcttttttactgtgaagcatgacatatggtagtcactagccacatgtagctttttaaatttaaattaatttgaattaaataaaatttaaaattcagtggcattcatcagttcaggactgtcctcccagttctacatttgagtctgagctgacctgcaagactgaaagtctttgaggactggagtctgttctctactctatttgtagccactatacacctaggagagtgctgggcaggcatgtcttactttgcaaacactcgaggggactaacttccacctcctctgctacttccagctgcttctaatcacacttttagtcctctcctccattttacacacacacacacacacactcactctcacatacacacactcatgcatacccactcctcagtaaggatcaactctgaccaaaaaaatacacaacacattaatgtcagctcagtgaattacccttaaacacatatctcgatatttggtaaagcaagtcttcctaatttgtttttctgcaaaagtttttggctattcttgttcctttatactttcatatgtattttagaatcaacttatcaagtaccacaaaaagaaaaaaaaatattagaattgtattgagtctacagatctatatgaggagaaattacatttttcagtgttgcgtgttttttgttttttgttttttgttttttgacagagtcttgctttatcgcccaggctggagtgcagtggtgtgatctgggctcactacaacctccgcctcctgggttcaagtgattctcctgcctcagccttccaagtagctgagattacaggcacctgccaccacacccagctaatttttgtatctttagtagagatggggtttcaccatgttggccaggctggtctcaaactactaacctcaagtgatctgcccacctcagcctcccaaagtgctgggattacagatgtgagccactgtgcctggcctcagtattgagtcttctaataccataaaactaccactcagatcaaagactagaacattgcccgtacttcctgaaggcctcctgtgccacttcccaatcattacttcctctctcctccccaaagataaccactatcctgacttctagaaaaataggttagctttttccttttttatttttgaactttataaaaattgaattctttattcttttttctctcatgtctgatttattttgctcagtattatctttatgagattcatatatgtctttgaatttagatataatgcattctttttcattgcttcatagaatataaacgtatgaatatactagagtttatttatccagttgactattgatggacatgtgggttatttccagtttgaggctattatgaaagttgcagctgtgaacattcatatgcaagtcgttaagtggacatgtgcacatatttttttgggtatatacctagatatacctggaagtagaactgctgaatcgtagagtatgcatacctccaaattgactagataaggccgagctgtttttcaaagtgggcgtatccatttacttttctatcagctacatatgagagtctcaattgctatgccttttttttttaaatttttttttgagacagagtttcactctgttgcctaggctggggtgcagtggcgtgatcttgtcttactgcaacctccgcctcctgggttcaagccattctcctgtctcggcctcccaagcagctgggattacaggtacgcaccaccacacctggctcattgttgtatttttagtagagacagtatttcaccatgttggccagggtggtctcgaactcctgatctcaggagatctgcccgcctcagcatcccaaagtgctgggattacaggcatgagccaccactcctggcctcaattgctatgcattctaatgaaaacttggtattaacagtctaattttagtcctactgttggatgtgtcttattatgcttttattccacatctctgtaattattaaggaagttgaacaacttttcatatgtttattggccatattaaaattctttcttaaagtgcccatttaatctcttgcccatttccctttgaggtttagtctttcttttatggactagtatatgcttttcatatattttggatatgtgccctttggcagatatgttagcaaataccttcacccatctgtagcttgcctttggaatttctcagagatacctactgataaagagaaggtcttaattttgttgtagaccaatttagtctagtcctttttaagcattactggattttatttgctaatattttgttaagagtttggttttccacttatgtttctgagtgaaattggcctgtaattctcttgtataatgcctttttttttttaagaaggcactgcagtggctggtatatagcattcttgtgaatatatctaactgggatacaagttgaggtagaaatatttcaaatgtccttaaaaaaataagtaacagagttcttcctggactcttctttaatcacaagcctcagattgatcccaaaatgacacacagctactctacctaatacccacatcacggtaaagttggtcgctctcctgttaaaaattcagactttaagaactggaagggacctgggtagtcatgcccaaccagtggggttttgatataaagatttatgctaattcacataaggagttggggtatatgttagtttcctagggatgccttaacaaattactggaaacttggtggcttaaaacaacagaaatttattctctaacagttctggaggtcagaagtccaaaatcaaggaggcacatcctcagggccacactccatctggaggctttaagagaaaatcctctttgcctcttccagcatctggtggctccaggctctccgtggcatttgttggcttgtagttgtgtatctgcaatttttgccttcatcttcacatgacctccctctctgtgtcttcttcttttccatctcttataaggacagtcatcatcagacttcggacttattctaatccaggatgaccttattttgaaatccttatcttgacatctgtgaagacctttattcaaataaagtcacattttgacattctgcctggacatatcttttggggccacagttcaacccaccacagggtgcatttcctttttgttattctctgcgatatttgggtaggatgtcttatttctccccttaaatatttgctagtagagcaaattgctagtaaagctatctgagactggggtttctttggtggaaatttttttaagttatatttttattattaaattttctcctctacatattagtgaacaacttttttcagtctttttagtggctaccctagaaattataaaatacaactttgacttaccaaagtctaaggtttacttccctcctgcataatacttcaagtccacaataatttcacctcttgatttaagtgaccgttttgtcattatttgaatttcatatatattttaaacacacaagacataattattattgttttatatatataaatatatacttatacccacattttcacaattttctttgttcatatttgcgatgtctttattatatcattataaagactgtaataatgtagacaattatttaaaaactaacaatgcctttattcttatttttaatggctataaaataatcttataaagaatataataacatgaaaatcactaaacaagtgtttactgtgtgctaggaactcttctaggacttatcagagctagtatcttgcagaattaattccagcggccaccattcacaaaaattatgtgaaaataatgcctctggagttgcttgtaaatgatgctccctaaagatgtacaaatcagtggtcctaacagaagataataagatacaaaaatatactaacttattatatttatgtttaaaataattccctatgcctggataaaaatcctgaagtgaacatttaagcacacacagagtcttaataggactatgggtgacttcttttacatatttttctcctttctaaaacttctgaattaacgttaaaaatgtaagttatttgcctccttctgcctctaggtcaggttatgctaaagttctcccaaacaggaagaccagcagaggttgcatctgttgataaaggtctctcttcttttttttttttttggtgaggcggagtctcactctgtcgccaggctagagtgctgtggcgccatctcagctcactgcaacctccagctccctggttcaagggattctcctgcctccgcctcctgagtagctgggattacgggcatgcaccatcattcctggctaatttttgtatttttagtagagatggggtttcactatgttggccaggatggtctcgatctcctgacctcgtgatccacccacctcagcctcccaaagtgctgggattacaggcgtgagccaccacgcccggccaaaggtctcttaataaactgttttgatagcctctttatctcatcactgcaagaaattctttcttaaactcaaaatttcttcaaaatgtatttaagaattgtatgggatcttgaaagccatctatctgaaccacccaattactgcttgaattatctgctacaacattacttccaaagtgttgcctagctcctttttactgaaatatagtttgtgaacaagcagcatcagcatcacctgggactttattagaaatgcagaatcaggccctgctccagatcttccgaaatagaatcaaccctttaacaagatccccaagtaattcatatgcataataaaagtcagcagcactggtctagaccatgcccaagcacttataactataggagctcattgcctgccaaggcaattcatcccacatttgaacatcttttaccattagaaagatcttcattatattgaatcaaaatattttccccaaatcctaatcttggtttaaacctgagatactttataggcaaattgaattccttttctatatggcaattcatcaaatatatgaagagaaaaattatgtcccatccctttttcctccaataaactttcctaattccttaacccttccatcacatgacaaaattccaagttttctcgcattaaaacacatgtggtgtggcttcaagtctggctctatacccagggagagtggacagcagcattatcccataaccagtgtccccaaaatgtgttgaattaatgacttccctattgtaagtgatggcatccgcatcttacaaggatgtggtctcaatttattttgaggtctttgtccaggaattgtggattttaattcgttcaaagtaacatcaacaaatatcagctgaagagtttatttttatgtgtccaatactgttctgtggggagtacaaaaatatatggcttatttctcaaggaatgtatagactggagaaacaacacataaatatatcagaatgttttaaatatagcatagagtgccataaagtgtaaattagactttaaatacctgaggaatttaagtaagggataggtcattataagttgagtgaccaaaaaagaatagtgatagaaaggacatgcaccttaagttaaaagagcttaaggcaggggactcccggctttgacacttcttgcttgtacacattaggaaaacatttggtctttctgagctgtagcttcatcatcggtgaagtgtgagtaacaacagtatttaacacagagtggttgtgaggcaaatgagaagacatatgtgaggaggaggaagagtaggaatggcagtgtgggatgcaagaattctgcatgtagccggtgatatgagtgagacggactaaattctgttgctattctgtcccctccagctgcccctgtaagagccacaccaatttcagtttcttgtgaggaagacatttaaaacatttgagaagcactgacaatggatgaggctgccttgggaggttgtgcaccccaagacgccacttggggagtccaagcaaagcctggggaattgagttccagagaatttgggggagaattcccacctgagaaggaggttggaccaaatgactggaaggaactttctgcctcaagtcttcttgagtctgtgcttctctatcggagagttgggtgagaactagctctctctgttcagctaatctgctttctttgcttctcttgtagcctcttcagaagaaacttgactccttcccagctcaggacccttgcaccaccatatatgttgctgccacagagcctgtcccagagtctgtccaggtgaggcatctctctgcctactctccgtagagagggaatacatgaaggaggggaaaatgaggaagttttttttttttaaggtgggaagagggagaggatcagggaaaatagctattgggcactaggcttcatacctaggtgacaaaatactgtgtataacaaatcctcatgacacaagtttacctatgtaacaaaccagcacatgtacgcctgaacttaaaataaaagtaaaaaaaaaaaaattaaaacaaaaacaaattaaatgaaacagattgatgagtcctggactggggaagggaggccacagcatgcaggcaaaaaggagtctctgtggctttggttttccagtttccatgaagcccccaatacctgctcacacggggccactgctaaccccctgctggccagtgtttccctgagagttgtccaaggaccacatcagaatcagccagcgtacttgttaaaaataaagattcctagggacttccacctaggattctgttaaatgaaaatgtctatggagagtagccatagacctacgtatttaaaaaacccacaccccaggtaattctgatacacactcaagtttaagaacagcagctggagtccaggagttctcaactccagctacaaaacagaatcaccagggaagcattgtaaaaatgctcatgcctagactctgtgcagccccatttaatcagaatatttaggggtggagatctgcataggtgttaagcctagaagagaatatggggtgcagctcaaaatgatacttgcatattctaccctattgcaagatcagcagggactaagtttacttcggacaggaatctttcctttactgaatgaatagaaataaattctgggctgaaatctttgctccatttgggctctttcagaagagagcccaggatgatagaggcacaaaggtcacacaaatgcctgcatccaccttatttttcaaagctcctaccgcacacacactcatccagaaatgcctgggcaggtgccctatatttcaagatgaaaccaatcttcaacttgaggtccattctcacttcactgtcatatctaagaaggaagtaaaaatataaacctgacttcaaagcttcaaaaaaatacatagatttttaatgaagtttacttaaggacaaaaacagtatgctatagttaacattttatggcaaaacccttaaattctattttctttgtttctttgacatgagagatctttgcgcataaccctcttctccccttcctctctcctgccaataccacttttctcttctccctttgagtcccactagactttttaaaaactcaataatttacaactctcttggcttcccagattgtgacccatatgtaacagcaaaacaaatggttttccttacaaggggatggaaggggagagggcaaagagggagacagggcactgagtgctggtcctcagatcatgctccccataatggcatgcttatgcttggaagggagctgtggcccttgttgcaggtggagaagcagtgtgggaacccaagtgctgtcccagcaaggccctgtctgtgacagaccctgcacaagccatgatctctaagaccctttccttttcctcagcagtgctgttttcatttgcattctgtgaagtgagtatccagtccctctactcacagacttctgctttgtccccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgagatctctgagttttgaacagtggactggaaaccatgtaagagccttaaaagtacagttctgtgcaaatggcattcagttttaaagaaaaacgtagcaaatgtttgatggtgctgttacaaaggagcttggaatactcagaggaacttgtcccatggtgatttttcacttctcaaaatgatgtttaaatcccagttctctgttgattcccttgaacaacaaacctggaacctcagctaagactctctgtgaccagattctgaacctcttatatccagggcttcaaggggtattgcaggtcaaggtctttcctaggcactttctactccctgcatacctctcctcacactaaatttatcctctagtagaaaattaagttattttggtctaacagcttcaaatctttgaatgctcaataacttattttgcaagctgcaggcagaaagagactttttaagtaaagtcctttgttttttcctattctctgcttttagacaggctgtcctcaatttaagccctgctttttcttattgtttcttatataaacttggtaagtactgtaagaaacagccactatcataccattgcataataaggagcaccaacttcccagctcaaaactcaggtccttattgccttgtatcttacctcctctatgaggtcaattcacattgtaagcctgttgcttagtgcatctcgtttcctggtaccagcttctttaatagagttcttagttgcaatcaacagaagctggctttggcttttttatgtagaaaaggaacctattgaaaagatactgattggttccaataactgctagaagtttctgcaaaaccatgctttgaaagtgagcaggaaaagaagagactaggctgtggctgggagcacagccaaaattacaaaaccagcccagggatgatgatcctgttcatgcacagccactgtccccagcactaggcacagactctaccactgcctcactgtctctgctggacttggaaacttgatattactgttactgctgcactgtctgccatgaaaatgaattctccagggtcccttcttcatcctttcatctctagcttataattcaaagtctgggattgagtggccaatcctaggtcacatgtccatgtcctatctccaaggggggctgggaattgaatatctggcattttccactttcacttcttatgaattaaggaattctacaaataatagaagtgggattcaggtggtaggcagacaaaaaagcctcacaattatccactacgccacccttgtataaccttaccctcattcactgtctactctcaaaactgtggagctactaatgaagatttgtaaaccctgggcttatgagcacccattcctttactacaactcagattgctctagaagctcagttcccagcacttggatttttccagtagctgaattctacctgaaggaagggcagaaacaaagggtgaagaagaggctatcacttccaagtatcctgcacccctgggctcaagacctcactggggagggagtcttttgggccacccaccaaacagcactggcattatgcctctcaccctagaccatggttacacgtggtaaaacaaccccttctggtgatacattcacaactctctagtttcccccaaatggcactatggggagcgggagcttgccttttcctcagacttaaaacaataagttttccccgtgtttcccctctaatgctgttttcttttgaccaagcatgtctgaattctagagaagtcaggaggaacacacccattctcggtttgaagggactgatgttctgaagtacaactgggcacagtcccaggctcttcaggacgcttcctccattcacacagcggggatgtgattgttacagcgggtggtgtgtgctggctgagaagccactgtgaattgattcttcttctgaagtttatgtttctactttttggaaatgaataaattacagccagtccatcaaggaaattgcaa

SEQ ID NO: 636 - DNA, 20320 bp, Human
gataatcttttcatacaagatgcattctgcttttgtgggcctcttgcagccctcaagcccccatctgatttgtacacaatgatccagtgggccagaggagcccagagccatgagcggcccatccctccaagaactatttctgactgtccagtatcatggagcaagtggaaagaagaaaaaaaaaacccaattacttttcgaagagcaagatgaatgctgtagaaggagaaggaaggggagggagatggatgggtgccgattccagaatcttcagatctgcttggatgaatcattacctatgatttgcgggacaagaatctgattttattcatcaaccagtagaaacttttctttctgcctcccaacatctgaaatccaacaaacatgtgccttaggaacataccggtcatcttttagaggcattttatatacatattgagtaactagaaaacactctttccgtaatacacacacacacacacacacacacacaccatcttgtcatacaacactcccacgcaagaaaagcgaaactgctgtttgatgaatgtaaacacttggctgtttgcagcagtcgggagtcctgccaggtttaagtgctaagatgggaggtgaaccccaggggtttccccctgcccgtgctgagatccttatttggtcaagcttctacctatgccctggcctcggagcgagcccgatagcgctggatcacagcagagggagcgaggcggctgacgtcccatcccgaagagatgaatggaattccaggaagctagagtcatgctggcttgggacagtggcttggagaccagacttcaatgacagaagcactaggcagcggcactcatggcaatgtgtgcacccacagaaatgtaacccacacctcgggttcaggagccgaaaaatgaaaagaacgtttagggaggaaaaagggaaatacaataataggcagagagtaatttattactctatgggtctgctctgtaaatagctgaagactctggagccagatggttctgcaaattctccaaacaggagtcacgttaagaagcacgagtgggcacaaaaactgtttttcaagacacaatttcaatttggcttgtggaaactggatacgagtaagtttccttaaaattcgagtagaaagcagctgtcctccccgggccccttgatgagaatacgcacaccgcccccaagcggccggccgagggagcgccgcggcagcgggagaggcgcctctgtgggccccctggcagccgcggcaggaaagggcccgaaggcagcgaaggcgaacgcggcgcaccaacctgccggccccgccgacgccgcgctcacctccctccggggcgggcgtggggccagctcaggacaggcgctcgggggacgcgtgtcctcaccccacggggacggtggaggagagtcagcgagggcccgaggggcaggtactttaacgaatggctctcttggtgtcccctgcgccccgtcggcccatttttctttttacaaaacgggcccagtctctagtatccacctctcgccatcaaccaggcattccgggagatcagctcgcccgaaagcccctgcgccaccccgcgggccctcctaggtggtctccccagccccgtcccttttcgggatgcttgctgatcaccccgagcccgcgtggcgcaagagtacgagcgccgagcccgtgcgcgccaaggctgcgtgggcgggcaccgacttttctgagaagttctagtgctcccaagccccgacccccgcccccttcactttctagctggaaagttgcgcgccaggcagcggggggcggagagaggagcccagactggcccccacctcccgcttcctgcccggccgccgcccattggccggaggaatccccaggaatgcgagcgcccctttaaaagcgcgcggctcctccgccttgccagccgctgcgcccgagctggcctgcgagttcagggctcctgtcgctctccaggagcaacctctactccggacgcacaggcattccccgcgcccctccagccctcgccgccctcgccaccgctcccggccgccgcgctccggtacacacaggtaagtcgcccccggcggccgccgaggaccaaagctgcccgggacatccacctggagcgctgaggcttcagtccctctggtggaccccggaacctacactctccccgctcgcctaccccagcccgctcctctcagccgctggaggactcttcagggcaaggctccagagccatcctctccagccttgaggttcacaaaccaactcatcaggacaccccaagatttccttactctctgaagtcctccttaagcctttgtatcagcactccagggaagagtctgtacttccccgtgccctccctgcaaccccaaactacagttcctgatcttgctcaccttcgacttcccaaaagcccccaaattgttggtcttgcgccccccacactttaaaaccagcatctctttcctccacctctctctctctctctctctctctctctcatgctctctggaaagtaatcctgttgtccttcatttcagcaaacgcggggtcaaagagggatggtcccggccctgtccccatgcccagccccgtttctgcgcaccgtccctccctgcctagctgatctctgaccctcggctcttgtgcttcctgctacaggatccctgctgggcaccaacagctccaccatggggctggcctggggactaggcgtcctgttcctgatgcatgtgtgtggcaccaaccgcattccaggtgagtttgtgtggcacctttaggggaaggagggacaaggaagaggtgctggctatcccaggtgtgccccctcacgtgctgtcctctccctcttgagcctgactggacatcaggacgcagcttcactctgatcctggtatttattcacctctttcagtggttgccaggagttttcaccccaaccctttgtctccacccctaaggactcagccccctactgctggtcccagcctagaaagctcactttgtgttctctcctgtctaacagagtctggcggagacaacagcgtgtttgacatctttgaactcaccggggccgcccgcaaggggtctgggcgccgactggtgaagggccccgacccttccagcccagctttccgcatcgaggatgccaacctgatcccccctgtgcctgatgacaagttccaagacctggtggatgctgtgcgggcagaaaagggtttcctccttctggcatccctgaggcagatgaagaagacccggggcacgctgctggccctggagcggaaagaccactctggccaggtcttcagcgtggtgtccaatggcaaggcgggcaccctggacctcagcctgaccgtccaaggaaagcagcacgtggtgtctgtggaagaagctctcctggcaaccggccagtggaagagcatcaccctgtttgtgcaggaagacagggcccagctgtacatcgactgtgaaaagatggagaatgctgagttggacgtccccatccaaagcgtcttcaccagagacctggccagcatcgccagactccgcatcgcaaaggggggcgtcaatgacaatttccaggtgaggcttcttctctgagccctgctccgtgggatcatctgctagacaggtgacctgccaggagggctacaggaaatcctgtctgtaaactaacgcagcagttctcagattttaggcagcatgagcatcacctggagggcttgtgaaagctcaccctgctgcaccccagccccagagtctgggattctgtaaaactgcaactctaacaagtaccaggtgatgctgatgccggtggtctgggaagcacactttgaaaactactcaaggaaacaagaaatggttttcctttagcagtcagcctgttcaagccttagatactccttaggctcttaagaaaagagcttatttcaaatgcattcccccaattttaatcttgtttgaaatggatactttctatgggcagaatcagtaccactttgctattggatttctcatggggatgcagctggtctcacataaaaggttaaaatagcagttagttgttgctgttacagcttcatctgtgccttaacttctagatctttgcaacggtggctttgaactcccacatttaactctttgacactggaaagtgtcattatatcctctaggcttaggatcagattccatttcctgtgtacccaagtaggctgataactgaattctttgtaaaatactcaagacttggcagaagtcacaattaagattttgaagttgtttggcgattaatgttgctgtgttattttgacatagtgatcttaagacagctctttgaagcttttagaacatctattgtatgcttttcctagcatacagacagtctcccccaaccccatccccaccccgctctgcattctacaagtaatgtgtgtcctctgcccacagggggtgctgcagaatgtgaggtttgtctttggaaccacaccagaagacatcctcaggaacaaaggctgctccagctgtgagtacccctctatttttagggcacatagggaatcagggggaattccaccaaaaacaaactgaggaatttagcaatagtggttatacataaattacccccagtgagatcatcaagaggcatacagaagtgactccaaggggtattatacacacacacgtatacacacgtgcgcatacacgcaacccctctacctgcatccttcacaccaaatgaaacgtcttctaccactaagaactcaagaggctggttggtaagagtatctatttgaagttttcattttgtttcttgccagctaccagtgtcctcctcacccttgacaacaacgtggtgaatggttccagccctgccatccgcactaactacattggccacaagacaaaggacttgcaagccatctgcggcatctcctgtgatgagctgtccagcatggtcctggaactcaggggcctgcgcaccattgtgaccacgctgcaggacagcatccgcaaagtggtcagtggcctctgcacccagcccgttagcatgaaccctggaaggtttatcgcagatggtcccaaatgactgaaaatgcggggggacactaatgatattctctcccatttagactgaagagaacaaagagttggccaatgagctgaggcggcctcccctatgctatcacaacggagttcagtacagaaataacgaggaatggactgttgatagctgcactgagtgtcactgtcaggtaagggaccttcaccagccagaataagaatcgacggcttttgtttgaacctacatctttggggaaataccctaatcgccacagagattctttttatgttccatggcctgataacaaagtgttttttttttctttaagatgcaattatggcatctataagttcttctttaaactctcagatggtttatcaaagtattaattataccccaggctaagtatctaagagaatgaatctactaagacatctgaataatttacctaccttagttcaaagactaagtgttgaatgtcaggtaaataaaacctggttggaacattcatttttttttcccaaccctgatttatattcagctttggcataggttcttttagtacagtagcaattgtttttcaaatcacttagtctgacactgttaggatgttactgtctgctttgctcagatggcactgccaggtgtgtgattcactctagcatccccgcatgccagtggccagtgagtttggaggttcacctggcttatctattaatagcaaagtatttgaatttgcttaaatacaaatcacagatgactggctgtgggaaccaacttcattaaattccctttcttttccaatataaagacagatcacagatctatagatgaggaaaaagtgcttatagatcttccttcctccccccaaacacataatataaaaatgtaaaagtcctggctgaattttctgagtttgatttcagacatagatttgacccatgatgtttgttggttcctctgctataaattctttgtactgtaacttccacccttgactaagtagcaattaaaaagaactttccaaggaatggagtgacacgtaaactagcactagaactgtctctacgatagtggtggctgcaaatatgacagagacagatctatgaaaatcattccactagagcattgacagccctgaccatgttttggcttgtaaaggaaatgttacaggatgtagacttctgtatgcaacatgctcagcagcctgttcccctctcactctcttgccctgcagaactcagttaccatctgcaaaaaggtgtcctgccccatcatgccctgctccaatgccacagttcctgatggagaatgctgtcctcgctgttggcgtaagtttctcaaatggcatagctattcttcagtgactaggtcagttctacatacatcctagacagccgagcacaacactggaaccccacccccatctccatcatgcttccattcagtttcttgctgcagcagctggttaactgacagcttatctgctgtacagagccaaaactccattatgagtacatcgtaattacccatctggattgcagtaatggcagtgaagatcttggtatagctcattaattctgattttttgctttgaggaaaagagatgaagacgtggcagcaacagctctaagttgactgcttttagaatttgaccttagtggcacagagttaagaaaaatctgctcaccagagatattgacaggcttactgtgtaagcattggcctgatcgggcctggaagttttgcccctttcatctgtagggataagagggcctaagagaatagcagcaatctgagctctagagcaccaaaagaaataaggcacgatatcgttccatggcacgttatccctggcttttgttaccagtaaaatgaatgactttgctgagacaatacttagtgtagcaggtacaagttataaaagtgattcattacaactaagataaggaagaaaacaggaaaacagcacttgcccttcacacacacagaaacacacatgcacacacacacaaacacacccttgtcacagctcagaataaccaattccatccagggatcatattagcgatattggcactgtaatggtcgtttttacatttattttctgttccgcattcacttaacatgtgcgttaaaaggaacaaagctagctggaggtagcaaagttttgaacttgaatcagggattgctaagaaaacttacaactaatgaccacagaaagtaagttctttgtcttctgtctgatacagctagatgtgattgtagccgtggtgcctgggcagatggtaaacaaacatgctgtcctcttatgacaatatgtgcagagaaggccccaaacgctggggtgagaggaacaacaaactgactaactcacggccgagttggagccagaaccaacaacagctcggctgccttcacactcatctgtcaaacacatggtgtatggctcccctgacagaaatgactcctataagcttcctcatactcgcgcattcttggaagtctgagactggaaatgcctacccagatatgttaagtcagtaaaggaaaactcatttgcaatgctgagaggagaaagaaaatcaatgaataggagagcatacactgtgggaaggctcagctgtactgagccaggcaaagcatccgattaccccactgctgtacacatcatgacctgggataaacccctgggccgttggcctaagaaatatgttgcttttcatcctgtataactgcaactttgtgccggctcatattatgttctagagagctcatgtacaccatggtgaccatagttaataatactggattgtatgcttaaaatttgctaagagagtagatcttaagtcatcaccaaaaaaagtaactgtaagatgatggagatgtgttaattagcttgacggtggtaatcacaatatatgtgtatatcaaaacatcacattatacaccttaaatgtatataatatttgtcaattatacctcagtaaagccaaaaagaaataaatatattgcttttcaccctctggcaagtggagggccctgaacagagccctctaaagaacagcttgtcctaatcatcacgtacctgatgaacctctgtttcccctgcagccagcgactctgcggacgatggctggtctccatggtccgagtggacctcctgttctacgagctgtggcaatggaattcagcagcgcggccgctcctgcgatagcctcaacaaccgatgtgagggctcctcggtccagacacggacctgccacattcaggagtgtgacaagagatgtaagcatcttagcctctcagggacgtggagaactgacctgtccttgttgtcgtcaccaagggcagctccacagcatgtatattaagaacacgggttctaggatctctggatcccaatcccactgcttagctgtgcacccttgaacacaacttaccctctctgaggctctttcctcatttgcaacttggagataataatagttcttgataagtttatcttgagcattttatttagatactgcatgtaaagcagttagcactgagttttggtttatggtaagcaccctgtaaatgttaggatattaacagcaacccataaaaacagcgaacttatccgttctctggtagaaaacattccatgttgacatttgggcatgtggccaggagccaatttctaccgtacactgggtttagttgccattgaccatttcctggaaatacttctgcgtgctcctgatgggagcctctatttggctgtctctaagccaaaaccatttgtgaccatcaactctgtactttagttaaacaggatggtggctggagccactggtccccgtggtcatcttgttctgtgacatgtggtgatggtgtgatcacaaggatccggctctgcaactctcccagcccccagatgaacgggaaaccctgtgaaggcgaagcgcgggagaccaaagcctgcaagaaagacgcctgccccagtaagtgtgaggtccgctgcaagggtgagcatgggcagcagctctgcccagctggttgcctggcatctgcagcctgcagttcagtgggtcatagagcaggaaggttacctactagagaaacaaacagaagcaaagtcctgcaggctcagcaacttcttttaatgaaaaacaaactcaccctcttccccagcattctttccatgtgtcagagaagcagaggtttcttgaacgggcttaggagagtctatgacaagggagggatttgaaagttgatcttaattgttgcctgtggttcatcttcttacagtcaatggaggctggggtccttggtcaccatgggacatctgttctgtcacctgtggaggaggggtacagaaacgtagtcgtctctgcaacaaccccgcaccccagtttggaggcaaggactgcgttggtgatgtaacagaaaaccagatctgcaacaagcaggactgtccaattggtgagccacgcagcccaggatgaaacgacccaggagctttgctcttttactgaatgctgcagtcagcattcgaggagattccagcttggttagtcctgagcgatttgattgctctaagatgcaggtggacaacataatcccaacaagttatcggttccctataccctataatatcttacactgtgttaagtgcccagcatggcagtatggcagcttagaccaaccatttactgtgactgtctctctctccttgtctcagatggatgcctgtccaatccctgctttgccggcgtgaagtgtactagctaccctgatggcagctggaaatgtggtgcttgtccccctggttacagtggaaatggcatccagtgcacagatgttgatgaggtgaggaactgatggggctccgagtttctggatctaggaaagcagctaacctgtgcagtcgcttccttatggcagtgacttctaaacatgatgcacgctcttatttcctccatagtgcaaagaagtgcctgatgcctgcttcaaccacaatggagagcaccggtgtgagaacacggaccccggctacaactgcctgccctgccccccacgcttcaccggctcacagcccttcggccagggtgtcgaacatgccacggccaacaaacaggtacagtcaactagacgagtaaaccagaggacaggagagctgtccttgaccaaaataactgggagcgggaggaatgtaatttcatacccttcaccaaaaaaaaaagggcgaggagatgaatgtacggtctagttttagaaacgtgattagaaaatccatggtaaatcctgcaggggaaaaacagtcttccatatttaaaaatgctgctctggaataagttgtgagcagatggacttgtaaacgcctaggtgctgagcaaattcaagaaaaataaacataaagcaaagtttgcttatagcctcagggagaatggggagggacagaggtaacccacactcttccaaatggagcctctgtctactcagagatgacagggatctggattcttgtttccatgatatctgaggattctcaaaagctctgtgtaacagcagcatggtgtaccctcaggtgtgcaagccccgtaacccctgcacggatgggacccacgactgcaacaagaacgccaagtgcaactacctgggccactatagcgaccccatgtaccgctgcgagtgcaagcctggctacgctggcaatggcatcatctgcggggaggacacagacctggatggctggcccaatgagaacctggtgtgcgtggccaatgcgacttaccactgcaaaaaggtagagccaggtcctttgtgtgcctccagaaagagggcccatcaccttatcaaaacacaggctaaggaattttaaatacttaaagtttggacatgaaactgaaagattaaatctcccaaagggagaggggcactaattcctattaaaattaaatcacttggtgccaaaaacatgaacagggctagctctttttgggcaactgtgttccatagtcaactcttctgtccaaaaaaaagttcagtactctatccaaataccagcaaagcatgacttgtgttcacaacatctataaagcctagagcatttacacaaattctgtatgtatatcccccaagaaaagttttattttcttgtcttcccataaaaaaaatatgctgttactgagccaaattctgttctttttctatttggaattccaggtacactccctcgtgcatgagctcagcatgaggaaggcaactgaagcagtgatatatatcttctctttcctaggataattgccccaaccttcccaactcagggcaggaagactatgacaaggatggaattggtgatgcctgtgatgatgacgatgacaatgataaaattccagatgacagggtaaaaacagttttctatccctttttcatcttttcagttcagcaacagcctgaaacactttgggattcaaggaaattacatggctatagcaaaaaatataccaaatcaatacacaggataattagaaattattcattgtgttccagtagtttaaggatgtagatgttgccaagagaatttttaaatgagggttttgtttttcatcagaactgtttttctctgtacttgagaaattataatgcataaacaaatgccactttgttccctagattcatttcaaatgtcacatcgaaattacagtaaaattgactttgggcacactatgaactgagatgatgggattatattctacatctcactaacttctaacccacagggatccatttttttaactatgtccttttaacttttgtagtgatcgttttacactgagtgatcaattagcctatccactaggtagaaagtattgctgattttcacagttttagacatattatgcacatggtttgaggcttgagctgttttcaaggacaacattgttaagtgctccatttcttctctttgcaggacaactgtccattccattacaacccagctcagtatgactatgacagagatgatgtgggagaccgctgtgacaactgtccctacaaccacaacccagatcaggcagacacagacaacaatggggaaggagacgcctgtgctgcagacattgatggagacggtaaggtgctgcctgatcagagggcccgcgggagacagggacatgcacagctttccaaacgtacttctgtctagtcctggctattagtatgcactttggtggaaacatccaaggctggagagcccagctcttatttgtcccttgttctcttcaggtatcctcaatgaacgggacaactgccagtacgtctacaatgtggaccagagagacactgatatggatggggttggagatcagtgtgacaattgccccttggaacacaatccggatcaggtaggtggatggactcctttcagagtctttcagtaaactgttggaatatccctttcatggcctttgaaaaatgagcttaacaaagttcaaacactttcattactgtggctccctggcttctcatagccaactggaatacgttcatgtaaataatttgcctgatgtgagctccttgcacagagtctcacagatctttagcatgaagatctggtaacttcagtcttaccttctgtaagaagggctactggacttgctcagcatcgtctaccattgttaagacaaattatacaaagcagacatctgtgactgacaactgtacaataatattaatcatatgtaatactaagagatggaaaaataaatgtgcataagcaaaataaccattttcatggctaatgatgtaatctagctataagaaaatcatcaaactaaggatacatccaaaaccaaagtaatttatccctgtcataaacattacccagacagtatacaacacagggaccagtggtctgtttccatcttttcaggacttttcagagaagtcgacgtgtcaacagttttacaactgaaaccttctaaggaaattctctgttataaagtatccagaaaatttcatttaacattaagatgtaaacagttaacatttcatttcatctttagtaattaaatatcactctatttgaccttatttagaaagttttatatgtaaaacatttttaaattatcccttctcagatttttatacgaaaacaaagataaaggaaaaaaacttttaaaatgtaattgctactattgctatctttctgcaggagtgtgtaaatagacatgacaccccactggctgtatcaaacaatggagaattttccctgtggtgggggcataagttatctttaacatgaatggtttatactgcaatttaccctccatttacatctctctttcagctggactctgactcagaccgcattggagatacctgtgacaacaatcaggatattgatgaagatggccaccagaacaatctggacaactgtccctatgtgcccaatgccaaccaggctgaccatgacaaagatggcaagggagatgcctgtgaccacgatgatgacaacgatggcattcctgatgacaaggacaactgcagactcgtgcccaatcccgaccagaaggactctgacggtgagtcatgggagccactttctaagacagggactgctggcacagctgtgtagattgaagaaatgaaaccaaggctcaaagcatttgacaggatgaagggaccaaatgccaacttagacaagatagtgacatttctgacaccagtaataataatagcactttagaattttgctgaactcttgcttttttgacctcaggcgatggtcgaggtgatgcctgcaaagatgattttgaccatgacagtgtgccagacatcgatgacatctgtcctgagaatgttgacatcagtgagaccgatttccgccgattccagatgattcctctggaccccaaagggacatcccaaaatgaccctaactgggttgtacgccatcagggtaaagaactcgtccagactgtcaactgtgatcctggactcgctgtaggtgagtagcgagttcttagatcctaagagactgatgcatacatggggaaaaacaaatataaaacctggcagttgtacctatccctgtgggtgctgaggatgtctaggaacatgatggagaaccttctgaaggctgcaggttttaacctggctctgggctcttcttccaggttatgatgagtttaatgctgtggacttcagtggcaccttcttcatcaacaccgaaagggacgatgactatgctggatttgtctttggctaccagtccagcagccgcttttatgttgtgatgtggaagcaagtcacccagtcctactgggacaccaaccccacgagggctcagggatactcgggcctttctgtgaaagttgtaaactccaccacagggcctggcgagcacctgcggaacgccctgtggcacacaggaaacacccctggccaggtaagaagcaaagccctggaacagagagagagcttatgggtgcctgactagcactggggatgctgtgctttgaccaagactctgaccagggagtcttagaaagttcccagcatcaccagctgcagcattgaactctgctttgtaaaaacataatagtgttgaaaagggagcttgaccaagaattgccctgcaaatcctaaggtgccttcagccttttcaaacaaaaaaacctccttccctcctctctgtactgctttatatgtgtgctcagtggcacacaacaaatatgagaggacttggaaaaattccccattgcagccctctaacttagatcagctcagtacctttcaagcattgtttctgatggaatgaaatagaaatctttacctgaaggagctgtgtttcaacctttccttttccttttccttcaggtgcgcaccctgtggcatgaccctcgtcacataggctggaaagatttcaccgcctacagatggcgtctcagccacaggccaaagacgggtttcattaggtacgatcatactgattcactttcacttacagtcacactgagggacaaaaagacaaaaagtattaaatagcattgtcactaaacaagattttttttccctgcagagtggtgatgtatgaagggaagaaaatcatggctgactcaggacccatctatgataaaacctatgctggtggtagactagggttgtttgtcttctctcaagaaatggtgttcttctctgacctgaaatacgaatgtagaggtaagagcaacatcaccatgaatgtacactggacatctctatttcagactaatatcaaggatgacggttatgggggagtccagtgtaaagactgttttggagacagggttatttctattttgcttttgaggacacaaggacaaaaatggaataatgcctaggcactgtggcttatgagttcctgagtccttagctataatattagtttgcttagcaatctctgtgctcctcatacacagtgcaaaggtaagctgcagaaaagctcctatataatttggacttcattaataatactgttctttacaattatatatttatatatcttactgcttattgttttatgcatgccatcacagcacgagttagcattcccaacttttccctgtatacaaagaagggagaggaatgttgctttcatattggcatgttaaattaatgttcactattaaacttagcattttttttcctcattcttttttacttagtcattacttaagctcgctgagtccaacactggctctaccacaaaataagtgcttaatatatatttactgggccaaggccagatacctaaaagatcaatgacagtagagaaagatggttgattttactcaaaaaaatctaaattattaatgtaatttttgagtccaaatttttaaaataagactccctaaactgttaacattgaaagcctttggaaagcataatatatgttctggaaggttcacgctgtgtcggtctcctagcatcaatgtcagctaataaaattaaatgctaatgtgcttgaacaaccttaaaattaggcttttgtcattagaaaagtagagctattcctatgtggttaacttattaactaagatgtctatgcttttatgaattagttttcatttgtatatttatttatatttgtttatttaacagatccctaatcatcaaattgttgattgaaagactgatcataaaccaatgctggtattgcaccttctggaactatgggcttgagaaaacccccaggatcacttctccttggcttccttcttttctgtgcttgcatcagtgtggactcctagaacgtgcgacctgcctcaagaaaatgcagttttcaaaaacagactcagcattcagcctccaatgaataagacatcttccaagcatataaacaattgctttggtttccttttgaaaaagcatctacttgcttcagttaggaaggtgcccattccactctgcctttgtcacagagcagggtgctattgtgaggccatctctgagcagtggactcaaaagcattttcaggcatgtcagagaagggaggactcactagaattagcaaacaaaaccaccctgacatcctccttcaggaacacggggagcagaggccaaagcactaaggggagggcgcatacccgagacgattgtatgaagaaaatatggaggaactgttacatgttcggtactaagtcattttcaggggattgaaagactattgctggatttcatgatgctgactggcgttagctgattaacccatgtaaataggcacttaaatagaagcaggaaagggagacaaagactggcttctggacttcctccctgatccccacccttactcatcacctgcagtggccagaattagggaatcagaatcaaaccagtgtaaggcagtgctggctgccattgcctggtcacattgaaattggtggcttcattctagatgtagcttgtgcagatgtagcaggaaaataggaaaacctaccatctcagtgagcaccagctgcctcccaaaggaggggcagccgtgcttatatttttatggttacaatggcacaaaattattatcaacctaactaaaacattccttttctcttttttcctgaattatcatggagttttctaattctctcttttggaatgtagattttttttaaatgctttacgatgtaaaatatttattttttacttattctggaagatctggctgaaggattattcatggaacaggaagaagcgtaaagactatccatgtcatctttgttgagagtcttcgtgactgtaagattgtaaatacagattatttattaactctgttctgcctggaaatttaggcttcatacggaaagtgtttgagagcaagtagttgacatttatcagcaaatctcttgcaagaacagcacaaggaaaatcagtctaataagctgctctgccccttgtgctcagagtggatgttatgggattctttttttctctgttttatcttttcaagtggaattagttggttatccatttgcaaatgttttaaattgcaaagaaagccatgaggtcttcaatactgttttaccccatcccttgtgcatatttccagggagaaggaaagcatatacacttttttctttcatttttccaaaagagaaaaaaatgacaaaaggtgaaacttacatacaaatattacctcatttgttgtgtgactgagtaaagaatttttggatcaagcggaaagagtttaagtgtctaacaaacttaaagctactgtagtacctaaaaagtcagtgttgtacatagcataaaaactctgcagagaagtattcccaataaggaaatagcattgaaatgttaaatacaatttctgaaagttatgttttttttctatcatctggtataccattgctttatttttataaattattttctcattgccattggaatagatatctcagattgtgtagatatgctatttaaataatttatcaggaaatactgcctgtagagttagtatttctatttttatataatgtttgcacactgaattgaagaattgttggttttttcttttttttgttttggttttttttttttttttttttgcttttgacctcccatttttactatttgccaatacctttttctaggaatgtgcttttttttgtacacatttttatccattttacattctaaagcagtgtaagttgtatattactgtttcttatgtacaaggaacaacaataaatcatatggaaatttatatttatacttactgtatccatgcttatttgttctctactggctttatgtcatgaagtatatgcgtaaataccattcataaatcaatatagcatatacaaaaataaattacagtaagtcatagcaacattcacagtttgtatgtgattgagaaagactgagttgctcaggcctaggcttagaatttgctgcgtttgtggaataaaagaacaaaatgatacattagcctgccatatcaaaaacatataaaagagaaattatccctaagtcaagggcccccataagaataaaatttcttattaaggtcattagatgtcattgaatccttttcaaagtgcagtatgaaaacaaagggaaaaacactgaagcacacgcaactctcacagcgacattttctgacccacgaatgatgccttgggtgggcaacacgattgcatgttgtggagacacttcggaagtaaatgtggatgagggaggagctgtccttgcaatgttgagccaagcattacagatacctcctcttgaagaaggaataataagtttaatcaaaaaagaagactaaaaaatgtaaaatttggaaggaatccataaatgcgtgtgtgtctaaatacaaattatcatgtgaagaaaaggcccaagtgtaccaataagcagaccttgatttttggatgggctaattatgaatgtggaatactgaccagttaatttccagttttaatgaaaacagatcaaagaagaaattttatgagtaggttaaaggtctggctttgaggtctattaaacactagaaaggactggctgggtgagataaaatcttccttgttgattttcactctcattctataaatactcatctttctgagtagccatgatcacatacaaatgtaaattgccaaatcattttatagtaccaaggtgaagaagcaggaactagaaagtgttgataatagctgtggagttaggaaaactgatgtgaaggaaataattctttgaaatggcaaagaattaaataccatcattcattatcagaagagttcaacgtttgaagtgctgggagataattctaattcattcttggatagtgaagcaaaactgattgaaaataccaagataagacagaaaaagtgactggaaagaggagcttttcttccaggcatgttccagtttcaccctaagactgaccttcaaataatcaggttgtactgaaataaaggacttgttaaaaattaaaattatgtcatcgagatgatagcttttttcctcctccaacagtttattgtcatgtgttgtgggagagctcgagtgaagagcaataaactccaggtcttataagaatgtacatacaataaaggtggtgccagcagtttttttttttctaaagagtcacatgtagaaaagcctccagtattaagctcctgaattcattccttaaataaattggctctctctctcttctataatttctttttctttttatttttgagatgaagtcttgctctgtcgcccaggctggagtgcagtgacacaatctcggctcactgcaacctctgcctccccggttcaagcaattctccctcctgcctcagcctcccaagtagctgggactacaagcgcccgccaccaagcctggctaattctgtatttttagtaaagacggggtttcaccttgttccggacaaacactaagccctaaagggaaatccaaaataaaaacatctatttttaataacactttctatctaaatcagggtgactttttaaaaaaaatccggaagctttgtgttgaattacgttacagacttagttaccagtccttgttagagttaccttcagttgacatgctgtgaatggtcccacctcttttatggcagaattcattacttaaaataactctattttcttcccccttacctaaataacagaaaggctcactatgtcccaaatatcattggcagaagcaaactataaagtcataagccctttgcagtgcaagtctagaaataatt

SEQ ID NO: 637 - DNA, 6392 bp, Human
  misc_feature (1)...(6392): n = A,T,C or G
ccagataagtttgcacatctaaattggggaacttttgtaaccgagggttgtttgtagcagctaaattatttaggttctctgtgctcattgagatatgggaggggatatgtgaagaggaatttggtgctttgctgatactaatgccctgcttgtctaatggttctaggggattttgaataagttccttgtgagaactgggtagctgtgtaatcacggctgaaagggtctctggaggtgaggactgcacactctagagttcatcccaacacagctccctctgttctcatacgccactggaatgctgaccacaaaatggtgtcttagctagagcagtttgaatactggtacaataggcataacctagaacagtgcctaccactgcatggagaataaatacatatttgatgaatgaatgaaaaaagtattctgaataagagagaggaggaaacaactccctttctcaaaacctcccagtgttctccaccctctcatcatttttggaatagaatcccaactccttgcaatgatcaacaaagcctgagtgatcttggccctaactcctctcatcttccctaactccttactaacattgaccttcccgttccttctcagacaagccaagctcaattccatctcaggtcctttatacttgccttttcttttgccagaaatgctgtaggttacccagatcttcccataggttactcattcacttcattttgatttctactctagtgtcatcatctcaaaaaggccttctctaactaatcactcaaaaatagccacccccaagcactgtctcatacctacaatttaccctgctttatttttctctacagaacttatcactacaggaacttgagtttagtcattcatttattttctgtctccccactagataaaaactccttgagaattcggactttatcttgttcactgctctatctccagttcttaaaacatggccagtaggtgatcaataaatactggttgaataaataaatggatgaataaatggatcttctgagaggccttttatcaggatctaattaccttttgagtaagaccaaagttagacccaaaccgtgtataggtcataaagggtaatagaagagcagtcccaataccaccattaggaacacctcttgagaaagtcatggggagatgtacgtcaaagagtgaaagtacaccagttgagtcttagctggagttctaaataattttgggaagcttggggccagaaaactttctatgaacccacctgtattagtttcctgaggctgctgtaacagatgatcataaacgtggtggctttgccctcaacgttctggagagcagaagtcgaaactcaaggtgtcagcagggccaccatcactccagagcctcctctagcttctggcgcctgttgatgttccttgccttgtagctgctgcactccagtctctgcctccactgtcacaaggccttctcctctgtgtctcaattgcctcttctcttgtctctttgtcaaatatccctctgcctttctcttaaaaaagcacttgtcattggatttatggaccacctggataatttgggatgatctcctcatctcaagatccttaactttattatctctgcaaagaccccttttctaaggaaggtaacattcatggtttctggggattaggacatggttaagatgtagacatatcttttggtgagccaccattcaacctattacaccatccatattaaaacttatttgattagagctggcatcattatttaccaatatatatacttctctagttttaggccatgtaacccaaaagaatgtagcctccactttataagtctgtaacaaaaaaaagtttaatgtcagccatgactaatttcgtgtattttaaaaatgtatgtaatgtatttcatcatttcattattttttttctagaatctgtatctgtatcaagatgatctgaagaacagcttctacctttaggaatgtctagtgttccaaaatgactagcatcttccattttgccattatcttcatgttaatacttcagatcagaatacaattatctgaagaaagtgaatttttagttgataggtcaaaaaacggtctcatccacgttcctaaagacctatcccagaaaacaacaatcttaaatatatcgcaaaattatatatctgagctttggacttctgacatcttatcactgtcaaaactgaggattttgataatttctcataatagaatccagtatcttgatatcagtgttttcaaattcaaccaggaattggaatacttggatttgtcccacaannnnnnnnnnnnnnnnnnnncacaacaagttggtgaagatttcttgccacccctactgtgaaccctcaagcacttggacctgtcatttaatgcatttgatgccctgcctatatgcaaagagtttggcaatatgtctcaactaaaatttctggggttgagcaccacacacttagaaaaatctagtgtgctgccaattgctcatttgaatatcagcaaggtcttgctggtcttaggagagacttatggggaaaaagaagaccctgagggccttcaagactttaacactgagagtctgcacattgtgttccccacaaacaaagaattccattttattttggatgtgtcagtcaagactgtagcaaatctggaactatctaatatcaaatgtgtgctagaagataacaaatgttcttacttcctaagtattctggcgaaacttcaaacaaatccaaagttatcaaatcttaccttaaacaacattgaaacaacttggaattctttcattaggatcctccagctggtttggcatacaactgtatggtatttctcaatttcaaacgtgaagctacagggtcagctggacttcagagattttgattattctggcacttccttgaaggccttgtctatacaccaagttgtcagcgatgtgttcggttttccgcaaagttatatctatgaaatcttttcgaatatgaacatcaaaaatttcacagtgtctggtacacgcatggtccacatgctttgcccatccaaaattagcccgttcctgcatttggatttttccaataatctcttaacagacacggtttttgaaaattgtgggcaccttactgagttggagacacttattttacaaatgaatcaattaaaagaactttcaaaaatagctgaaatgactacacagatgaagtctctgcaacaattggatattagccagaattctgtaagctatgatgaaaagaaaggagactgttcttggactaaaagtttattaagtttaaatatgtcttcaaatatacttactgacactattttcagatgtttacctcccaggatcaaggtacttgatcttcacagcaataaaataaagagcattcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaggagaatttgtcaaaaatatagaccaagtatcaagtgaagtgttagagggctggcctgattcttataagtgtgactacccggaaagttatagaggaaccctactaaaggactttcacatgtctgaattatcctgcaacataactctgctgatcgtcaccatcgttgccaccatgctggtgttggctgtgactgtgacctccctctgcagctacttggatctgccctggtatctcaggatggtgtgccagtggacccagacccggcgcagggccaggaacatacccttagaagaactccaaagaaatctccagtttcatgcatttatttcatatagtgggcacgattctttctgggtgaagaatgaattattgccaaacctagagaaagaaggtatgcagatttgccttcatgagagaaactttgttcctggcaagagcattgtggaaaatatcatcacctgcattgagaagagttacaagtccatctttgttttgtctcccaactttgtccagagtgaatggtgccattatgaactctactttgcccatcacaatctctttcatgaaggatctaatagcttaatcctgatcttgctggaacccattccgcagtactccattcctagcagttatcacaagctcaaaagtctcatggccaggaggacttatttggaatggcccaaggaaaagagcaaacgtggccttttttgggctaacttaagggcagccattaatattaagctgacagagcaagcaaagaaatagattacacatcaagtgaaaaatattcctcctgttgatattgctgcttttggaagttccaacaatgactttattttgcatcagcatagatgtaaacacaattgtgagtgtatgatgtaggtaaaaatatataccttcgggtcgcagttcaccatttatatgtggtattaaaaattaatgaaatgatataactttgatttaaacagttctgacacataagggatccacttgtttctttgctataactgagttctgaatttatcatgaagtcaagggaagcacctgtttttcttcagtgatgtgtgttctagtgtatcatggccaatattggaaaatgccgtgacttttgtgaatatagctgggtttgtatagcagatttctacagcttttgatgctttcctcatatccatggtgcattcaactcaacttattgatggctgctcgttgataaagctggagacactatgcctgaaggttcctccccaaccccccaccatcatgcccacacaaagggcagttcagaagtgctggaaattgtccttggaaacagccctcaaccaatgtcagaaagagctggtggataaatatcccaactttctcactcattttttgagataaatcaaaaaatggggtatactttacactctccctgagttccccagtaggataaaattctggttgtccacagtagaaatggcttgattaagtattctcgactggcttccttcccatttttttctcacttacttattcctccatgtgtattccatgggatcacctctgtgataaactacttgccactgaatatttgtctcaggggctgcttatgagggagcccagaccaagaaagtgttccacctcagtccaaatgaaaattctgagtctagttttccatgactggagatctcgctgagattctggttgtatgaactaacatgcacaagagcctttgctcttttgattagaaggaagaatatagttgatatacggtgcttctatatatagcatctgtctctttggggaactattaaagtagagcatgagcagatggggcagtgtaaggaatggatatatctgatgcttttcatacccatcaaacatcctgtcagtctacatttttactccagcagccagctctgggcaggtgtagtcttgacaaaaaccttgtcataactacaccatgtatctttcactttatgccccatgacttcactgataccactgcgtgggatgcttgtagaagcctgttctaccattctgatacatgcacaaacctggaagcacaagggataacactacgggatgggaagcattatatacatgctcctttcttctattcttgggttaaaaaatgaggtgtaattgataccttttctcagacaatccctagtggcactgaggtttacttacccacagggtaaccagctcagtaacttggttttgcattgactttccattcttccttggtcactcttctcattcgggtcactcttgagtcctgagatcgctgctccaaacaagcgacctttccttaactcaaggagtctagaaaaaataaataaaataaaaagcaacaaaaaccaaaaagcctacaaatgaccagcccacaaagctctcatctcagtctctacttttttgagtgggaaggaacccaactaacacatacatatctattagcttcttggcctaaagaacttacagtcaatcagagaacactaaacatatccaaataactaaaataaaaatcaatgaaacaaagctataaaatggaagttcagaggttgcttaaattgagtgaaaaaaaatcttagaaatgatgtgtctttttttttttttttccattaggtcttgaaggaagactttaactttggatttttcaatgtgtaatgatgaagaatggaaaggccattctaaacagaaagataaagagagcaaaggcaggtatacccaggcctattcttggactggtatcccagtttgactggaccgtgaggttcatgaaaaaca

SEQ ID NO: 638 - DNA, 19910 bp, Human
atcctcccacctcagcctcccaagtagctgagactataggcatgcaccaacatgcccagctaatttttgtaatttttgtagagatggagttttaccacgttgcccaggttggtcttgaactcctaggctcaagcaatctcctaaagtgttgggattacaggcatgatccactgctcccagccttaattcttttaaaaaggggaaaatgaggtttttcactattgctccaatcaccatcatagctaaataagttaatgcacatagttaagaaatgtacagtagagagaaaacaatctgtgttgtatttagaaactagcaagaattaaggactaataatatctgaatatgaactggtattaagcccaaactactgcatcaggagaccatcaataaaatttatttatcgagagccattcattagtcaaccaaagtcgtgggaaatttaatctgtataaggagtcataaggcataagggataggtatgaaggattgttgagatgatgtgttttatttcgctaataatgcatatgacaccattccaatttttttaaatttaaaacaacaatcatttatttgcttgcttctcaagcctgggtaatcgtgtttggcaatgagaccttgttgcatgcttgctaatatcccactggtcaaagctagtcaaatggccaagcctagagtcagcgtgggagaaggccacacaagggtttgaattctgaggacgagtctctttcattgaaggccaaagaaacagtctacctcagagggttgctggggagctataatgcaaagaataaacctcaccctgccttcaaggcgctcacagagaagaaatcttttgaatattagtgaagttttcctggacatcccaatggatagatgtgagggacagtcacgtactcaggacatctgtttgcttatggtgttatgttacagatgtcacaaatgaaaatcagagacatgtagccctgagcccagtaactataaagcggtctagctgaagctggagcccacaagagggcactttgcaccatgatgcacgcttgtttcttgccatcagctctgcaatgagttcaagctaatgccatgtcccagccgtccagttgttttatgacttgtgtgattgaagcatatggtggcttgtggcatgttcttaggcaaaccactcacctccctaggtttcgttttcctaatttctcaaacaagggagttagattaggtggtctatagttccttccaattgtgatatttcactatataacaatatagttataatagatcatagcacatctgtaatgaaaaaaagtgagttcatttcttaacaagtacatttacttaactagttggagtcattaaagcaaattaagaacgaaattcttagttaatctgaacttttctgggcatactgatctgttccctaacgcgtctgaccgtggaaaagtggatcagcaggagtgggactggctctcagctttgccatgtttggctctttctctgctgtgaaactcagtttcttcctggatcaagaggttaatttctgccggtgttattttacagtgttgcaaagagataaaagccagacgaaagaagggaaagtacttcagctttgattagggatttttttttctgtccctgtgaccatacactactcaattctgacagcttcgcatgagtctagcagaaaattgagggattcactgttattccttaacttgcagaggtccagacccgcccacatcaaatggtgaggtccccactttcaactttagctgttgctaaatctgtgaccctttcaatgaaatccaaggatctcagcttaaaaaaagttaaaataaaataaaaactaggtgtttttcagaggcggtttgaaacgcctctctgaggttgtcagagattgtttttgttttctccctttgcccttcttggaatgcaccaaacataaaagcattttttttcaagctttactttcactttcgagagtgccgtctatttgccacacacttccctgatgaaatgtctggatttggactaaagaaaaaaggaaaggctagcagtcatccaagtaagtgaaggtgttcatttcacgttcttactgggcagggtctctcttgctgagtagagtttgctagcagaatgcatgtggttttagccttctttggtctttctttgatctggtgcttgaaatctagtcagaattattcaggaaggaaagtggaagaaaagggatatgatatgggcatgggagaagggtataactcagaacacaagtaatagcaccaatatctagttaatgtgataatgtatttatgcagtatttaatttttttctctgtagcattctgtacctggaaaaaacacattagggaagctatggaaatcattttgcaacagtctttttagcaaatcacatctttgccttaaagaaacaaaactccaagaggttaaaagagcgtatccccttttgttagttttattggctggaggggagacaggagctggcattgtatgacaatgtcttagataggagagaacattcaggtatgcctaggagtaagtaaatggctttctttcacctaatgaaggataatggaagaagtggagaagtggaaagttgttaaggtgtatgggaagatcagaaactggtatcggcaattgtggggtactcgggtaaaaatggagttggcttcagcaagttgattcccaggtttacagatgattacgtgctggtatgtgtcttcatatgggcgtgcctgtgtatgaacctactacaaaggttgcaaagtttacaaatcaaactatggatagtggttaactccaggtagtctgcctccagaccccatgtcctaaccatcaggcaatattgtctctcacttggacaaagaatgtgaattccatgtgccctcacaaaatatttccaaaattctaaggctgagtgagtctctttttaattttttttcattttctttatttctgctagatctcattcaacagcaacgttttcttcactctcatttcatcctttaactgcatttttgcttgttttactgaagcatgtcctagaataaccttttcatacagatcgtatggctataaacttactgaatttttgcatatctcaaaatacttatacctttttatttagttattcagatggatgtgaaatttccctatcttattttattttattttatttcattttatttcatttatcgatttagagacaaggtctcgctgtgttgcccaggctgaagtacagtggcatgatcgtggctcactgcagccttgacctccctggctcaagcaattctcacacctcagtgtcacgagtagctgggaccacaggtgtgaaccactatggccagctaatttaaaaaaaaattttggtggagatgaggtttccctgtgttgcccaggctggtcccaaactcctaggctcaagggatcctccagcctcagcttcctaaagtgatgggattacaggcatgagccacaggtaattttcttggcctggtcaaaggtaattttcttgttttttagaggtaaggtcttgctctgttgcccaggctggagtgcagtggtgtgatcatgattcattgcagccttaacctcctgggctcaagcgatcctcctgcctcagcctcccaagtagctggaactacaggcttgtgccaccacacttggctactttctaaaatatttttgtagatacggggtctcactatgttgcccaggctggtgttgagctcctgatctccttctgcctacaccttctaaagtgccgggattgtggggatgagccactatgctttgcctggatatgaaattttaaattcaaaataattttctctaaatgtttggaaagcttatctctattgttttccagtggttcatgttactgatgaaaagttttttattaatcaagatctcttttctttggaaatgaaggttttaggatttttgtgtgcatggttgcaattctgaaatttcataggagtctctccaagtttgttcctctttcactcctcctgcctagcatttggtgagttttgcccactgatgaaatgtcttcagatggggcaagtccttaagtcattcagggatatgctttgtaatggattagtccttctcagcaattctgacctatagcaggagccctaccagaggggtacatctcacctaagcaaggagaatgtattgtagggaccttacctatgagttggtaaatagagataggaagttctgaaggaactggaagagaggtttgggacactctcagagagggggcaggtggggagctggtccccagcatttgagaggtatcattgccagccctgcatccttcacgtgcctgggcaagtcagcaaatgcatccttgctggcctagctgtggcattcctcatggcctgtggatataaagaatgtgcacagctttacaatgattagtgccagagttgtaaaggccatgagatgggaatattagtttatggaagccagttttttttgttgttttttctgtttctgagaactaaattagaatattagtaaaatcgctatttttaagtatattagaacaattctatatactcacattagttctgttttcctaggattagtcacctaaggtgattttattacctgacacttacctggaataattttcatgtcatgacttttagatcttgtggaatatctatttagatatcattaccactgcttcatctccataccttgtgggtgtatttgattttttaaaatatctgaaatttggttgttgatcacaccacagagtatcacactgggtacacatcccaccaaaataaagtgtgacaatgtatggagttgagtggctttcctgagctgactaaatgcccatggaaagctattgtatgagtgcattctcacattgctctacagaaatacctgagactggtcatttataaagaaagaggttcaattggctgatggttctgcaagtggtgcaggcagcatagcagcctctgcttctggaggagcctcaaggagctttcacccaccacagaaggcaaagccagagctggcaccttcacatagccggagcaggaagaagagagaaggggaaggtgccacacacttttatttttttattatttattttggggggagtgggggcgaagtctcactttgtcacccaggctggagtgcatgtggtgggatctcggctcactgcagcctccgcttccctagttcaagcgattctcctgcctcggccttcccagtagctgggattacaggcacccaccaccacacccagctaatttttgtatttagtagagacacggttacaccatgttggccaggctggtctcaaactcctgacctcaggtgatctgcccaccttggcctcccaagtgctggggttacaggcgtgagccactgcgcccaaccaccacacacttttaaacgaccgaatctcataagaattcactcactcactatcgggagaacagcaccgagggggtggtgctgaaccatctgtgagaactctgccccatgagccagtcacctcccaccagcccccacctccaacactgggaattacaattcaacgtgcggtgtgggtggagacgcagaggcaaaccatatcggctatgtattcaacatatatttatttcttcagagccaacaaagtgccaggtcttgttctaggcacagacaacaccgtatggaataagaactatgtcctctactattatagcttcacattctagtgagaagcaataattaataataaataatacacaatattggataatttccatcaaccatagcaacggaaaaggcaatctagaagaagagcaaaatgggaggtttcgctcactgaacttcaagacttgttgtaaagctaaagtaatccgaacaatgtggtattggcctaagaactaacaaatatttcagtggaagagagtagacagcccagaaatagaccctcgcttaaaacatttactcggtttctaaggaaagcacagaacaatccggtgggggaaagaagtctctttaaaaaatggtctgactggaccaggcgtggtggctcacccctataatcccagcactttgggaggccgaggtggatggattacctgaggtcaggagttcaagaccagcctggccaacatggtgaaaccctgtctctactacaaatataaaaattagccaggcatggtggcgcgtgcctgtagtcccagctactcgggagcctgaggcaggagaatcacttgaacccaggaggtggagactgcagtgagccaagatggcaccactgcactccagcctgggtgacagagtgagactccatctcaaaaaaaaaacaaaaaacaagatctgactgactggcatatacacacaaaaaaccatgactcctacttcatgcatacacaacaattaacttaggagaggtcacacaccttcacatagaagctaacaccataaagctttttagaggagagtatctaagtaaaggggagtaggaaaatttcttagagaagacacagtaaatgataaaaataaaagagaagatgataaactagatttcatcataattaagaagacatcagtaagaaaataaataggcaactcacacactgggaataaatatttacaaaataggaatctgacgaaggactgacactcagatacataaaaaattcctacaacacaataataaacaggaaacaatctaatagatgagcaaaatatttgaacatataagggaagataaatgaacaataagcacatgaaaattgttaaatatcgttagtcggcagggaaatgcaaatgaaaaccataattagctatcactatatgttcagcagaatgattaaaaataataataaaaataggtaccaaatgttgtcaggaaagttggtggtgcaacactttcccaaaggatctggcagtttcctgtaaaaccaaatggcctcaccaaatggcccaggcattccaatcctagttatttaccccaaagaaatagaacacagtcatgtggcacttaatcatggggatatgttctgagaaatgcatcgtgaggggacttcatccttgtgggaacgtcacagggagtgcttacacagaaactaggtagtacagcctgtggcgcccagcctgcaaaaccagacagccggcgtgtgactgcactgaatactggaggcaattgtaacacaatgggaagtacttgtgtatctaaacatagaaaaggtaagtgaaaatgtggtacaaaaggttacaaatggcacttccatagggcacttaccacgagtggagcttgcagtactgggagtggctctgggtgagtctgtgagtgagaagggaagtggatgtggaggcctcggacatgactgtgcaccactgcagactttatgaacactgcacacttaggttatactaaacctatttaaaaattttactttcttcagtaataattaacttattataactgttttactttataagagttttaatttttcaaaactttttgactcgtgtaataatgcttggtttaaaacaagcacattgtacacctatacaaaaatattttctttgtattcttattttataagcttttttctatttttaattttcttctttttttttaactttttaaacgtttttgttaaaaacgaagacacaaacacacacattagcctaggcctgctcagagtcaggatcattaatgtcactgccttccaccacgtcgtgtcccactggaagctctttaggggccacaacacgcacggacctgtcatctcttatgacaacagtgccttcttctggaatccctcttgaaggacctgcctgaggctgttttacagttaacttaaaaaaaaattagtagaaggagtacactctaaaattatgataaaaagaatagtatagtaaatacataaatcagtaacattcatttattatcattatcaactattaggtactgtaaataattatgtgtgctatattttatataactagtagtgcagtaggtttgtttacaccagcatcactacaaacatgtgaggaatgcattgcaccatgatattatgacggctagattagtaggtgataagaatttttcagttccattatgatctgcagtgactatttatttatatgattgtaaaattgtgattgaggctgggcacattggctcatgcctgtaatcccagcattttaggaggccaaggctggaggatcacttgatgtcaaaagtttgagaccagcctgggcaacatagcaagaccctatctctctataaaatttaaaaaataataaaaaattagccgggtgtggtacatgcctgtagtcccagctacttgggaggctgaggtggaaggaacccttgagcccgagagttggaagctgcagtgagccatgatagtaccactgtactccagcctgggcgacagagtgagaccctgtctctaaaaataaataaataaatacaaataatttttaaaattgtaaataatatttactgactttagatttgctgaattaatgtaggccaaggacctcatatgtaatcatagtttcagggtaaaatgctaacatttcacatcttgacaatgtcaagcaatgttatagctgacagttttaggaaatgtaagaaaggaagaaatgtgaagaaaaatgtatttatttatttaaaataaaataaaaattaactggctgggcacggtggctcacgcctgtaatcccagcactttgggaggctgaagtgggcagatcatgaagtcaagagatcgagaccatcctggccaacatggtgaaacctcgtctctactaaaaatacaaaaattagccaggtgtggtggcgggtgcctgtaatcccagctactcgggaggctgaggcaggagaatcacttgaacccagaaggtggaggttgcagtgagccgagatcgcaccattgcactccagcctggtgacagagccagattccatctcaaaaacaaaacagaacaaaataaaacgaaacaaaaacaaacaaaattaactaaagaaaagttgtgaatagaatgagagaaaaatataattaaattccttatctttatagtgaaatgagtaaatgaagaaatagaagatcaagaatattaagtttatggaggtaatcatgagaattacagatagaacctatcaaaagagagacattgcagctgcaactggcattaaggtgaaggataggaaggaagtttggatgttttattttttacctttctgtactgtttgacatttttccgtttgatgtatgacttgtataatatgtacttgtatggcataaaagtatgagtaataacatcatacatggtcatattttggtgatatattttacaaggaatataccaatgcatttgaaagccatctgctattaatgttgctcatactttttaatgtttcttttctacagcagaatcatgagacagactttgccttgtatctacttttgggggggccttttgccctttgggatgctgtgtgcatcctccaccaccaagtgcactgttagccatgaagttgctgactgcagccacctgaagttgactcaggtacccgatgatctacccacaaacataacagtgttgaaccttacccataatcaactcagaagattaccagccgccaacttcacaaggtatagccagctaactagcttggatgtaggatttaacaccatctcaaaactggagccagaattgtgccagaaacttcccatgttaaaagttttgaacctccagcacaatgagctatctcaactttctgataaaacctttgccttctgcacgaatttgactgaactccatctcatgtccaactcaatccagaaaattaaaaataatccctttgtcaagcagaaggtaagttgaaaatgtctattgttactaatgtttttaagtcagttacccatccttagacttactatctaaatatcaaggaaataaagaggaagaaatttgatctaatccaatttgccacaaatattgccattataatagaaaatgcttccaaaagagaaaatatactcttaaatcagtttcatccttaattttcaatgtttgcctctctcgctttctcccattagaaatagaacttagacgcaagagatagaagtaatgaacagagaagaatcagaatatcccctaagaacatggaaactaaactttcaatgctgctgatttagcatgtgaagtcgtgacaaaagtcttgagtccaaattctgacttaaataaaattaacaaattgatacaatgatcaagtgaattgttcaactaaaaattacctactcctggtttcagaaatctcctcagtggctatttcaatgactttttcaatagtggtgtcactttttcaatgattcctttttcttttcaaaactttactcgaattttagttttttttcttttctttttagttgatgtttaataattgcacatatttatgagatagagaatgatttttcagtatgtgtatataatgtgtaatgattaaatcagggtaattatcatatccatcatctcaaatgtttctcatttgtgttgtgaacattcaaaatacgctcttctagcttttaaaaaatacacaataaatcgtagttaaccatattcaccctacaatgctttagagcaccagaaaaaaaaaaacgcatgttattgtttctaaatctgaggcaattattaagtgcttttctttaaccaaagcgattttcaagttacttcattttatggccttataaaaaattgaacattgctcttcctcagatgccaagaataatgtacaaatgtaaatatgctgtgaaacataaagtgatttgctccctagctattttaaatcttttcttgggtcttcttagagtctaatgtggatgaaatatctttgaatacaaaggcctcaaaatctggctagagaaatcattgcaaaatgttatttttgtaaagacttaaattaaaaaacctgcttctcgttaacagcgattacattagactttgccttaactggtatcgctttcccttaccttttgcctgaatttgaagcatacatattcaaaaatagcaaagggtgataaaaacatcccacagtactgataaagcaaacaaaacttaatattctgtactagtcatgactcaaaatttatataatatgaccctttctcagtataaaaatctatttaaaatttcatagatggcaaaattctcatgctttttaagaaaacattctgttcttttttctgatacttattttcaaggttaaagcatgacactgtgtgtttgataagccatgtgaaaatttcttgcatcataagtaaaaggttatgataaataagttcataaattagcaatgttccttatatcataaataagcttaagtcttttttattttggtaagagaaataaaatgattcttgaagtaagaaataaaatccttcctacaatggttgcaagggtgaccatcacaaagattataacgtaacaaagattaatcagatcaaagattttttattatgcttactgttagtattctacagaataatagagaggtgttgattttgctgttgaagtatttttcagatgtacttacatttaaaagaactgtttttgacagcaagactctaacatatgcatattattttttcccttcagaatttaatcacattagatctgtctcataatggcttgtcatctacaaaattaggaactcaggttcagctggaaaatctccaagagcttctattatcaaacaataaaattcaagcgctaaaaagtgaagaactggatatctttgccaattcatctttaaaaaaattagagttgtcatcgaatcaaattaaagaggtaagaagtaaggtaaaattattttgcattctgcctttaaggtggatagtccctatctgtgtcacatacacaggaatgtaatgctctctagcctctgcctgtcttccagcaatccttcccacctactgcttgggggcattggtgtcatcctcctgagagctcaggcagccccaggagaggtcgggagacgggactctgccgccctgcagcactgggtggaacccctgtgccgtgaccttgcgaacatccttaacatctctgagtctgtgtcctcacttataaagtggaaatagtgctctctcacacaaactctctgacagagttattaattaaagagtacgatggtcaagagccccaggttcacagtcgggttagctggcttggtctctgggctttgtcttttaacaatcatgttatcaggcaagttattcaagttctccctctctagcctcccagctttcaaatgggcgtgataatgactctgcttcataggactgtgtggtaaagaatttaggaccgtgtctggcgtaggcagtgctcaggaaatgatcagcagcagtatgtggttataaaaaccttcctataatgaagtcagcttaaataactgacaggactgtctctttttggaatcatgatcttcaagctaatcattttctgtcacgggagagcaacaactatctggaccggtggcacaggggtaaaagaatttaccaagacagttgcaggtggagaaaggcacatttattcgtgaaagtaggaaactacattgcgagaaggcaacgggcatatcagcaagagaagctgactgcaaagaaacaaaggcttgctggggattttacagggtcttgtttatgctgtgtgctgaagagggctttgagctgcactgacagcgcccaggttgcagtgggctaactcgcaggggcctggtgatagctgggcacaggaagattgtcagttatttgcacaggagggctacgtgtcctggatcatgaagacagactaataatttacctgctcttttgctttctctcggtcccgccaactgactacttttccctaaataggactctgcattttcacatacaggtttgtctgtattttacactcattttgttccaggctataagactactggaaatccttaattacaactctattttttttttcagacataaaaataaatggcgtacaaatttatcctaagatattaagatgttttgtgcaagctcttcattttattttttaaactgcatttttctatgattaagacatttattgtagtaatcttattaaatatatgaataaatgagaaaataataataaggggtgattttaaaaaatcactcaaatgtccatagtcagaaacaaccactgttagcatttgggtatatttatccctggcttttctccaaataattataaggaaaaacgatagcttaaattcttactgtactgaaattcacactgttaaggcacttaactgtgtgtcaagtgctgtgataaatttttaaaaatattttatgtatatagtatttttaatcaatattttattttattttattttattttattttttgagactgagtttcactctttgttgcccaggctggagtgcagtggcacaatctggactcactgcaacctccgactcccgggttcaagcgattctcctgtctcagcctcccgagtagctgggattacaagtgcctgccaccacccctggctaatttttggatttttagtagagacaggatttcaccgtgttggccaggctggtctcgaactcctgacttcatgatccacctccacctcggcctcccaaagtgctgggattacaggcgtgagccaccgcgcccagcctggagggggctctgatttgtaatgtgtcacttgggggacagtagggctaatgcaaaaaaagagagaagtatagaagaaagggtgctttatcataaacaaatgagttaaaatgcaaagcagaaaattatgaaattaagtatgataaatctgcatgatagcattattttacaggcattaaaattaagctttggaatgcttcttaattgtatgggagatgttcataatatgatattaaatctaaagagcaggagacatcaatcttagctactcaggaggctgaggcaagagaatcgcttgaacccaggaggcaagggttgcagggagctgagatcgcaccactgcactccaccctgggggacagagcgaaactctgtctcaaaaaaaaaaaaaaagaaaaagaaatcagagccctttactcctctggcggtttcgactgcctgccggaactggcctccattctctctggattcctcctctcccacctgctgttctcttgtccccgaagtgagtcccagaacagccaaggctctggtaagggtgtaggacggagcagaagggagctggaaaaacacgatagtaaaagaaagtcaggagaaaatccgggtggaaagacgagagggagagctagagctcagagttccagaaaggaaagtgtgccgtcaccgcctcatcataaaagccatccacaacttccttccatgaggctcactgagaacagcggcaccaagacacaaccaggaactgccccaggagtgacttcacgagcagtttattcattgcaattgttctcatggtgataaagaaaaagtaccaggagatggatcctggactggaaggtcagagaagcctccctgaaaaggtggcatctaagctgaggctgtgaatgctgagcagaagttagcccgtggccaggggaggtcagaggctggagtaagaggtgggcgctgcaggaaccgagtaaggaaggactcgtgcattacaggaagggggagaaatgctctgcccatgggatgtggtgaagggtgagcggagatggagtaaagaactgcatctggccgggtgcagcggctcaggcctataatcccagcactttgggaggctgaggcgggcggatcatgaggtcaggagttcaagaccagcctggcctacacggtgaaaccccgactctactaaaaatacaaaacttagctggacgtggtggcgcatgcctgtaatcccagctactcgggaggctgaggcaggagaattgcttgaactgaggaggtggagtttgcagtgagctgagattgcactgctgtactccagcctgggcgacagagcgagactccgtctcaaaaaaaaaaaaaaaaaaaaaaaaaaaggctttcaacagcattacagagtctgtgttcttttgattgttaacctctttttttttcctacctttagttttctccagggtgttttcacgcaattggaagattatttggcctctttctgaacaatgtccagctgggtcccagccttacagagaagctatgtttggaattagcaaacacaagcattcggaatctgtctctgagtaacagccagctgtccaccaccagcaatacaactttcttgggactaaagtggacaaatctcactatgctcgatctttcctacaacaacttaaatgtggttggtaacgattcctttgcttggcttccacaactagaatatttcttcctagagtataataatatacagcatttgttttctcactctttgcacgggcttttcaatgtgaggtacctgaatttgaaacggtcttttactaaacaaagtatttcccttgcctcactccccaagattgatgatttttcttttcagtggctaaaatgtttggagcaccttaacatggaagataatgatattccaggcataaaaagcaatatgttcacaggattgataaacctgaaatacttaagtctatccaactcctttacaagtttgcgaactttgacaaatgaaacatttgtatcacttgctcattctcccttacacatactcaacctaaccaagaataaaatctcaaaaatagagagtgatgctttctcttggttgggccacctagaagtacttgacctgggccttaatgaaattgggcaagaactcacaggccaggaatggagaggtctagaaaatattttcgaaatctatctttcctacaacaagtacctgcagctgactaggaactcctttgccttggtcccaagccttcaacgactgatgctccgaagggtggcccttaaaaatgtggatagctctccttcaccattccagcctcttcgtaacttgaccattctggatctaagcaacaacaacatagccaacataaatgatgacatgttggagggtcttgagaaactagaaattctcgatttgcagcataacaacttagcacggctctggaaacacgcaaaccctggtggtcccatttatttcctaaagggtctgtctcacctccacatccttaacttggagtccaacggctttgacgagatcccagttgaggtcttcaaggatttatttgaactaaagatcatcgatttaggattgaataatttaaacacacttccagcatctgtctttaataatcaggtgtctctaaagtcattgaaccttcagaagaatctcataacatccgttgagaagaaggttttcgggccagctttcaggaacctgactgagttagatatgcgctttaatccctttgattgcacgtgtgaaagtattgcctggtttgttaattggattaacgagacccataccaacatccctgagctgtcaagccactacctttgcaacactccacctcactatcatgggttcccagtgagactttttgatacatcatcttgcaaagacagtgccccctttgaactctttttcatgatcaataccagtatcctgttgatttttatctttattgtacttctcatccactttgagggctggaggatatctttttattggaatgtttcagtacatcgagttcttggtttcaaagaaatagacagacagacagaacagtttgaatatgcagcatatataattcatgcctataaagataaggattgggtctgggaacatttctcttcaatggaaaaggaagaccaatctctcaaattttgtctggaagaaagggactttgaggcgggtgtttttgaactagaagcaattgttaacagcatcaaaagaagcagaaaaattatttttgttataacacaccatctattaaaagacccattatgcaaaaggtaggtaaacattgtgaaattttaagtgtgtacttgcttttcaattaaatttctttttttttttttgagatggagtcctgctctgttgcccaggctggagtgcagtggtgtgatctcagcttactgcagcctccacctcctgggttcaagtaattctcctgcctcagcctctcaagtagttgggattacaggcacgcgccaccaagcctggctaatttttgtatttttattagagatggggtttcaccgtgttggccaggcttatcttgaactcctggcctcaggtgagcttcaattaaacttttaaatattaccaatattactcacaactcaaagaatttttaaaataaaattaagaaaaaaaaaacctgagtttcagtaacagtttaaactctacagagtatttttaaatagtattgcttctggctgttaaaaaccgtatattaattcttcaatacatttttttacttagattcaaggtacatcatgcagttcaacaagctattgaacaaaatctggattccattatattggttttccttgaggagattccagattataaactgaaccatgcactctgtttgcgaagaggaatgtttaaatctcactgcatcttgaactggccagttcagaaagaacggataggtgcctttcgtcataaattgcaagtagcacttggatccaaaaactctgtacattaaatttatttaaatattcaattagcaaaggagaaactttctcaatttaaaaagttctatggcaaatttaagttttccataaaggtgttataatttgtttattcatatttgtaaatgattatattctatcacaattacatctcttctaggaaaatgtgtctccttatttcaggcctatttttgacaattgacttaattttacccaaaataaaacatataagcacgtaagaacattgtctactgattaatatacaatcagccactgagcctatgacagcttaaggagtttgaaaacattcctcattttaagaaaagttagaggtatatgagggtttgtgatgatctttttgtattttggatgcacttagaatgaaagataattgtttcaatgggtataatgctatttcctttgtaaaagagtaaaatatatacccatatttttaacaagtttaattacagtattttttcaatggaaaaactttgtattttagtaagtacttgtctcagtgttgactttgttaaatgttaaatattttttaatatacatacccaagggcagaaaacatttgcaattcatttttattagttaatgagatgattatttgaatgaatattgacttgtattttcctgagattatgagtttctgctgtgggagggtggaaacaattctcttactaaaagtattgtaggcaggcttgctttctgaaggctaatcactatttggctttgtggaaacagaactttcctcccatggtcacagactcaggagatggcgttggcaaaatcacttggtcccactgggattctttgactcctgatcttgaaaattatgataataaatgcatcttagatattcctatgtaattagtgatgatgatcgctgtataatatattcaaaggaatgtattattttaccataaaataatgtgctacgcataaggtagtccttatctagaaagactatttttatttttgtttttttgtttgtttgttttttatttgtttgtttttgagacagagtctggctctgtcgcccaggctggagttcagtggtccaacctcggcccaccgcaacctccacctctgagttcaagctattctcctgcctcagccacccgagtagctgggattacaggcacatgccaccatgcctggctaatttttgtatttttagtagagatggggtttcaccatgttggccaggctggtcttgaactcctgacctcaagtgatcctctcgccttggcctcccaaagtgctaggattacaggtgtgagccaccgcgccccgcctttttattttgttttacaatacaacaaaaaatttttagttttacaataaaagagaatctgattattggaaatagacctgaatagctttttgaaatatttatagttctagtatttaaagagaaacctgaaattataaagctgagttaatttctatacctgaaatgttcatttgtctgctgaattcagggagcatttgagatgtcacattttggaactttgatttaaatagttcagtattcccaaggctgagttccatgaccctggaatgagaaatatccactgtacctctggttctgaagagtctatagtcggccaacactgtgaatgtgtggaggactaattgtcactttcatgttatttgccaccctgacagctgagacactgcttttcagcattttagttaagatttgctttttaactgtgcaataatcattttattttggcattataaaataaaaatcacaacttctgcttttcttatatgctttgtgtgttatcacacaaatattctcaaatattcataagatattttaaataaatcattgtgaattagtcagtatatcaagttgcttaatatgtcatatatcaatgctatttaatatataatatctatatttaatatattgatatgttactggtggagagtgtccaggttcttggtgctttgaacaaggaattggacaaaatgcacaaagaatgaggcgacaaaagcagaggtttattgaaaacgaaagcacaccccgcagggtgggagcggcccgagcaagcagctcaaaagccgggttacaggattttctggggtttaaatactctctagaggtttccattggttacttggtttatgccctatgtaaatgaagaggctaaagtgaaattacaaagttatttacttgttgtgcaccctacgcaaatgaatagctgtcacagctgag

SEQ ID NO: 639 - DNA, 88002 bp, Human
cacttgtctgcaaacaatatttatttatgttagttaatgccaggttctgggtgaatattatacagataataattccattagccctccaaccttgtaagataagtaccattattatctccactttatagatagggaaactgaggcacagagagcttaagtgatcttcccacagctagaaaatgaaagagctgaggcttgaacctaaacagagactctataggctccagagtctatagtctcaacagctctgctctggtctgctccctgtccatattggaagcagggacagactatagtctagtatataatgcaagggctgaataataaggcatgattttatactaggcactaatacaggttactcctaataaaatcaaccctcaggcatttttttcagaactgaaatggaacagaccagtatctaacttgaggataatggagagggattaaattagttggagaatgatttaaccttttgctcactgagcattttctcatgaattcatctttccatccttccagggatctacttatccacttattcaacaactatgcactgagcactctcgccgtcctgaagcgacggtcacacattgcagataagacacggtctgaccgacaaggacttagcagtccaggtggggagaagcaggcaaaggaaacccacggtctagcatggcaagtgctgtcagaagtggggcctggaagagagggacatgaattcagcctgcatttgggagaatagcagaggaggcaggagggaaaagatgagagacaaatgcttatggagaaaagaacattgaatctgaccctagcaaaattttctaatcgcgatattcctgggaagatcttagaaattacacagtttccatcaaagacaagagaaaattgaacactcttttcaagaaaagccctgggacatagtaattgataacacaggttttggagtcagacctgcattcaaatcttaacctctcttggaagaacttcctccattagaagatggggctattcatagtgacccatcataaggttgtcctgagggtcatgtagactcctgtgtgaggggcacagcacagtctgtgctgagtgcaaatacagtaaatcctagttgtgaccttcttctccgacgaatagtcacactcacttggtcccttagtccttaatcttcttagtagctctaacttttagaaccaagttttgtaaatctcttttctgttttgcatagagaatacaaaaggaataaaatttctgtaaaactgatttgcatcccagtgagtttattgtactctatggttcttggtgactaggtaaccagcagaggagctaattcattattttaccaatttaaacaggaacttggaagaaaagcacctggtggtcacagagcatgaggactatactgacaagaagattaaaagaaagttcagctcacacagccctagataatcacaaatgtacccaaggtttattaacaatcacaattacctggaactatattatttgcctggctggttattctgaagacaatttgtatggatagatgagctgagaggagctcatgaagttattttgaagtggctggcagagtccctttgcaataaatatctggggaaataggagaggacacccaaggctccctggtccaatttctcacctagaagtgaaaagaaactctgagttctcctcagaggaacagcccatccacagggccccagcccccagccctcatgtttcctccaagaaccatttgcccaccatgggaccagacctgtgtgttctagataagccttttgagaaaacaaaatagtatgcagaagcagtgtccattttcaggggtccagtcctttaaggaacaaagtcctgggcctttatgacattggcagccactgtcccttcctgacgcccccccttgaaaatctctggctgcctactcctgagctttgtaggcttgtgcagagccatggtgccaaggcataggtctcagaggttgtctctttccttggtttccgttgcagattcccacaactccatgctgtgtgctgcaggctggtcctgaacccagatctctggctgagaggatgggggcagatggggaaacagtggttctgaagaacatgctcattggcgtcaacctgatccttctgggctccatgatcaagccttcagagtgtcagctggaggtcaccacagaaagggtccagagacagtcagtggaggaggagggaggcattgccaactacaacacgtccagcaaagagcagcctgtggtcttcaaccacgtgtacaacattaacgtgcccttggacaacctctgctcctcagggctagaggcctctgctgagcaggaggtgagtgcagaagacgagactctggcagagtacatgggccagacctcagaccacgagagccaggtcacctttacacacaggatcaacttccccaaaaaggcctgtccatgtgccagttcagcccaggtgctgcaggagctgctgagccggatcgagatgctggagagggaggtgtcggtgctgcgagaccagtgcaacgccaactgctgccaagaaagtgctgccacaggtagagtccgggagctcgcagcgtggtctcaggaggggaaggagagggctgagcagagagggagagtgaacaagaaggaccaatgcacttccagcgaaaacgcactcccagcaaaaccccggcatctcttcacacggtcaaaggaaaaaagtgtcctagtctgtagctgccggttaatatgtctctaagatctaaatgcagttcttccccgagggattcagttcagggattttctacactgcatagccagtttgaaatacattaacctgattttggggggatgagtcaggtaatggttcatcggttcagcacagcaacttcgatggcgagcagggaatttgatgtctgtcttctttcatctttggttttcacaggctgttgaattgatatctatccatgttaacctgagggactagagaatgcagacgctctgttcactcaatcgcagcctttctcccatctgagtagatgatagtcattaaggtctcagaggacctatccccatcttctccagtgagatggaagctttagcacctgccccctcaaaaagcacacagaagcgtatgcacacacacacacacacacacacacacacactctcacacacacatactctctctctcacgcatgcacacacgcatgctctcacacacaacacactcacacaacttagtgcaccctccaaaaggctgaaatctcaggggatttacttctaacattgcccaccccctaattagtaacccttgtgagttacctttacctctctgcaagacataattaagtcttcagagtcagaattcccaagttcagatcctggctctactgcttcctagctgatgacctaagcagttccatatctgtgccttcctttcctcatctacaaatggtgctagactagagcaacaagaagttattaacaataaaagcacctattcagatgtcagcctggcttctgtaagtaacgtataagcaacagctattatcggctgacgccaatgagtgggaactgtatctgtacccctttgtgcacaggttttctctcccaaaaggtaccttagaccccatgcaattcagttctttgatgacaagaggcatttgtcttgagttcaagcactcacctctataggatccatgatctcaaggctttcacggggatgaaagctggaggtggcagagtgaaattttaacagagcctggatggcccgcagatgtagaggggtacctgacacattcaccctgagacacagcaagtctagaggcagtcactgaggactaaaatatttcatgggttcctttcacctccttctcctcccaataaccaacactataaataaaacaatctgcagaacagaagagcaagtccagttctcctgtgcttcaatgacaatggtcaggtcagcttgtcttttcaatggagcaggagaataggggaaagtcctaggtttccatgagcatggactctgcagctcaggaagctggggcttctataagtgaactttttgccagccttccaccaggatccctggcaaacatgggaaaaatctgcaaggaagagctaagttaaataatgtcagtaaagtatattttcatgggggcggcatgaagtggcagaattaaacaaggatgtaacttactagacttcatatcctcaaggccaagtgcaaagaaggatgccagcaggtactccatttgtatttgtttaatacgtttacttgaatcatgctaggcagataaattaaccactgtagttatcccacagtaaggtctaggacagagacatgcgtagaatcccagaggggtcatagcaaacagtaactaaatgagagtgaggtcctggggagcctttgaagtaaccatggagctgggttttgatgaatgagcagagtgagtcagatggcaggcagggagggagcgagacaggtttgtaacacataagacctttctctgcacagtggactcagtgctcagcctatacctccttaggtccctcacaaaatcccatagccagcacctgggcatcctggtgagaaggctgtcctcagtttgttggaaacttcttgggctgcccagagagagaatgaggggctgggggattcgcatgccctcagggacatagaccttaacccacaatgagatgtgacctgcactgcccagagcaccctgcagaactgaacccaagtgactcttctggaacttggcttgataatgcacctgggcttgagcacgttcccttcccaactttccactcttccctaccagttttttctgggaacaccttccaataaatcacttttacatgaatctttagcaaagacctacttctaaggaatccatcctaagacaccttaaaggtcagcttctggaggacaagggcccagatctcattcatctttgcccccagccctgtgctaggcacagacagcccatgctaggtgaaaatatttattaaattgaatatgtaccaaactacgttgagcttcactctcagcaacagaaatctggtcagagaatgagtagagaggcctttgcccatccttccccagcaccattgacaggagaggccactgctgctctttgaccttctccttgaccattccaggacaactggactatatccctcactgcagtggccacggcaactttagctttgagtcctgtggctgcatctgcaacgaaggctggtttggcaagaattgctcggagccctactgcccgctgggttgctccagccggggggtgtgtgtggatggccagtgcatctgtgacagcgagtacagcggggatgactgttccgaactccggtgcccaacagactgcagctcccgggggctctgcgtggacggggagtgtgtctgtgaagagccctacactggcgaggactgcagggaactgaggtgccctggggactgttcggggaaggggagatgtgccaacggtacctgtttatgcgaggagggctacgttggtgaggactgcggccagcggcagtgtctgaatgcctgcagtgggcgaggacaatgtgaggaggggctctgcgtctgtgaagagggctaccagggccctgactgctcagcaggtaggcaggggaactctctggggtgtttggcaagggtggtccagcaaactagctggatgcctccagttagcttgggaagaaagatgagtgagaaagtgaagtttaggcaaaataattctcaattgagttgtactcatttgctttccaagagagctgagttcttgagtcttgatgaggcagattaaaagggataaagagtggaaataggaaaaggtcaagttcaggctgagagctggattgttacccctgagactaggaaaaaggtagtggtaacaatgatgacaacacttcattgcccttgaggtgggggagggtagacagtgaagtcatgggaccaccttaggcaaggccattctctaactctgagggatcccaagcgttccacctgctcaaaattatctccctcaccagttgccatattccaggaatgccttccacaatgctactgcaagagatggtggttggtctgtgaggctctctgattatcttggagcttacagattgcaagatgttattaatttatgaagtgattccagtggggcagagtgtttttagacaaggacttaaatctaaacaggaataaagtactaaggacattgggcaacagctaacatgctaacaattagtacagaatattaagagtatgactcactttgttccagatgactatctagcaaattagaaccaaccctatgtatagtctacactgtcaaagctgatagaaggatgatgtactaaaatggggatctaaacccaacagtgagaaaaaaaaaaaaaagtatctcattggggctgattccctttttttttttttttttttttttttgagacggagtctcgctctgtcgcccaggccggattgcggactgcagtggcgcaatctcggctcactgcaagctccgcttcccgggttcacgccattctcctgcctcagcctcccgagtagctgggactacaggcgcccaccaccgcgcccggctaattttttgtatttttagtagagacggggtttcaccttgttagccaggatggtctcgatctcctgacctcatgatccgcccgcctcggcctcccaaagtgctgggattacaggcgtgagccaccgcgcccggcctgattcccttttttatgcaaatcagattatgtttattatttcactatagctcatcctcttctgactaaatcagtgactactgctcatacatttgtttatgttttaaacagtacagattaagtggttggtcttttccattcagggctcagagagcccactgggattatttaaaataaaaaataacaacaaacaaacattttaaaccttctaatggagcaattttaggaatttgctgataagtcatgtgacatcagtttaagggggaaagcctggtaagccggattcaccagacttctgtaagccagagttactcactcctacgtggcaggcaatgttcccgcacatgtaacttcaacttaaattattttcaaaaatcaatgataataatgaaaagaaaaacaacaataatgcactgtgcttagggaaaaaaatttaatgttccttaattttttccatatccaattatttcatttagcctcccaattttgtttactgaattgaaatatctttctaaaaatattgtcaccacaccaattatcccaaagtgaaattcaagcagaagttaagccttattgtttctgaatccaaagtcactaggcaccttctgggaagccaggctgacaaatggctccagtttccatccaggggatgaggctccatgagaccccatctggaggacacccagggtcagtgtgggccatcgctgtgttaatgctattctgtagcgcacatgcttcttagtagacttactctttggcggtctggacatacctgtcatattcttgaccctgcctttctacagggataggttcatttgcaaacaaaatcttgatctaatccaggacttacactgaaccctcctggctacttcagggaagactcagcagctgctagcatagctacaactgggttgagtccaaactatgagcacgttacctctgacatggtacctctgtgctgcttgaggaacacttcaataggcccagataaattactttacaggttcccaaagcatgtgaagaaggacagttgcataatctccatctgtttctatagcaaccctagagccaccactcatttgcaggaggtctgctcttaaggcctgctttttaaaccaagtgctacaggtctcttccagagaagtatctaggtcattatctaaagtgctcctttgcttgctctttgtgaaaagactgtaggagaaggggctatttatccactgtttgacgttcctggccgggtgcacacaccacagcacgatgttcccattgcccatgggactgaggagaggagagagaagggttaggaaggtgaaaacactgagagccacaaaatatacttcgttatagggcattcttttctctttggcaagggcgtagaaaatagctgcccattgtgtggattgcattctgaggccccctaggtctgcagcacttaagcacaattgaatagtgttgccaaggtcactacttttgactcctagccttgatctatcctcatagtgtgccaagggacaaaatctcaagacttctgcctccattctctgcccatgtacagataatagaacaaaacattcatgaatatgagaacttaaaacaggccttagaaagaagcttctcattttacagatttaaaaagcagcagtcagtgagacagattttcccagagccagacagctaattaatggcggagtaagaaaaagaatcctggtctcctaccagcttctagcactcttttatcttctctggaatgcaaagtagaatagaattgaaaaataaaaattttaaagccatatacacaaagaagtagccttttgatatgaaagctgagctccatcacatgattaaaaaaatgagacgtcagaggtagggtggaaaagcacattcaaccatttgtccacatctgtccccagtgatggtggttagtgctggggctggccagggagctggccaaaactcccccggagccagcaggataaaagaaccatcagaacagggtcttgagacaatccagaaagctgtttcctggacttcagtcagacctgcggagattcatcagtgtcagcctctgctctgtcaggactgcagccagcccaacctttggcacccgaaaccacttactctttggagtaagacacatcatggaactaattccaactgctctcaccacataagtgcaacatttatgcaaaatctaaagaggaaacagcatggcatctttgcagataagcaaccctgattcctcaagccacagtttattcctctttaacagcatgctcttcctcaagtttcaaagttgacaccccaaagaaagtaaggctaagaatactttgcacccaccgtgaattcattgaattaaggcatgaggctctttgattgtttgcagtacagttcaatataattttcttttataaggattactgatgcctagtgtacatagttgctgctaatttagagtgaaagtggtggtggtctcctccattgagccaccattgtcaagaccacttccacgaggaatgacgccagttgctgctttctcattcagaagtgtaggcaactttaccaccaggctcaggcctcaagctaagttgccaagatttttttaaaaatccttctgcacctcttttttttgctttaaaatcccaaaatgctcttcttagatcaccctctattgttaatattagctttgaagaaggaagcaaaaaggaatacgctgatttgttccaaatgccctaagaattgctggtgacttgaaatttggagtggccatttctgccactatgacagaagtcctgcataggaaacctggagttaatgtgttgaatcacaggagacaggcactagagaacctgtttaaaaagaattttcttacctgtaggatgagcaccagtctagagatcacacctattaagatcgtctgaattattcctaatatagtttactttgggacaccatgtataaatgaaaggaggcatctcgcgcaatctgtaacctgctgtctaaattgtaggggaaagaatgaaaactgtagaacatcagggtttgacagtcagttctgctatgacccactctgacttttggcacatcccttaacctgggattcagtttcctcattggtaaagctgggataattatctctacatgaactacctcatatgactgctactaaatatttttttaaattcttgttagatggtatatatgaaaatagtttatagactgtgaaatgctatataaatgtaaagtggtattgtatattggctaagaaggtttatagtcattctgcctgcattctaatcctagcttctatgtttgctgactgtgtggcccaatttcgtcatctataaaatggtagtaataatgataccttaatcccatggtgttggtgagagggtgaattgaaataatctatgtaaaagtggttagcattgtacttggtacataataagtgctcagtataatcatgcaaaatcctgacaggttctaaatatcaactcttcttctcatggcctaggagtcattctgtatgtgttatataggttgtcccaaaggttttagtgaaattcaaagctttaataaggtcaaaactataggtgatacagtttataaaacatcatttgaaagcttatttaaatttcgtttacacttcttgagttttataaattttaaacaaaaattttttttaatttttgttttggtcaacatttgccatcctcaagaagctctgctttctagactgttttattcaatgaatggttttaggcaaaagtaattgaagcaaatgtccagcagtgcatatatatgctgctgattctatcctgtgagtcttggatctgttaaaggtctccttgtgtctctgtctttgctgaggatttgagggtgcacatgtgagtacaatgaggagacagcactctccactcacaaggtccagcaaaacacagctggcctcagcctacctggttgtaaaggggaggggtgagattacccaggggagaaattcaaaacctatgacaactcttaaactcatcgaagcctccactacatataaatttataagttaataatgaccatttaaatatcggcttgatctttgatttaatctatgggcaggtctaattacagacacactggagttagcctcttagttagtcttaaaggcttaattatttaatggccacaacactggtgaatcttcattttccaagacgatacacaaaagtctatttctctgtgttttaccctttggtgactccaagtagcatttgagaaatcagaagaaagtaaagcaaggtcctcaagaatgtttttttatcatcatcatctccaagattgaggctaataaaaattagtttaacacaagctagatttctttcagaacataagtggtctttaaaagggaaaattctacaataatgggctgttgagtgtcttcatcaggccgtggtatccaggacttactgttttggcttctcataatttgcaagataatcaggaatgagtctttatttccacttgccaaatcagatattggctcccagggtaatctgatgacgataacttattaaaccaccaaaaatgttggccagtggtgtgctgttaaatacctaacaacctggctccctaaaggaaaaaaatttaaaagccccgttgtgtagcatttgccagtttccatgatgtaaatactctctccatggccaatttcaattaccaacatgacgtcagtaaacatggagctggaaacagatgtgtagtagagtacaatcatagaatattttcaccagacagagcacacataaattatcttaaaggtacacataatagtaaaatgtagtcaaataatttgagagtgataaattttgaatatctattacctttatttttaatataatttacttaagtattaggttataaaattgaatctttaataatggctgtattcaacgacagtcttgaaacagtcctgaaaatttgacaatcagcatttacaagccagtaggagctggctccagtgcatgttcatgaccttatagagattggggtactaagcaccaaaaagacaagagcctgctcacaaaggaagttacaaatcacttaaagccattgagcccagcaggacatatagacatggcatggggggtgagatgtgaggaagaaagttgagtccaggatggggaaggcaatcctctgagctcatgctatctgtgtattgcctcccggtagttgcccctccagaggacttgcgagtggctggtatcagcgacaggtccattgagctggaatgggacgggccgatggcagtgacggaatatgtgatctcttaccagccgacggccctggggggcctccagctccagcagcgggtgcctggagattggagtggtgtcaccatcacggagctggagccaggtctcacctacaacatcagcgtctacgctgtcattagcaacatcctcagccttcccatcactgccaaggtggccacccgtacgtaccatttccctgtcctgcttcatttttcttttctcctacatgagatcatgggcattcatgatagtagcgtcttttcttagttcttcagggatgcctggaatagttattgcccttgaggggaagggctagagatgtgacccatttagaaagggtacatcattaaaaaggcactttcgattaagagagtttccaaattcaggcagctttcataaattatagaaccaaaaggacaaaaagtactttaattatggagtactggcttgttataagctagactctgactagaagtcaaggaaagtgtaagacatctacagactttgaatcagttagggatccaaaacaaggagatatgaactaggacctctaagaagcaagtgctaaatggtgtgttctcgaccataagtgtatagcaaagtgagaaaaaaatcttatttaaaaccacagctgacaacatccccttctcctgatagagaggtggcataatttcctcctggtcttttgtttagtgaaatatcttaatagttcattttagttataaaagttgaagccctagagcataatttagaaggattcacagggaagaaagagagagatggagacagaaagcaatctaaactgctctccataagaaatgaacagttttttttatacataaagggaaacttctgtgggtgtgtacctatattttgtgtatgttcaagcatagaaaaatataaaagattacataacaattattaacactgactacatcacagagtagaataagaaggagataggaaataattattatatttttctttatacccctctgaattcttaaattgatacaataagcctgttttagtttagaatttcaaaagccaggcagaataatttaggcaagagaagttctcatcaccccaagtctactgcaaaacctgcatgcacacaatgcctctgtgccttatgtggaaagtctttggagagatcatgaaaaaggggctgtatctgattaaaatctgggaagagagaagagaacattcaaaggagatgaggtatgagtgatacagagatttttagcaataccaagaaagtggaacaagaagtaaccatgaaaacataagccctctagaattcagaaagcccccgggccagtaaataggacttaccaccagataaggggtaagagatctgagcccattttgtgtaggtagatggtattcaggtaacaaatgccacgaaagttcagaaaaggaaaaggtcaaggtagaaagatttagccttgaaatcttcatggaagctccaggactgaattgacctttgaaggatgcaaggatagagacaggcagaggggaaggaatttaagaagtcatcttgtccccttgcttttcaggtgacagaaattctgctataattttggactccgctatgagaagagtgctgactctgttaatatgcctataattatctctgtttatatttgacctttttttaaaaaaaaaatcctctggtgcctgagaactggttttaaatatctgcaatgattgtgcagagaggcaggtcaccatctgccgcttttcccaccttgctccgggatgagtcaccaccctaagtgcctggcctaactcccaagcgtctcctctctgatccacatgcatgcacagtgatgaggtttccatctcctgtggcatttattatgccaattcagggcattccctcaggcaagctcccaggtgacaaggacaaaatcatgtaaaccacctgacacaacttcaagtgggcttgcagtcagccctgccttccaaccaagaagcatgagaactcttccaaacaggaaggatgagaaaatctgtcctttttccaatgggaatagcccatgagaggcaaagctaaaatgggagcaggcttcctggagaactgagaaaagtcatgctgtcatatttcagggctgataattgaaactccattaggacaagcacacttccatctcacaaaacctgtgcatgtgtatgtgactgtgtggttgggggagaaggggtggtgggaggaaaagagggagatacatgaaatgaaaaattcagaccatcctagacttagtgatttgagctaaacaaaatactctcaatgtgcatcagatgatcaaggaaatcactctagtattaattctgaaactggtttgctccacaactttagccagctttctctgtgcctctcttttcctgtgtgcaaaatgagaacactgatagaagccatcatagtacctcccgggagtcctgtaaagcttctaaagatactgctcaagtcctctgaaaaaggcactgtactatatatgatatgccaagatctaccacattagtaagaaaagaaaaatgatgtctgcattttaatagtaacctattaatgcaataaaaagcattaaaaattgtttatatagattgtgtttaagttaactcatgtattccatcaacatcgagcactagagccacatggggtgggttgattctgcacctgggactcactgtgtctggagcaagattgggattgtccaccagacaccaccacgcccatggcgtggagggagttcaccaagacaaagcaccaggcaatgctgtctgtcccaagggttagccatgacattgtcacctacattgctgtgttccagatctctccactcctcaagggctacaatttaagacgatcacagagaccaccgtggaggtgcagtgggagcccttctcattttccttcgatgggtgggaaatcagcttcattccaaaggtaacactcacctgttacactgccaaacagacttatttggaatatttgtacctttagcttggaatcaggggcagcaaggaaagtgctacccaatatctctctccatgccattaaagacacaaaatggcatgttgtgggtgtctgggatatagaacatttctgtgacaaatatgtggtaatgacctgctgacaagagtagccctgagcatggcaccctggccttgcagaacagaggatgtgggaagcagccaccagctccagctctctgctgagataactctggggtctgatgagccatagttttggtgagcatgaaaaccagaccctgaaaaaattgaggcttctctttaggacataagaaaagccaggctgaatccatcacataatcagccaaaagcttcattctgtgcagacagatgcaccacagaaaagtcagcttgcatggcatcaatccctaaaggttacagacataaaacaaaacaccttggctctcctggattattcataatacatttgtatcctattaatttagcaacttttttattagtctatgacttttaaagtatcctaagattcctttctactctctaaagcagtattttatttattttcttaattctaaaactaacttttccgaattgccacaggtgtatgcctggctctaaatttccagaatttgttgaccctaccaatgtcctccctaactgtaccactcatgaggatataaagttcaattatactccttccctctgtctttattcttcaacatcaaagaacattttttagccattcatcagacttaatgacaaatgacacatttttggctaacaagaccatgatttcaccattcttttacttcaaaattcttagagctgtgaactgttggagttacaaaagaccttcaagttcacaggtacgacccctcattttacatctagtttagtttaatttatagacactacgattcagaaaacttgaaggacatcatacagctagttggtgacaggcttaaaacgagtacctgggtctccaccacctatcccggggctctgttcactaaatctgtatgccccattttcttatttacagtcatattatagtcacatcacagcaaggtaaataaatctaaacagacatctatacaaatgtgtcctatttgagttaaaatgataaataaaatgtggcaattgagttacataacaattgaaacgatcatgtcaattggaatggaacattgctaccaatgtttttcaggaagaaaaattacgccaggttctcctgttacctatacccaatatgtaaaactctaattaaaagagaggctgaccagggaatgccaaggtcaaatgcatggccacatggtttaataactgttgtgatctgtaggttgaggccactggggagcattcatcacactgatttataagagtatgactgtaaattacatataaggcaccctgggtaccataaatagaggccaaagaataggggagaatggcagtgccctccaaaagaggccctcttgtctcctccatttctaaggacactcatagaaagtatatggagggaaagagagagagggaacgataagatagatagataataaatcctagattcaatttcgtcaagttactctttctcattccctctccctcttgtctccttcttctcttctttgtattatctttttccaagcttcctttttcctttctttgtacttcatatgtggttgtgtcactgagtcctaattcatctgggtgaaggggaaacaagacatcgacagattcacaccgaatgtagcaccatgagaaactccagatatagcaaaatattagctctggctcataaacaattatctcatagcaatgtcttagtttgaaatgtgttgtgtgtgtatataaagatgtttacacacaaacacacatgactatcctctcctaaatagccgggggcatgttcattacgataaatgccaaaaacctctgatgaatgttaaccgcaaccatcaaacatttgatctttggcaagagccaatctgcaccacctcatcactaatttttattggcaaactcagcaaactcaggagtggccaaagaaatgttcttaaaaattgatcctccatttgccaaatcctcatagggtggtgtcattcttatggagtctatggggagttatttctggccccagatactcagctgtcagcatggaggaaagagacatcacccccattttaaattcacaatccacaattagtattccacacctttatctttctctcatcagatttctctcccagtgacttttctcttttgctctctgcttctccccactgtccagaacaatgaagggggagtgattgctcaggtccccagcgatgttacgtcctttaaccagacaggactaaagcctggggaggaatacattgtcaatgtggtggctctgaaagaacaggcccgcagcccccctacctcggccagcgtctccacaggtgagtgcctccaacccttctccctagagctgcctactaggtcacttggaaaagaaccacagaattgcccaaggagtggagagacaacagaggtgctagaatttctcctagagctgggacaattctggtacctggcaatggagctactctaccagatgcttagctcatcatcttccctattactcatccttacaaatactgtcatctgggagagtgtttcatggagacaattcttttttaatatttccattgtatttatgctgatcttactcatgaagaacactcatttgtcagcctctggtgtcaatgatctttggaagcagcaagagctgactcattcttacctatgatgatatttggagaaagtcatctgaaccttcccaaacttcaatttattttacaagataagcaagaataatttatgataaacaagaataccttcttcattaagttaatatgaggatgggattagataaagcacacaaagcaatcagctctgtgctgatgagagtgagtgctcaatacttggtatacgcacatatactcagaacatactcagaagtgaaagtggtaggaaacaagtcattcaaaaataagtaggtatgggttgggtcactgttcaaggtgatggcttaagtctattattatttcatcccacagatcacctcattcaagattattatatttccaggattgattcattaattgtcatattttgccttattgtatcctcagctaacaaagagtgttcaacttcaatgctgtaaattagctattgtgatgtataaatgtgtgtgtgtcctcaccaagaatgtctcgaaagttataaatagcatctggcataagttttggttctcattttattgttgatggagctgaaactcagaggctaagcaactttctctgtcagtaacagaaattgagataggtgactattggtacagctttatgtgtttttcataaacagaaattgatgtaccagaaagccagttttaagtccaggacaaaaggctgagttgaccagagatgagaaccacaacacaatgtaatgagaccacatttatagattagtgattcatgctctgctactgaatccaaaccaaacagcatcaggtgccaaggcttaagctcagtttagaaaacgttggttcagaactattgtggcagtagcttgtgttccattagtgcaccaaggttctatggcagtgccttgaggctagaatccagtggaaagccagacctctaattactccctctttcatgcctccaaccaggacagctccactttgatctgttttatattttgtacatccatttaagatttttgtcctttaaaaaataagtttaccacccaaaaagctttcaaaccatggttctgctctaaatagtatgttttagaagaaaccccataaccataaaagctaaagtgctctgtaggaatccctccagaaggccggtggctgaggttttccacagctccaaggttatgctgtaacctgaagagttgacattcgataacttgggggcagaaaggtgtgatgcccttgctcacccatcatataagcatcacaacaacactgctatcacaaaagacaggttaacaagagaaagcgtaacaaatttatttaatcaaagtttcacatgacaaaggagccttcagaaatgaagacccaaagacctgggggaaattgtctgtttttacgcttaggtttgaggaataatggacagccatgtagaaacgtaattggacaaatggctatgatctaatggtaatagtctaagggggagacccagcaaggcctgtctgcccagattcttcttggcctctctgtgaagcatttcttctccacctcctctgtgggacaagacctcactggaatgagggtcctcaagggagaagggaggagggaaaaagttacctttctaggttttatggcttgctttgaggaaaaggagttctagtttctattacctgccctgaggaagaggaattctgatttctgtgaatcacttcaaagggagaagaagggtcaggagatgggaggactgcagatggtcagaaagaccttgcttgcttccggggctgtttctgaggctctttcattcctctttaattcaaagtactcagcacaccaaggtgccaaattttggagtgtctgtgatgagcccaacaatagcaggtgcagcttctcctcttctgatatgaaatgttacaaggtgcccaagttattcctgtgatttgatattaagaaagtattagtaaaagacaaaaggctaaaaggagaagatggttcataagaggatagaaaacattgcagttgaagaatatttttctcctagaatattgacagaacatggagaaggtagtccaactttgtcttatagtcaaaccacattcttataacatttgcagtattttttggtttggcagttccttaagtttaaaattaaaattccagatctagaaatttgtggtaaagctaggcagaattattttcatttaagaaaaaatgtccttaatattttggcatcatctacagagtcatgaagaaatggaaagacatttattccagtttactttttgagcagggattgtgtttgtttagaaattaggaccaaagctgaaagcaagttgatacctccttgattggaatggaacattgctaccaagtggccaacaaagggcagaatccaagagtggctacaaaatagacggttggctcccaatcctgtgtgctgtttttaggaaacgattgtttaattatttccttctgctaaggtctgacctacaccaaccccctactgcgaagctctgtgtcctcatcaggcactcaggctgccttcttctaggcaggccattttgtgaatgcaaattacaagacctcccacagctaaaaccctctgcgctacataatcacattttaatatgttcaatccattatgattcgggttttctggatttaaagagttgaaggacaaaagctttttgtggtcagttgcatttccctgacacttttttttttttccaaaaagctccagtttattgaaatgcttccccttctttctcatggataaagaagattttccattcatttcatttactcgacacacatttactgagtgtctactatgcttcagatatcatgcttacacagcaactaggaggccacttcccccatttcataattaatttaaattaaatgtgaaaggcctaagttatctaaaaccaccaagtgcagcatgctgaaaagaaactggatatattctgttaaatcacattactacctcaaatatgaaaaccaggacttcattttaagtccaaaccaggtggcacccaagtggtctggtgattttcattttagctggtgctggaccaaaagccctaagcagcttaagagaggacaggactaggctaagacccggaaagagggaggggtacccagggaaaggctcaaccttgaaaaactgaaagcctcaaggtcagcctaagacggccctgagggagaaacttcattctggagacagagtaggaggtgggccagagtggactggttagaaacaagtcttagccaaggctctccagtaacaaggaagagagacttacttaaactagctgaagcaaaagagagaatttactggaaggacatagagtgcctcatgggaatcccaggaccagaaatgcatctgggcctcacaaaagacttgcaccagaaaatggaacatcaggaatcaagttattccatatatctttctagaagctctgcatggccactggtttctctctccctctttccttttctccctctttccccttttctccagatcaaatgttttctatatcagtatcagaatggtagaaaatggccacaccagccctggctctgcacggtccaacacaggctaattagagaaccagagttctggttttagttccaaatccttaaagaatattaacattaataatcagctccagccagaagggtgtagccccaataataaatgaaaacatggaggcaagagcatgttggccatgcagacatcccatgagaagttgagaagaccatttcctattctcctcacttggctgtttctttttctttcttcttctacattccctcacctccccattatctaattcagtatgaacagaacctcaagtgggtgctggagccacagctggtgggccctgcaggaaatcaaccagctttccaggtgttgccctgacctgcacagtgccagaggccagggcttatgagggaaatacactagagaacctggaagaggtgactgcaatgtccttctgctgtagaaatatgcaagaacagatggagaaaaatgacccgtaagaggctgttccgaagctggggtcctttttatccttttatccagagaagcaagtttacccagaaggcatgtttcatgtcctcatatgcaaatgtctgttggtttttaaatggtcttagcaactgtgttgactgtgctgttagagtggctgagcagggacatcttttgaatactcatgatgacctctttggcaaccaatctggaagtcttggatgtttaggtgggctggtcatttcctaggtctttcctcagggctcaaagaggtgagagctgagtggcagacacacgcagaaacccagttctcaattccctgtcccatgacctccagaaagaaacagggctgactctttcaagccagcaagtgcccttcccctgcccagactgggaagtgccatcacctggaaactacagcctggtaaaagagcagttagaccaaaattcaggggaatcaaggcaaactgcatgtcctcaggaaagatattcatcttactgtgtctcattttcctcatctgtaaaatgcagtaacaatacccatcctctctctgactcaccagacttccataaggaggaaaagagagagctgacacccaaggcttatttctcattcaaactttttgttctgtttgatccttctcactcagtcattgacggccccacgcagatcctggttcgcgatgtctcggacaccgtggcttttgtggagtggattccccctcgagccaaagtcgatttcattcttttgaaatatggcctggtgggcggggaaggtgggaggaccaccttccggctgcagcctcccctgagccaatactcagtgcaggccctgcggcctggctcccgatacgaggtgtcagtcagtgccgtccgagggaccaacgagagcgattctgccaccactcagttcacaacaggtaaggctgcggtgggggagagacgcacaaggagggaaacaggggtggagccaaccggtggtgtcatcacagcaagaggagtattaggaatgaggcaaggtgtgtcagagcattggccttgtcatagacaccgcgagaaggaagcaagaggtttccagcatacaggaaaagcagcgctccctcactaggagaggaaaactagcttctcatcctacctctactggcaaccagatctgtgcttgatataaatccttccccactatgggcctcaggtttcccgtttgtaaaatgacaagtttgccttgaacacatgtaagcatccatatcgctagtccaaatggaaattttgtgagaattcaggaaaggtgtctctttctcaagacacattcttaccatttgctggaaattatcataataattctataaacctacgatgactacaccaccatgatgatgtgcattggcattatgctaagcccagcctgtacaactctaagcagaacttctgaccaattctgtgactcaccttgccgtttgtaagcactagcagtaaggctaatatgaggctgactcccacagacaggaagttcataaagcccatataaaacctgccttgctttgattaccacccacccccacattctcaaggccattgggactcttaaagagctttgccaacagttgggaaaggccagacctcggggtgacttgctccctgactctctcagtgcccatcagtctggccagctagtgggctagtaggacaggcaccatccaaaggacaggctttctggcaccctcaattgggtcaataagggcctgtgatcagattagtgattgtgtctgtcttctggattctcagtctcatcctctttgccttggggtggtcacatgtcaaataatatctctgccaactccaagttgacccagggatcaatgaaaactgataacatctgtaagatctaagaaccagcatcttcagatgggataaagttggagaatcactaattcaagaattctaccttagactgtggcataagagcctgctacagaatggaatgagtccagggttttcaagaagattcaataaataaataacacccctgtgttccactgggtttaaaatcaattgataaataagggaaaaagtgaaacagatggacaccaaaatgtcccctagattgcagcatgtaacttagtgtcatggccagatgggtttgcaaactggatggccactgtggacctaggcaagtctctccatatggcagaaattgggagactatccaggttaggacttagagcatagaggaacaagtaggtgcctgaaccctcggaacagcctgtcccacgagagaggggaacagaagggcaatgcccaggccttgctgcaaaactcaccatttaggtaagctcattttctccagcaaaagagagacaagagccttaggaaggaaacatcaagggcagggaaaagcttcccccttaaaaaggagcaagtacagacactgacaaaatggagaaggcaaagtttatttctgaaaaatactcttttaggttttctctgtagtgcctgggccagatgccaccctgtcacccagggggtgcccagtgggatttttactgaacatatcttggaatccggagtgaccgaatgtgcatcttgaaacaatgaactaaattctgcccatttctcttcccttctgcttcctcatttagccaaagatgctcacgtcccttcttggttaattctaggtcagcttctcatttcccacccccacaataccacttgctccggggtgtggtatcttctgtggacaatgagtcctgcatccttttcttaatttcaagatagttttgtttgaaaagtggtttctttgtgctctgctctgataagaagtttgaagcggcaaaaaggagaggagagctcttgagcagcatgatggaaaacaaattcttggtgttcaggtcgacaagatggaagcaggattggctggtggcccaggaaaattctgatcaagacaattacattctgcctcctaggagctccccatgagtttcagttcattgctacatggctttctgtttccagttgcctggtggattggcagctgtcaggcggctgacttctcaatacagcctcagcctacacctcaaatatgctcccctctgctggaggagggtgaggggaaagaagggatgaggagatgcaaacagcactgcagacagattctccaggcctgggttggcaggtgccagttaaatgataagagggtacccagaccctcatgatgaggccctcagtcatttcagagctccgcttaaattcaaattaaccaaagtgcttttccaggtgatggctccgacactaggagtgcactaattgcacaggcaattaaagcagagatttgcttcctgcatggtgagtggatatttgcttgggtcttagagctgttctgaaaaggaaagaaccctgaacaaagtgcaccatggccggtgattggagagaagccagcctagaaaacccagaggccaatctccaaaacccctccctgccctcagcagctctggtttcagttgccctcaggagggaactcctggcaccatttctctcctctggaggccttctctttaagcagatccctcaatgttccaagcacagtcaccagggcatctggtcaaccagaggctgctgttttgacctgaatactccagatttctctttattgctattataggttgaattgtgctccttaaaaagacgttgaagtcctgatcctgatgcctgtgaatgtgaccttatttggatatagagtttttgcagatcatcagttatcatgaggtcattagagtgggccctaagccaatatgactgtgtccttatagaaaggggaaatttgggcacagagacagacatgcccacaagaagaacaccatagtgaagatgaaggctgagatcggaatgattcttgattcttccagaagccaagaaacgccaaagatcaccagcaaatcactagcagctaggagaggcatgcaacagattctcactcacagccctcagaaggaagcagccctactgacacctgtaccttgagtctgtgagacaataatttttctttttttttttttttgagatggagtctcactctgtcacccagtctggagtgcagtggcatggtctcagctcactgcaacctccgcctcccaggttcaagcgattgtcctgcctcaagcctcccaagtagctaggactacaggcacctgccaccatgcccagctaatttttggatttttagtagagacgaggtttcaccatgttagccaggatggtctcgatctcctgacctcatgatctgcccgcctcggcctccctgtgtgctgggattacaggcgtgagccaccgtgcccagagagacaataatttatattatttaagacacccagttggtggtaccttgttatggcagccctgggaaactaataggaacttccaagtcccaacagttcaagcccctagctgcttggcagtgatgccgctctaggactcttcaggaaattctttcacaatttcaacctggatgatacttgcacctcagccaagaatctggctgcaaagagcagggtaggacttcctgctcatacaagaccagcaccctcagtcaaagctatccttttttctgcaccttctcaccccaagcattctcaatgctccacagctgaaatatttaacaagacttttctacaacttgatgtgtgcttatcgaacacctaccaggtgccaagcactattctaggcactgaggctacagaataaacagatagacaagatcctggttcacattaattacattccagtggagaaactggacaaggcagaagaaaataaacacccaaaattattttgattatgagtactataatgaaaagcgaaataaacggtacagaagcgtggccatgttggatcaagcggtttgaaaaggcctctctgaaaaggtaacgttttaactgagacctagatgacctaagccatgtgaggatctggagaacattccaggcaaaggcagaagccagtgcaaaggtcctgaggtatgaataagcttgatgagtttcaagagcagaaaaaaagcaatatagctagagcgcaatgaataagtttagaagtcgtacatggagatatctgagaagcaggcagggccggatcactcagagccctgctggctacaattaggagtttgtaaaaggaagcaacagaaaagttttaagcaagggaattacttaatctaatttatgttttagtggctagatatgtctattccatagtctcaagtctctccacacagcctccactagacatctgtctttgcctcgctcttgacttgctgacgttgcagggaacagctcccacctacaggggtgcccttggtggccccagtctcctagaggtcagacttcaaggccagagggagcaaacaatttcaccttgtcctagctctaacaaccacctttccagacctcattctcaggattgacttctttcaggatcattgacattggaggtatctggtcccttcagagacaacacttccccttaatctacagaccacaacccctatgatcaaaaatacaaaacaacaacaacaacaacaaaaaccatagtttaacatttccaaggcctgggtttttagttgtgaagagcactaggtagaagtctcaaccttaaccctaaacctaaattaattttgccccagttcagttctagctgcacaccccaagcccagtccagtccctttgcccagcttctcctcatgcatgaaatttaggggcaacaatgcaggggcaggtgttcctccacatgcctctctatccaagctcctctctccatccaactgctggagaaataacacacataacacgtcaagaatacatagtatctggcaagctaaagtacagtgagtgaggaagaatttctcaggaaaacaagctgcagagccataaatctgctaaaagattcacccaatttacatcgctaaacagaacacttctcactccaaagcctctgcgctcacattgattcacggcatttcagtcttccacaagaacaattggtggaaacttgccttgcttttgcatattaaaacagtccactcgaggttttctcacaatgaatggctagttcactccaaagttaaattcaagtgtcaaaggcaagaactattttaaacgttttaagtgacagttgttccgggcagcacgttattgcactgcaagttgtttatgctgtttctgcccaaagcagcttgaggagatagccagtcctgggagaaaaaaagcagtgtccccgtcgtctctttgtggcaactgcagagaacaagcattgtggttgatggaactcaggaaaagcttcagaggcaacaggaagccagcccaggccttgggcacctttttttttttttttcctttggagacagagtctcactctgtggcccaggctggagtgcagtggtgtgatctcggctcgctgcaagctccgcctcccgggttcacaccattctcctgcctcagcctcccaagtagctgagactacaggcgctgggcacctatttttgtacagatgcccatggattgcctaatccatgcaacaacctgaaaatgttggtatgatttgccccttttacagaggtggccatcaaggccaagcagggttaaaagacttgctcatggttccattaccaaagatgtcagagctggggatcaaacggaagcctgactccaaagcctatattatttctgctacatcacatcctccatatatgtcttacctttacagctgtgtttattcaagtaaacacagaggaaggcaccttacacttcaaaaccttgaaatcaacagtcttctttttgtttagtggtcaaatttgatattgttctattccatctccatcactcgggagctggctctgattttctcctcctggggtttcccttgttttgtttttaagcttatgatgttgactggttccttttaaagtttctagaatgccactggaactcttgaatggaaatgggggaagcataaagtgtattgatcttcagctcccaagtatcactctaacctgcccaaggaatttgtcacagcagaccaaaaagctaagggtagccacagtgttcattcaaatgtgagccagagggtcagggggtgtgggctgtcaccaccaatcttttcagagttcaagatgcaccacaaatgtacattacattatcatgtgcgatgttggtgatgtctgtctatttttagagatcgatgcccccaagaacttgcgagttggttctcgcacagcaaccagccttgacctcgagtgggataacagtgaagccgaagttcaggagtacaaggttgtgtacagcaccctggcgggtgagcaatatcatgaggtactggtccccaagggcattggtccaaccaccagggccaccctgacaggtgagtaagacctatctcttggggttatgctggttgctgagtctataccctcacagctgtctccccaacctacacatcttacaaacccatggccaattcctattgatctcatctcttaagtgcctagcacatatgtctagtactgtccattgtactgccatcacctgttctaagctactaacatctcctttttttgagacggaatctctctgtcacccaggctggcgtgcagtggcacaatttcagctcactgcaacctctgtctcccaggttctcatctattatcttaaccattgcaataaccccctcacattgtctcctggcccactcttcacacctcctccagtgacttttttttttttttttttgagacggagtttcactcttgttgcccaggctggagtgcagtggtgtgatcttggctcaccgcaacctctgcctcccgggttcaagcgattctcctgcctcagcctcccaagtagctaggattacaggcatctgccaccacgcccggctaattttgtgtttttagtagagacagggtttctccatgttggtcaggctggtcacaaactcccgacctcaggtgatccgcccacctcggcttctcaaagtgctgggattacaggtgtgagccactgcacctggccttccagtgactttttcaaagtacatttttgattatgccattgcactgtgcagatattccagggaattcccactgctcttaggataagcccagacccttagtgtggacaccaggccctgcctggtttcccctgccctctccaggctcacctcccacccatgttccctgatgttttctgggctccaggcccacaagtctgcttctttccatttctcaaatacgttttccctcctgctatataggactggcaaatgctgttccctctgcctgatgggaacctcttcatctagccaatgcaggcttccctttccactcccaggttactccccactttagggagctttagtggtcaaatttgatattgttcctgagagagttccattcattctgtccggcagcttcatcttgccagtttccattcacttcttagcactcctcaggttatcattttacatgtgtggcatgactatttgactgtcagtctccaccctacacctaaatctctgtgaacattgcaccatatttggttttgctcatcattgaatctcagggttcaccatttcctgaatgaatgaatgaatgaatgaatgaatgaagctgcagaagttcactatgacttgggcatggattgcaagaattcactgataaaatgagagccgagtcatgccttatgcacccgatgaaaagtttgggtttattcttgagggcaacagagagtcattgaaagattttaaataaggtgatgtaatgactggattgtacagagaagggcaaggtcagaggcaggaagactggttaggaggctgctgctggagtcaaagggagatgatgatggcatggactaaggcagtgtcctcggtcaccatgatacctggctgggaagtgttccctgtcccctgggagtgtgagacccaggcaacaccactcctggggcctctggctcacccatccaagaaaacctcccttcccaaactcaccaaagagtagaagactggaaatgggggtgtggttttcagataaaggagatgctgtgcagaacagtcatggaccaggagctgccaatgtgctcacagacagagattttgtttaatttgtgtcttggattcctgcaaaagtatttgctgtcttgatagacaagggatacacagcaaagagtgcatacggtaaacaagggcagtataatcaaagcagttttcctcccaagttgaaatcccagaccaccttgccaaacacagccagttaaagtaaatataataaatgccttttccagacagacgcactcctaaaggcacagcaaggagatgagaagatatgctgaccaagcagattaacgggggtgaattaagcagagaaaggatagaccagctggcatagggcctcgcagagagctagaaacagtcacaaaaattaagctaaatccaaaaaaaaaaaaaaaaaaccctgaaatgatacaggagggaactgattctaagcgcagcccatccctgcctagagccgcaggctaatttggtaattagcagttatataaaatcgatggctaactgttcagatggaggatgcgccatgacatcatgagagagatagaaaaccccacgtcctagttattatttccctctaccgggaaaaaagaagatccgacactcactgatcatctctcttattccaggaactctcatacagttatagcttctttaatcttcacaaccacctcatgaggtgggtatggttagcattcccattttacagatgaggaaactgaggcttgtggagtttgaaaacctgcccaagttcacaaggctagcaaggggcacagctgtgattcaaagccagtcctttcgagtcccagtcagaagattccccttccacagctgcttctgctaaagaagtaaaatgtaagggacagtccaaatttaaatgccacagacctagaagcgatgggaaaattattattgagtagggggcttaaataggttgattttttgttacagtcagatttaaaacatttcaaatatatgtgtgtatatatatatatatatatatatataatattacatttatatattacacataattatctcagggagttcactgctgaggagatttatgaggcaaatagcttaacataatttaagaagggattattggcacataaggaaatcaagtgtatttgtactcgctgagatgctagttgcaaggattgttggttctcttgctgaggcatctgggggaagagaagggagagccatgaaaaagagaaagggacaaaagggagaagtttgactctggctctaaaacattgtgctttctcactcactctccaacttggagcgtaaaaagttaagtttttcagcctccaatgcctgtgttcagacacagtttgatctgaatgctctgctccatgcaacatgctaagagcctagactttcaactctgtacccaggcttgccacttgctgtgtgatttgggacagttgattgaatctttctaaacctctgtttcttcatctgttaaaggggactgataccactgaccccacagtgccatcatgaggcattcatgaggcaatacatttaacgagtttaaggtagtgcttctgacaacaaactactcagtaagtggatgacagtggtgaagacgaaagagatgaggaggtctgtgagctactggatggtttaggatgtcctcctttagtccatgtggcctagtggtttagaaccttgcctctcacagcgtggtgcagccaccagcagcctgggcattacgcccagagatgttggaggcctcttcccccgagaactaccaacccagagcctgcattttaggacccctgcttcaaggaaatctatgagtgagaagcactcacttagagcacagctgtggaagtaccccactcaggggggagaccagcttcatgaaaagtgcatccttgagcaaatttcttaaatttcctgcactttagttctctcatctaaaagacatcctatctacctcattgggttgtagcgagaattaaatgaaatcatacatatatccctattcaagaacttaggatggagcctggcacacagtaagcactcaatacccattcaattttttattggtattaatcctcacaaagctcagacctgaagccgtggcagcctggcctttgctgggcacaaggtcaggccccctttactctcactgttgactcaacacttaaagctctatggcacctgtatttgccattccctgcagaagccgttgtctctgaggccaccattttcctctttgttgtggaatccaggcccttcctgactctcctggtctctgagacattcccagagctggctggcagcaagtaccccctcttgacctccctctttacaaatgttgccctctgccacacagagtccaggctggtgcccaaaattcaaacactccccccccattattctctgtaggcaatgtccagagaattccttctgggatatgaatttgtttctgaacaacagactcaatgtctgcaatgactttttctctctgctctagtggcttctgtgtccttaataagtctgttttagtctcagtcacttagcctgtatgatgtctgtttggcctgtgcaccatacctatagtcccaaaggggtccttgagtgttacacatcttaccagccagattagaacctggcaccatgtaacagggtacaataccattctgctttctgggcagcaacaaaaaaaaaaacaacaaatcatttagaaaactccaagtggaaggagggagggaaagagagagagaagggagggagaagatttttagttgctgattgcaatttagcgaaaaaaatcaacttccctgactgggactaacgcaaattataaacactactctggcctttgtgtccaaggtgactgctctaatctttcatcaaaaaggcatgtggttgtgttttagcaggaggggagggggcttgccctaagccatccactctctctcacctggtcttccctcatgaacagaagcttaggatccgtaaggattctcatgaccaggaaacaaggcaaaaggagccaggcccatacggtcacaggagcaccgtgctctcacaaccacccagggcccgttcatcgcaccccttacccactccacagggcacctgccttaggcctcatggtggcatttgctaacctgctgcctctccctgcaccaggactatctctatctccagttgacaagctgaaaaattgccaacagggcctaggaaatccagaagctttacagtttctacagatgtgatacaacataggactgcaagaaaacagagacttacagccagccacacatgatgcactcacactcaccacatgcacacatgtacacacaaacacacctacagactcttgcacttacacttaagcacatacgcacactcacatgcacatacacacatactcatacacacatgcacacactcatagtcatacacaccacacatgctcatgccctcatacgtacacactacactttcacataccctcacacgtacacacactcacacacgctaggctgatgcctgcaagtacgtcctgatcatgctttgggagttgccgccttcaaggtttctggcccaaatggggatctagtggtgagaaggttggctcctcagggtacactggcaggccacgtgcttgtctgcaggggaagaaatctgagactccagagggagtccagctggcaagtcagcactgaccacggcactcgatgtccacctcgctatgtctgcactccctgatgggccagtgcacaaacaccaaacccagcaccagaccttcaacgccctgcagctcttctgaggaggaaaggaccaggcacagggcctggggtcccgggccagacagtgctcagcctcctttgggcgaagtcacagtgaccccaagtggtcactttggtaaggcaccctctaaacatggtgtcaccttccaggggcgggaagctggggagtgggctgcagagacccaagttgaagaggaggaaagaaaggacaaaggcttccacatacctcttcctcacggagctgggacatacagggcctattccttatttgtcttaaaggctggggataagggggctgggggaaaagccaggtgggaatatttcagctgcagcttccacttcctcagcagggagtacttgttcacagcaacaacccagaatagggatgctcctatatgacaaggttgatgagctgtgtttctcattaattccaccagcaataagaaagttccatctggaaacaggccttagaagtattatttttcttatcaaaaatgggcttgttaggccagtcccttcctttaaatcaggatggaattggctgcttctcttgaaacttgaacatcatgcacacccaaaaaagcagggagatggcctcgaaagcctgactcattccaggaatcctgaagatgcacctgtcataatccaaagagataagtgtggggaggctgactgctcagatctccatttaactaaaaagtagattggtgcctatctggtgtgatttcaggggctctccagagatattctccacatatctcccccatgaaacctctggtctccaaattccactgatgggaaatttctctatgagggaccctatattagtccctgggttttcatgaattattttgccagagctgcctttgcatgccctgtttcctttgtctgggatgccctccctgccaccagatgtccatgggtccttcaaaacccagtccagatatcctctcttcggagtctccccaacactccccaccaccaccgctactgccaccagcaccatgctgcttctgtgcatgttttctcactatactacatactgaaaaaaataaaatctttgacccaaagacctaagagtctagtgaggaaaccaacatgaaaactaacaataataacataatcactataaaaatcgcagattgactgcaagttccttggggacagggtcctcagtttgtccctctctgtgaaggtaggcacccagtgcactagggccaatcacacccctaacctcagtttcatagacttgagcttcacagacacttgggagatgatctcagggatttaaagatggaaaggtccatatttcctcatgtccacttgatcccaaccaagtctgcagaccccaagtatcttactcatgtttttgctagcaagagacagcaatctcagttccttgggcctccttctccctaccactttccctgctagcgacagcaggcatgaagaataggttcccaaaacagggctaagtgagtcattctgcctttatcaccacagtccttgcactgcaggtgagaatgtgctaactcctgttcctttctagccctaattaatctatgaatgctcattatgccccattctggccactagagaattccatatttccttccctctatctttccttatcttagccagctttaagttccaactcaaatgccttctctggaaagacttatctgactattacagcccatgctgatcttctccctgctgatcgtgtcctcttagtcccatgctgatcttgtcctcttagttagcagcctctgctttggtcctgcattagtccatttgcattactataaaggaatacctgagggtgggtaatttataaagaaaggaggtttgactggcttacagttctgcagagtgtacaggaaacatggtgccagaatctgcttctggtgagggcctcggaaagcttacaatcatgcgggaagccggaggagtagcccgcgcatcacacaatgagagagggagcaagggttggggggaggtgccacacacttttaaacaaccagatctcacgagaactcactcactatctggaggacagctccaagccattcatgagggatccacccccatgacccaaacacctcccactgggccccaccaccaacattggggatggcaattcaatatgagatttggaggggacaagcatccaaactataacaggtaccaaatcactctcgaataccaagttgcttactccactccttcctcctggcctgtaagactcagggatgggaaccatgctatcatgagtcagaaaataacaagagacttgggttccaaacctagttgtatcatgtatcagttttgtgaccttggccaaggaatagacttcttggagcccctgtttgctcatctgcaataccctatcagtagtgcttcagggaaattaaataacgtgtgaatctttaagaagctcagtaatacttgcataactctttaccatcagacactcaaaaagtcttcattttttacttctctttttcttccctccccttcgtcattattcttttccatgtagcttagtgctaggcatattatgggtgctcactaaataattattttacttttttagcacagattccttttcacccccaaaaggcaaggctaatgtcttgttcagctcacaccaccttgtgtctgacacaaaggaggcccttaatatttgttgaatgtatgactgtgctttaggggttccaagaagaatgggtgtgaggtgaaagagttgagaaaagcatcaacctccaagttgaacaaagaaagttctataaggaacagagagtagtgatttcctatgggatgaattttctgtgctattgttaagaaagggaacagggccatttatatgttaccacttgcaggagttggatggagagataaagggggcattgatagagagcaatggggtctttaaaaagtgagaaatccctaggagtactcagagtgctgatatctaagtgcactggctatgcctcggatacatgtgtttttttttttttttccagcagaactgtgtctaacctgctggcaaagagcaacaattcacttgtagcatggaagaaagctgctgaaaatcaaaggaaagcagcaggcacaaacctataagcaagtcccacttttccatcctctagacagaaaacctgggaacagaacacattaaattctgctctgcagttttctgggagaagatgattccattgtaaattattgaacatttcatttaagcttcataaataagaaactgggatgaaaatgttacatgttagatctgtttggcaacgtataatttctgtcttactccctccatctgtcacccttcatctatgttggagaatttctacttcattataggcaattgaaggtcttaatcagttgcctgataaaagtagtttatgtcccaaaggtaatctcatttctgcaaccaaggatgtacctggaactcactgaacatattgatggagataaatgtgtgcttcaaatggatcagggggtattgcaatcacccactcaatctagagataggtacttggcccagccagggacaaggtcctcactgccacctggactccctgaatcactggtttccaacagagccaacaggctaagcctcagcaaaccaataacaacaagtcaacaggtgcacccaggaccggcctgtacttgcctggggcggtttttgtagttgatgagaccactcaccaaaaaaaaaaaaaaaaaaaaaaaaaaaaaaagtactcaaaatccaggaatagttctctgtgcaaagtaataaaatactagctactaccgctaagatccaggcactggactttaaacactttgactcatataatcctcatgatgaccctctgatatagatgctgtttttattctcattcttcagaaattgaggttcatagatgttaagtaatcaaaattacacaggtaaaaagtgaaagagaccaaatatagatatgtcagacgtcaaagtctgtcaaacttcaaagtttacctccactggtgttgccactttagagaaagaaagaattaagggttgggaaagaaagggagctggtttaagaagagaaaaaagagggctgattcgaatgcctacccagacagggcttcgggactgcattcctgggagagaaaccggcctggtaagctctgccatgcttaagcaacatttattgcatggactccacgaaagcctactgaggaaggggatgaagaaccccctggctgccaggcagcattcctcttgaccaagccaagccatttgttaaaggaatgttgctcaaagtatttccgatcaaaatcagggattccagagaaatcacagctgccctgagcagtggaaggaagtaataggatgtcccattcctcctaaaagccctgaactctgagaccagaatccggggggcatctctagctggtcacagacttactccgtgccacagtttctttttataaaaagatgatgtactctgttgaataacagtcccctcaaaatgcatgtccaccccaaacccttatttccaaataaggtctttagagatgcagtagagttaagatgaggtcatactggattagggtggcccctaaattcaatgtgactggtgtgtttataagaagaggggaagacacagacacacatgtgtctacagaggcagagactggggtgacgcaactacaagccaaggaatgccagggagtgctggcaaccaccagaacctaggtctcctagagccttcagaggaagcatggtcctggcgacaccttgatttcggacttccagacttcagaaccgtgggaggacacatgtctgttttaagccacactgtgtgtggtaatttataacagcatccacaggaagctaatgtagatggagaaaagactgcttatcccaccttcctcccaaggttgtgatgagactctaaaacacaatccattttgaaaagcacagatgttatataaatacagaataccattccaatcagccatgagcccacacaaagccccaaaaagagcctaccggaaggactcagactgaccactggaggccctcagggtgatcacttgattttgttgggtttttttgttttgtttttgtttacttgtttgtttgtttttgtttttttgatacagagtctcactctgtcacccaggctggagtgcagtggcatgatcttggctcactgcaacctcagcctcccaggttcaagcgattctcctgcctcagcctcacaaatagctgggactacaggtgcacaccaccacacccggctaattgttgtaattttagtagagatgggtttcaccatattggtcaggctggtctcgaactcctgacctcagatgatccacccgccttggcctcccaaagtgttgggattacaggcatgagccaccgtgccctgcctttgttaggtttttctacaaccccagtcctaatagataaaaatgagtttgatgccagttgtaatagatgaaatagccctcaaagaatccccagcatctgtgaatataaccaccttacagggcaaaaaggactttgcaggtgtgattaagttaaagatcttgagaaggagagactagcctgtactatccaggtgggaccaacatgatcgcaaggattttcataagtggatgtagggaggtcagagtcagagtagatgcaatgataggagcagaagtcagacagagaaaacagatttgatcgtttcaagcttctggctttgaagatagattaagagaccatgaaccaaagaatgcaggcaacctctagaagctagaaaaggcagggaaatggattttctcctagagcctccagaaggaaggcagccctgctgaactactttagactgcagacctcctgaactaactgtaagagaatccacttttgttgttgtaagtcactaaattgtggtgatgtgttacagcagcaataggaaactagtacaccagtcaaaccagttagtctgaaaataaatgtgaaagaggtcaaggagagaacctagagaattccagatattctaggaggttctcagagatcctttgtagtaaacctcccaaaggatttcctcagagaagcttacaccctttagtgggacagtttttgtgtctcctctgtcttcctggactcccctgaaagttattctaaaattagatccacagctttagataccctgaggcctgaattactgaacttggcggggggcctacagcaacaggacttctgcatgctcctactcgacagccctgtgcttagaaaaaaaagtccatccactgttccccctagaagggacccaggagtccccatatggcctcagctcctgtaaaaggtgtagcttggtccttgtatataacattcaaggaatgcttttcaggtctatgtccacactgtctctcttgattacatactcccgaaattcacaatttaagcaagaaatcctctcgctggttcaagccaacctgagacgctaagcatacaaggagtccttgtatacttatgtgagcacacctctgaaggtcactgacaaggcagcctcactgccttcccagagagcctgcctgcaagaaggaagctctgcgtgggctggttcgtcctattgacttgggattcctaaatagtgaaattgggatttcttaatagttcaaattaggagaggattcaaggaggactaaacacaaggtatgaataggagtctaagatcattttcttcccactttcagccttcctagccctgccccatacacagaataatgtttgtttctccatccactgatagatctggtacctggcactgagtatggagttggaatatctgccgtcatgaactcacagcaaagcgtgccagccaccatgaatgccaggactggtgagtaggaggactgctgaggaagaagaccaggttagcctataagcctaaggagtcatggaggctcgtcccagcaaaaattaatcagaaagcaatgtcttccagtgaacagggctctggtgacaactgtcagcctagaaacaacatccaccctatgcctaatccttgatctctgacaggcaggacagagtcaccctcttccccacagacctgtgctcggtcccccgtggtctgaagagctgctcagggctgtacagagcagaggtggaaaatcctaaataggttgatgccattgcaggccatatttttatctagaccaccccgacagcaggcagaatggggcatcctcgccctgcatacaccacagaggtcctcacaaacaccacttgggtgaaggtctagacttgcaacaacccattaaatctgagggcagaagaaaagtccagctgagacccttgctgctctggattcagcagttttgcttccaaatcctgggtaaatttcaaagtcatttcagcacctatggtactagcagcctgggctgggctagggattttagaccagtccttgtcccaaggttcagcctctctagagaaccacatggacaaaagtctccaggtcctcagatctagctgcctgcctggctatggttagaacaagtcaaaatagcctcagggttggagggtggtgcgcttctgttgccaggaatggcatatccctacttggtggtagctaccattttatccttattggctcattgagaaaggatgggagaaaatgaatatggcgagcttgaaaatcagcagccagctttgtcccagaggtggatgcaatccagtggtatcagagctcatcacggctttcttcagattgttcatctatttgccaagcccctggccatcattcagagggaaggtacttagcaaaatatgagataagtgtcagcaatgacaagctagtgctcatagtcagcaggcctgctgatagcttggaaacacacaaagcaggccaataaatactgccctccaggggaacacatgtaaaataggccatttatgtcaatccacagaacttgacagtccccgagacctcatggtgacagcctcctcggagacctccatctccctcatctggaccaaggccagtggccccattgaccactaccgaattacctttaccccatcctctgggattgcctcagaagtcaccgtacccaaggacaggacctcatacacactaacagatctagagcctggggcagagtacatcatttccgtcactgctgagaggggtcggcagcagagcttggagtccactgtggatgctttcacaggtaccagagcagcagaaatcccagccaggttcagggatcagtggatctcagtgtgagaaattcattcaggcaagtcactcttccaatgttccatttcctttggagaaaagagaggtgggtagaaaaggatagagtaaaaactaataagtgcatcaagagggaagggttggaagtaaagaggggaggtgagcaatagtgttacctgcctgaaaacttgtgtctggcttttctatggccttgacatagtagttgattctgtccatctttccctgctgcagtaaatcagtgggaattcagaggatccatgggatcatataaaattcattccaggatacaggctttcaatcctggttcagtattatgattaactcacagaagtagttctcattttaacagaatccattttcctatatttggattggaaaaagtggagtgaacagcactggagggtgaggaggtggaatctcttggttagtgggtgaaggtgtggcccttattagcaaggagagcaggtccctttagccaagaagttcttctagcccagtgacccatctcctcacgtgtttcaggaccatccatctcctttgctttgcaggcttccgtcccatctctcatctgcacttttctcatgtgacctcctccagtgtgaacatcacttggagtgatccatctcccccagcagacagactcattcttaactacagccccagggatgaggaggaagagatgatggaggtctccctggatgccaccaagaggcatgctgtcctgatgggcctgcaaccagccacagagtatattgtgaaccttgtggctgtccatggcacagtgacctctgagcccattgtgggctccatcaccacaggtgaggctggaggacttggcagcaggtgatgaaaggggttttcacagtagcctttgacaaatcaatgaaattttaaaagagaaagacccaaggagtaggggatttcctctatggctagagaaagtctgtgacctgttctgaaacagctacttcctccagtgctgcagaagatgcattagataagaaactcccacttggaaggtgggacaaagtcaatgtcttgaggaggtcaaagcttgaatgcatttgtccaaaagacctcccactaccagcttagaagaaaagcactggagaaagctagtctccaagaggaatccctctacagtgaagagacacctgttcctattctgaagaaccatctcttaactgcccagaaagttcactcgtacaataatgcttccttagtctcacatgggactagcatgcaatcaggtagtgacctggcactcagagaatggggttgatttggatgttgcttagaaaacacaggcactcagagatgaattggatcagtcccagctcattattcccaaacacagtttcaaatatgaggtacatgtgggtgaagatatgtatgtttgggtagtttcctccttactaacaagaactcacaaactggacaagtagattaaacacttagctgatcaactctgtgatcccctagcagtaaaaaaaaaaaaaaagcccatagcataaatgaaatacaatttaggaaaatggatttgttctggacttgtgctctgaaatccctgtacagtcaataggcagtttttcaaaactgaaaccaaaggtggctgctaaagaataagagatacaggcaaaatttggtttatcttaaaaaattacctcagagaaaatgcctatgtttctcccaattcaaaacaaaacatatgaacttaaaaaaaaagttcctagttggcttgcagataggtaacaggtacagagcttgccagcttgtcttcatgttgttaaaatattctccatgaacatagctttggtcatacctacaaggtttcaagtgaaacatcagcgtgaccatggttttaagataccctattacatggaaagatcttgtctgcctttgggacaacattggcttttggtcaacataaaaccagggatgagaatttctttttcacactgtgctttctgtctttttcccacaatcactgggtccttgtaggaattgatcccccaaaagacatcacaattagcaatgtgaccaaggactcagtgatggtctcctggagccctcctgttgcatctttcgattactaccgagtatcatatcgacccacccaaggtaacaaagtgatttgatttctcaaagatactaggatttgggtgaagattatgggagaactagcatatcccgcagaacatccactcctgcctgcgtttttcctcttctctgtggcatgctgcatcagaatgagagtgggctggtgagcagccaagaaaccccacactcaccaatgcctcttgagaaaggcttgattacattcacccagagagcaggcccttcactagcagaggtaactgatcaccattatctaggcagtgtcttgagaaaaaaagagccccaaaagaatctgccaagagcttgggtcacatgaatattcctacaagaatgaagttcaagactaggatccagagggatggctaaagacccagcaaagccagatggagccttggagggaagcacagtgatgtggtcccatttcagccactccagacaagttatgagtcagaggaaactggcccagacctcacctgcatcctgccagttcttgctggtacatgtggcatttttaaggaagtggagggcacactcacttccagtgaggacacaggacagcattccagactacactgtctctggactgtggggactgctccttgcatcggtgccctctacactgccttaatgtcattgtcttagagaagaccagcttgttagaaaaccacttaataggtaggtcatttttctttgctccaaggagcccataaaatgaaggagtgagaccagtgtgcaaagcctcttcacactccaacattcccagcccatgaaccatgtatcatccctccccactgagtgcggagtcccacacccatctgtgctttattgacatagactgtaccatgggctgcttggatgaaagggctgctgaattttaactgtagattcttctcttctccagtgggacgactagacagctcagtggtgcccaacactgtgacagaattcaccatcaccagactgaacccagctaccgaatacgaaatcagcctcaacagcgtgcggggcagggaggaaagcgagcgcatctgtactcttgtgcacacaggtgggaatgtctccctgctgtgtcaagtcagaaccctggctgaagatctgggtgaagttgttcgggcttgtagaaaggttctggaggctaaggctccatttcggggtgctcctccaactcactgtgtcttgcagggcaatttgcaatttctctcccccaatattcctccctaatactaaacgtttagagagtcaccctctagaagtcttgctggtttaggttaggaattttcatggaacttccaacataaacagtgccctttcagacatataatggaagtgaattctaaaacagatatctgaatcattcatctgattttgtaaaagactcagatgagaaaatttcacctcgagaagaaaagggttgttattccagtaatggaatggggtcatgaaattcatcatcagatatagccagaaaccaccaagaaggtgcctttgctcttgctttgtgctccagggagaaagaaggcaccaaagtggccataactccctcacccgggaccaaagcagtgaaggtgatgtggctccgtgtgcatcctgggctgcctgcaggggcaccgtgtagctcatgtctctgacaggccccctagtcagatccagatgtcttctgcatcctccatcagctcctacataatgaccagaggaagggaggtgcaagggagagactggcttgcaatatgggaaagtgaggaaaggtagtccaaatcccatggcctccctcttgaaaacaagcccacgcaatggggctgaagagaaggctcctttgctagcaccactgctcctccgtctctggcccctcagcaagtacaccaggcagaacatgcaaagattcgctgcagaactcactagcaggcacagccaaagtgttctattcccataccctagaccaaacctcctagttaagccatcattcccacagcacgtgggaaaacatccagcttgcctcattaggagaacacctggattttctacagttgcttaatttcactggagaatggtatttcccaaatgagggaaatatactttagaattccttactgctttcgtagatgttctcggaagctcagaaacagcatctctaaggcaatgggccaagaaatattccttcacaaacacaaaaattattcttctaaagacagcgcaggatattctgatcctccctagtctccttccaggcttatgacaacagataacacagccattcagttttgccctatctattaaattacctgtgaccattaaaatatcaacaagtgttggccagaagtgaggtccaatacaccaaaagaagcctctatcccaccttcttgaaccaagaaattcatattaaagaaattagcctttttcccattgaggacaataaaatgtatttcaagagcctcctatccccaagataaaagagaccagcaacttcaatcaaaaactcatttctttagccaggcatggatgcatgcacctgtagtctcagctaccagggaggctgaggcagaaggatcgcttgaatccaggagtccaaggctacagtgagccatgatcatgccactgcatgccagcctgagtgacagagcaagaccttgtctctcaaaagaaaaaaaaatccttgggtcatgagcagctagtatctctaaagcagatatttggtacaccaacccaaatggtatgcccatccaaactgccctcctttaagtctaggcagagctattttagcaacttccaataactagattgccccagaatgtcttattttgctgttgtatgtttgttgtggttttacgttgaggtctatgatcttacaacttttggaagtgagtgctccttcagggtgtcatgtttgtctcgtggtatcatgcatgtctcagatagatcaagccaagtgtagtctaagggctgcatttgaagaactctttgaacatgcagattatggatacaattccaattttaacatgaaaatattgtgcaggttgtttctttgtgataaaggacataggcaagtgaaaaaaatactttcaattagagaatagggcaagatccacagcagatcttggttctcaaaagtaaattttatgacacttgggttgagctgataactaaactgttgtaataacatccacttgtgataaattataacctgatggaagagaagcacagtaataaagcaaagacttagagcatgggcaagtaagactaggaagatgatcctatgacaagcacaatcttttcctctaacaggcccttttgacctacctaagcctggaagaatcctcttgactcttaatgcaacaaaaagaataccaaggactcagtcctgagtgagacttgtgagcagtgaagcaatcatccaataatcagatatgacttttgaggcaacctgactgagcccacgcagtcattccatgggtggatcttctatgttctctgtcctggggatactcctgcccctatggagttgccaccacacttcctgaagctcttcaacagagatctttccatgaggcacacccttacatttataaaagtgcaaatagcctgggaagtatgattatctcattaactaaaaaattataacaatttctgtgggttcttggttgctccatctagatttaaatgttgaaaattcattccagccatatcttgaaatcctctttagtatctggcacagtattctgcacataagaagttattgaattaattaaaaggaagagctgggggcgacggggggagaactggatacttgagagaagggaggcagggagaaatggaagaggctgatggaaccagaagaggagaaagggaagaggtttctgctcacttctttgttttgtagagtgcagcagcagtcttgcaccatgagtggaacttctgagatcattccctgcatttctatcctgcagctcctcttatctgtaactgataatctattctgtttcagccatggacaaccctgtggatctgattgctaccaatatcactccaacagaagccctgctgcagtggaaggcaccagtgggtgaggtggagaactacgtcattgttcttacacactttgcaggtgggtgtctgcaggcctgcagatcaggcaggtgggaatggtgggaattggagctgcagaccagtatgatgtgaataaacaaaacattttttcaatctgaaggacagattagaaaagttcctacttcaggtatactatgaagccctcaagatatccccaaactctatgctgggcatcgtggctcacacttgtaatcccaacactttgggaggccaaggcaggcggatcacttgaggtaaggagttcaagaccagcctggcctacatggtgaaaccccatctcttctaaaaatacaaaaattagccggaagtggtggtgcaaacctgtagtcccagctacttgggaggctgaggcaggagaatcacttgaacccaggaagtggaggttacagtgagccaagatcacgccattgcactccagcctgggagtcacagcaagactccatctaaaaaaaaaaaaaaaaaaaaaaaaaaaaagaagatatccccaaactctgcaaactgtatcaaatctaggagctgagaaagctgaatctgaaaggtacaagaaaggcatgtaaccaagggcaagtacaaaaacagagcaatagccctaggaagatgaaactcagaacagagctaagacttgcccccaaaatgctacaaacaagaaagcaggcttttctaaatattcgcagagcaagaaaaacactgaagatataggaccaagtttgaaacagagagtacaggctaacaggtgacaaaagattcaggactgctaaactcttccgtgtttttgtcttctctattcatatccagcccaacaggtttaactaacacgaaatcttgaagttcactgtcttctgtatcatgcttgttcaccttacaccatttgaagttgaacagaacagagaagcccaaagcaaaatagagttgagtcctccaagtctctaggcttagggaagttatttccctgccttcatcaaacatgtgatcacagaattgttttgggttatattcaggaatccagagaacaaagataccagaagacagaaggcaggcagatgtcttggttttcaaaaatgacagagaaagctaattctgtgagctgcaaagaagtaaacttattgtcaaagcttaggaaggtaaaaactaaaacagacaattaaacaacttggaaaaggaattagtgattaccatatagcagcacagattcaccaagaataagttttatcgaaactactttatgtctttgttttcattggcaaacctgctagtacatttgtatttcagcaaggcatcagaaaaccccacttatcacttagtccttagttaacatggaaaaatacatgaaaggtcatatttggaggtagctgggactgtagctgaatgaatgaccctccatgaagaagggatagcattactatgggtatgtcctaacccctctgtgagcatgcacaatccatctcaattcctgtcacccctcctttcataacatgatcccgcattttttaattatcaccatgctttctcaagcctccatgcatttgcacatgctatttctttcaccaggaaactcccccatttgcctgcctagaaaacccatccttcaagtcgtggtttcaaccctatctcttctgtcaaagcttccctgaaggcagtcagacacatctgctcacagacactaaacacacagctctaacagagcaatgaacttccattcattccacaaatacttttgatgccctcccatgtgccacacactctataaggctataaggattcagaaacaaaaattgagctctcatctttatggaactcacttctaatgatgttgcagagaagtaaatagttacaacttgatgtgagcagtgtatgctatagacatgcacagaacaccatgggccatgtccagtgggctactatgaatagggtcaaggtgtggagggaaagaaagaagaaaagtcttagataaagtgaaagaagaaaaggagaagaaagggaatttcaagaaaaagagcagactgtgggcatttgcagagatgtgagagtgtaagaagtctgaagaactaccatagtttggtatggctggagcattaatcaatggcatgatgtgcaaagggggacattaaaaagatgatatccttatacatgctcttccaaagcttaagcattagtttgaattttaacttgtttgtatgcctttagaccacaagaaacttgaaatctcaaagccctacctattctgaaaatgtgcctagtaaactgttaaatattaaataatttccaagtattctaattgcccaacagaggagttggccctgaactaatgaacagttttatcaacagcttgaatgaattcagagaagacatgcttaccaaatttgtgtataaaacaaaattgtgatcaatagaatccaagttcaaaaatattttaatcaactgaaacagtggcccaaaactcaatcaacgaggcaaaatgcaatagaaataaatgcaaagctctgtccatgggtataaaaaatcaactaacaaaattggattgagaggtagggggagtggttacaaagaagatctttgattagcaataatcttggcatgtgataacaatatcacatggcattcccaaaaccttactaattaatataagtggcacaagcacagactgaccctgtttatttcattggtcagtacctctccattattctcagttctctgagttttggactttagcagggacattgataaactgttacgtgttcagagaaaagtagataggactgtgaaggttttaaaattgtcacataaatgtgatgggaagtgggggctgaattttctcagtctagtggagagagaacttgattaggaagggtggtggagaggaaggggtcatgtacacaaaagactagatttatccttaataactccagagacacgaatagaagttatagagaagacaatttgacctgcacataaagaacactttttttcaattatgatatgagatgagaggggaatccttgcaaagagtaagatactaagctagataacctatgaaagatttttttccaaaattctctagtagtaaatccatgtgaaatacctttggatttggtagatctttcctaaactgagtagccttattcaacccttattcatattcatttgagttcagtcgctggagagaccatccttgttgacggagtcagtgaggaatttcggcttgttgacctgcttcctagcacccactatactgccaccatgtatgccaccaatggacctctcaccagtggcaccatcagcaccaacttttctactcgtgagtacatggtcacctacatacccgtatccctggggacttttgtggaaatgatcagctttcttgtggtggactagattatcacttacaggctttggacagggcagctatgagctgttcttatttggactgactacagcccaaattcagtgaaactaagctgcaacttttggccagcagagacatgtctgttttctgctctcaccctgggtgacagcagaagaaccaggtcaagagaggtctgtactcggaatgcatctgccccagaaaagtctgatggatattaaaaggctagatatctaggaaagagctgctgagtagagtgatgaataggagaaagtagacataggtaatatgtggaaacgtaagttcacgagtgaacaagcagacatgagagtttatcagggtccagatctcaggcatagaaggtcagtgtggaagatgtcacacccaagcctagaggccctgtaagggaaggggaagtagctgcaagaatgatcgtggcactgaatgattatcatctgacccaggagcaccctttatgctcctttccaagccagagcaggggtcagcatgtgagcaatcctgagaccaaagaggtgggcaacagatacccatacctgaaatcaagcagggggaggagctggagaggcaggcatgccctggcactttctcctctttgcagtcctggaccctccggcaaacctgacagccagtgaagtcaccagacaaagtgccctgatctcctggcagcctcccagggcagagattgaaaattatgtcttgacctacaaatccaccgacggaagccgcaaggtgagattttgctggaaagggaaaagaccatttcttccaagtgaggccatgtggaaactgactagtggagtgaccacaggacattggagggagggggaaggaagcaatccacaaggaactcatcagcttcccatcaaggatacccagcctgctgttgatgagagagccctagtctgcaagccagaagatttggatgatagtcctagctctactgctactctctacgtaagttgaggcaaaggactaaacctcctcaaggcttgctttcttctctagctaatgaaggtctctacccctgcaacttcactgggttgtgctggtgcttccaatacaatgacacaaagcacattggaaactcccaagtacatgatattggaatagtttttcaacaacagggctgagcaaacatgagctggataccaaattcaataggcttttatgcctcttgataagcattataaaggtgatatctgtgtagcctacagtaaagaaacaacaaatttttgttttatttcatcagttgaaacagttcatccagaacactgattttcaagtttttgttagtgaagcaacctctttttaaagggaaatcatatgcagaaaccaaaagcacagaatacatttcagcagagttagtctgcttgatagaagtaaggaggccttagatcccacttcctcagctctttctctgctctcaagcaagtacagtgcaatctgaagacttctagattcaataatgcaggtacctaaatttatcccaatgtgcattcctgagataggagctggcctaaatctcacatgggagctctcctctctgcttattggtgcagtaatccttattgtgggatggagaggatgacaatggccattgcaatactgacctagctgcccatgggatttggacttcccttccctactttcccaaattgcaagccagttgctcccttccaccacccttcctttggctcattatacaggagctgattgtggatgcagaagacacctggattcgactggagggcctgttggagaacacagactacacggtgctcctgcaggcagcacaggacaccacgtggagcagcatcacctccaccgctttcaccacaggtgagggagcatggccactttgatgccttcttctccacttcctgatgtttggctcatcagcagcctctgctgagacttgccctgggagcagtttatcaaaaaagctcagttgcctcctccttcttttcccctgtccaagcccctaccaggaaacctctcactaacaaggtaaccgcaggaaccagcagtacaactccctgatccacccggaccaattaaatgcaccaagtaaagacatcaggttctggctgggtgcggtgactcacacctataatcccagcacttcgggggcctagatgggcagattacctgaggtcaggagtttgagaccagcctgtccaacatgataaaaccctgtctctactgaaaatacaaaaattagttgggcatggtggtgtgtgcctgtaatcccagctactcaggaggctgaggcaagagaatcacttgaacctaggaagcagaggttgcagtgagctgagatcgtgccactgtactccagcctgggtgaaaaagtgagactccgtctcaaaaaaaaaaaaataaataaaaatttaaaaaatcaggttccttccagttcaggttttctgcaagtggttttccagcaaagtttatctttctcttcctccttcctctgctacctgtaatcagagactcacttagtaaaagcagcagtagtaaaccctcaacattaaacctgcagctcttttccatacacaaaggacttttgcattcctatgatctcactcagttcttatataacaactggtcaggaaggcctatgatccccattccacaggtgatgaaaccaaggggcacagaaaccaaagacttacatggctagtaaatagctgagtcagaccttgaacccaggtcttctacttctaaatgcagctgttccggctgccttccctccttaagtcagcagaagatacttgaaaaacgctgctaaaggataaaaaaaattcctaatctctataacaggaaataacctaatatctgacttttgagagttacttgccaagtactgtttaactgcattacatgtattacctaatgtaatcctcacaacagcctatgtggtatgcactatcatctctattttttacaaatgaggaaattgggccacagagaggtgaggtaactcacccaagatcccatagctcttaagtaagggagctggaatttgacgccagatgtttcagctctggggtctgtgttactaatgtttctctctaccacctcccactgtgcctctctacagtccataatgtaaggctgcccagccccgactttgaattctctccctggcccacattatgggggtgtgggtgcatacatgtgaggcaaacctgagcatgtcccatatactcagccacatcctgcctgccatgtcagagcaccagaatgactggattcccgtccatgcctcagagcctcttcctccatccccagagaggtgagagaaagtcccccagccccaccaggtgtctcccccactgcactcgttctaaatgacaaagcaagacactgatcagatatgacaaaatatccccagtggttctatagagtgcggagattgtgaacgagtcctcttctcccttctttttttacacttttcaatacatcacaaagtatcttaaatgagcacattaatcagagaaacaagtgttttaattaaaaaataaaaataaaccttgggtacacaaacagacatgaatccaagatgtatctttaccaagtggaacttagaagacacttgatctcttttatggggctggagtcaattatgctccccctccatgctcttgcaaaggtgtctgatctcagaactaaggtgctaccctcttcttgttaagcccttccctgcacattcgcaggttaattaaagagggctccatggtcctcttttccacgctaccacttaaagacccacgggttggagctttccattgaattaagaatttcttttctataaaaaggacacagatgacagacacttaaactgagctcccaatttgcatatttattaggtctaaattaatcattttatccccaaaatgcatgggtttcaatgtttgctcagtgtagtatgggcttttaattcccacactgatgatgccacagctagcagttgtgagcagtatgacaatgtgcctcaagtctctgtggcatcttacagctgtgcctcactccagacccacctgggctgtaaaagcaaaccagcttctgtgcccctcactgccctctcttagatgcagctgcgccaagcagtgtacagttttttggatctgggatcccaaatccacctggggcctcagtaggatcaaataagcagaagattaacaacacacatggaaatctggagaggaggcagaataatggcttcatttggtggacagtgcaggggactatcaggatgtatttaggttgtttgtttgtgtttacaagactccagttgacaccaggctcttggggcatgaccaataccagctcagaaaggggaaaacagaagagcccaatttcctatgcggtgagtgtagctactgactgaggtgttccatgtagagtttgtattattacttctgtggtacatggtaaagatatgtctgtgtttggaagctttcgcagttttactggaaagctcaaatttaaatgtaagtcactcatgtataccaaactctgctggctttgtcttggagatttatcagaacccactgaaatgactggttgcagaatgaaagattcttgggcagaaataatgcatgtgaaagtatcttgcacaaagcctggcacataccagacataatagacactggttaaattgaatagtcaaatctcagctgcagagcacagaagaggggtctctgataaaataaagcctaaggcgatttttaataccccttgtagggataagacaggcaaagaggtataaccttcaagagtatgatgtgatgcccaaattccctctaatttcaggctctgtcagccacctcaatgcaaatttccctgaataaattccactaggctacatagtcatttgcatggtaatattaatgagctctcgttgcctgtgccacctctctaccccaaagttttctacccctgcccaagagcaaattttattaaggaggaaaagaatacaagggtatcagcttacaaacttggtgaggtgggattggggacattaccaataaggaaaagcaaaattgaagagcagtgtatcttcacttatatgcaagactggagtgctgccagtcaggaccccacagacatgaattactcttgctgagcaagaagtctgagaaacactggaagcctcccaggtgatcgcaagccagggctaatggatttagaggctaatttctttttagcaattagcatcctttccaacttcattgacagtacctgactttcccacttagcagtatcctactcttaggatgggttgatctcagctcatcattctgagtgttttctatgccttctctgatggaacaagagagcttaaagtttggcccaaagttgcctttatccacggataaaccctcaccttgtcccaagtggaccataagaggttcattgtaagcaagatgcctacctgatggcctggaaaagagttaagatgtcaaaaagtaataataaaactaaaaaagagaagaaaagaaaagaactggcactcacaaaccctcaaaaacctcctttgatcaagatgtcttcccttgttgtgtttctgccacataacataagtccatttcattctttccttcatgttaatagcttcctgtcctcttgtctctggtgtttgcacaagactctggagggaattaagtacaagtagtatggaagagaaaaaatatggatacattatttataatttactgtcgcctgaaatttcatccaaggtctacttgtcttttagagatatgaatataaatgaggaaacaaatattccccacagagcagccaggacttggtgaaatgattgtctgagaggcagtttcattgtctcttttaatactataaaaagcaaacaaggttctcactaaagcttgtcctaagagacagtgagcactataaaataggttgtcttgaccttgaggttaagtaaagacaatcatttgcagaggtacccagagatggataataagaagttttcttttattacctttgctcctgtccctgcccttccacatccaggctgagctgttctgtggggctttttaagaaaactttggagtctactctaacacaagcttcagcttttgaggttgtgaaaattaatgaagattggcaaacaccacactctggaacaatagatggcagatcatggaaattcacatacttatcagatagatattctagttagaaaggaaagcctcatgatcactatccacggctatctatcctcagatatgccacaaatccttttcaccaaagtgcagaggtgatagggcttctctctgctccactatttagaaacagcttgagttcttgctttattataagacaaacaaacccctaaaaggagaagtctaccttctttctttgggacctggctgtggagaaggaggtagggcactaattatcccatttgaacaaaccatttccatgcatgtccaaaattaatagaaggataggtgtcagatcagaggtttcaattaatcacactgcacagtttttcacataccacccatgtcaatctccagcaaggtcccagtctgtttttactcatttatttccttttaccctcttctcttcttccaccttccataggcaggcatttgatacattaaatttgtgtccttttgtttgtatgtatttttgaaaaatgtgttcttgtaaaattactttgagtataaatattttaaatatatgtaagcggtattgggttacataattcattccctattctcatagtttttgctcagcactgtttttcagacccatccgtgttgtcatgcatctatatagtcttttgcttctaattgttgcaaaatactgcatggtgggcacccatcttattttacctctccattctcccaaaaatggacatcagattgtctccaacctcccaccaccacaaatggtgctgcagtaaatactttgtacatgtccacttatggatcactaaggtaatgccttctggaatatatgcccagaagaggaattgctgggtcataggggatgtgtttacatagtttaaccatgtactgccctcccacatggctgtactagtctacactccctccaacagtgcacagaagctcctatttcctaacgacatgcatcattccaaatgccttgacatggcctggctttgtcatttttgataatctcatagagataatttatatctcatttttctagttgaatgtctttaatcattagtttgagtttaaacatctcttcatatgttttttagtcctttgagtgttattttcctctaaatttcctgctcatatagtttgtcaattttccaccgggttcctgtactaaatattagctattattatttgagcttttgaaacctttcttaagaagtctttctttgcttttcagccaaaaggttttcttcaatatgttccgctattaactttctagatttatttctctatatttagcctattttatattggtattagttgaggatacagtttcatttttctttctatagtgaaccagttctcctaacatcatttattaaataatccatctgttctgtattggtttgtggtgcctcattgtatattaagttcccataagtacatggatctctgtttgacctctgaactccctattctactctcaggtctgtttttccatatggtattccataaataccacattgtgcttttatagctataacttaatacattaatatatggtaaaacagttttccttagttttcatttcgaggttgacttacctaattggtgacctttatttttccaaaggcatcttagtttaacaagtttagtttatcaagtttatcaagtccccccctcaaaaattttaacttgaatttagattgaaatgacaatgaatttataaattaatttggggagaactgacatctttgtaatactacagtcatcccttctgaagggctataatgcatcttcctttgttcaaatcatccttattttttaatagagttgtaagtttttcctttatattcataacaaacattctatatgttcttggctaatttctgaacatttcattttgtattgctgataatttttgtctaacttaaaaatatatattttctagttggttattaccaatgtagaaaaataccattaattttttatatcaatccagtatctagcaatcctgctgaactctcttattgattctaagtatctattgtttctgttaatatttttaggtaaatgttttatgtcatctacaaataatggcaattttatttctatacttctaattcttatacctcttatttatttttcttttcttatcacattacctaggacctcctgaactatgataaatagtgacagtaatattaggtacattgactttagttgcattcgcaaaaggaatgcaactaaagcattatcatgttgcataatctttgctaaatcttcctttttaaacttcctttagataaaaattaaaatgtaaatttaaattaaaaaaaaaactatttaggccaggcgcagtggctcacacctgtaatcccagcactttggaagcaggcggatcacttgaggtcaggtggtcgaaaacagcctgggcaacatgatgaaaccccatctctactaaaaatacataagttagctgggcatggtggtgcacacctataattccagctactcaggaggctgagacaggagaatcgcttgaccctgggaggcggaggctgctgtgagccgagatgacaccactgcactccaacctgagcaacagagcaagaccctgtctcaaaaataaataaataaataataaaacaaacaaacaaaaaagcctatttaattttttctaaaataaagaaaatatataattggctaatcttgaataaacacaaatagtgtttgtttagatttgaggtttaaaacatttatcaaggtatagaattttcttctaagttaagagtttttgtaataagctttgttgttaaactttatcaaatggtttttataatacctatttaatttattatatgacttttatcagttagtatactaatgaggtgagttatattaatagcttctttctcgatatattaattacaatccttagagaaatctctcctgaatatgatttgttaatgcactgttatatatggttagctactatccgtttagacttttcacatctacagtcataaatgaaactgacctgtatatttttttcttgtgtatacctctttattgggttttgaaatccatgttcactaatctcactctaaaaagaaacaaaaaaagctagacagcttcatctttcactcttttttcttttttgcttctttttttttttttttcttttgtggaataacttgttcaggacagaactcctcactaaaaccacctgggcacattgttattgttttgtttgtgtcttttcgtttctttgtttttggaataggaaacatttgactaccacgtctaagttttttaaaataattatccatccatgctcttgctttcttcttgtaccagttttgaccctttataaatttttggaaatatattcatttcatctgatttccagaatttagtagcataaaattcttcaaaagacttttcattgttttattatctctactgcatctgtagctattttccctttttcattttattttttttcatattctgtctttacttctcagtcttcctagtgatatatttcttttattaatattttcaaagaaccagactttagatttcagatacatagtcctgtttatttatccctcctcctttcttaaatgtgtcaatatggcatctttgtgtaacaatccaagtacttgagcaccctctcaaatccctctagactctttcctctctacccgcttcacctccccacaaacaagctctgtctaggttttggctctggattcttatggataggctttctcttttctctctgttaattatagccttttatttaagacaatataaataaagtttttccaagtagttaatcattcttacttttcacatctctagaacttgtcactcttatttgtgttctctaaattttcagtaatggattttgtaaggcaaaccttccgtaatttcatatgcccaaggaacttttgtggtttttttcatacattgaaattgtaatttaatcagatatcaaatactacctaaaaatatttgttcccatcatatttaaaaatactattccattatcttctcaaatgcagtgttgccattgagaagtcgaatgttaatccggttcctgttcttttgtaggtgatctgctttttctttctagaagctttaaaaacaatatttcttttatttttgcaactcttacacttcattatatgtcttgaagttcatttatgtttttatctccagtttcacactctatacactctttaaatctgatctgttttatctttaattctgagacatttatctttatttttatttaagcactttctcctcttttatttttcttttcaggacttttgttagctagatgttgaaatacatagtctatcctccaaataccttagctttttaaatgttttcttcctctttattcttactttttatgttctcaaagagttctttaatcagaacttccaactcacttgcttactctttagcttatttaaatcccttattcaccctatctgctgtattcttactttaaactgttaatatattaatttttatttatttgatttttaaaaaatccttttttatattgttaatttacttacctccttaaataaagttattgtgcttaatttaaattctgttctaataattctgtaccagatgatcaatctcataatggttgtggtctttctttcacagtagtcttactcttcagtgaatggatattctggcctgtgagctcgtgtccctttggggttatcggctcctctgcttggtaatgcaggtattagaaaaaggccacagacatgtgaaggattggcagtgattactccatggcaatatgaaagacaagcaaaacagactttttcaaaactttcttccaagccttcctctctctttttttggtgctgtttggttttgtggggtttttttgttgttgttttgttttgttttgtttgtttttttgacagagtctcactctgtcacctgggctggagtgcagtggcttgatctcggctcactgcaacctccgtctcccgggttcaagagattctcctgcctcagcctcccggatagctgggattacaggcacccgccactacgcccagctaactttttgtatttttagtagagacagggtttcaccatgttggcaaggctggtcttgtttgtttttggttctgtttttgtttttttatcagactaatgctggctgcaatgaatgagttgcgcaatgttccctcttgttctatttcctggaaaagagtatataaaattgatgatttttattctttaaattcttggtagaattcacagtgaagatacctaggcctggaaattctttttctagagattttaagcacaaattcaatttttaaaaatagtttcatcctattcaggttatcttttcattttatcttgcacaactttggggatgtggtgattttcaagaaattggtccatgtcatctaagttactgaattgatttccatagaattgtttgtactattcaataggacagggacatgtgatcccccacagggaggcagtgaatcttgccaagcaataatacaacctactattgaggcaggagaatagggtctggaggcagggaatctaagaccaattcgtgctgacttcccaaagctggatcaaaaggaaaatacctgggtatgaaggcaggaaccctaaggccaattagtgtcaacttcctaaagttaaaccaaaagaaaaaaccccatctccccatgcctagtaacaaaggttcaaagcctgctctccctacaactccccgccatccaccacatctcagatggaaagggaaagtgtcctggattggccaccctaagcaccggccatcccttcgtctgcattcaattcaccccagccttttgttagccacaaaccaaagccttcattcagataaggggtagccgatagagatctcaaaaggagtacttaaaacccaggaaactttgtaagcaggcccttgagccacttgcccaggtgcactctcaccttgtggagtgctttcttgctttaataaatccctgctttctctgcttcattcctgcgtttcattcctgtgttactttgtttgtgcattttgtccaattcgttgttcaaaaacgccaaaaacctggacatcttgtactcgaggcctgccttccagtaacaccatgggttgaaggtgacattgtgaatgttacagcaggaccttacatattactatatacagaacttgctctggcctattttaaattgtgttgtcccaaatgttttcagaaaatctaattttaattttccttttcataaccataggggagggataggatatagtgctcacatggcatcatacatttaacaaatactgattgagcacctactttgggtcagacactgttctaagtgctgagtgatgaataaggtaagagccagatgattatactgtcatggaacttacattcaaggggatgaggcagtgggaattgaccaaaagctaagtaaataaataaacagagtaatggaatagggacagtgtaaagagctgacttctaggacagcacctatagtaggaagtctttcttgattatcacttgccacttcctccaccgatcccagaccctggtctcaactagggtcgtcagaacaggtgtctctttacctgagacctgtgagccaagacttgaataatgagagtgaatccacaaagaagagcattccaggcctagggacgagtaattactacaccctgagggaggagtaagtttggccttttccatctgttacaagaaagctaatgaggctgaagaatagtgaaagtggggaggagtgcaggacagagacggagcgtacagggctttgtaggccatggtagggattctggattttattctaattgcaataaagaagccattgaagggttttgggcaagtaaaagataggatgaaatcagatcacattcacactataaaaaggtcactctggctaaagtgtggagaatgaatgcaggtgggaccagaatggcagcagggagaccagtaggaagtgtcatcaggacccagccctcccttgccatgttgaatcaagagccacagacaggggccaggctggcaactgccagtctgtgatcaatctaatctgccatgaaattgggtcttctgatataagtggatcaaaggaataataagagaaatgatgtcagaacattcctctagtactaggatgcctttagctgacctgtgaagggaggatttagatgtcttagatgtctgttgcacttgcccttgggcagaaggcaggtggtctgcagagcctgatgaccttcttccggaactctgttgagggtgaacacatcaaagctgtcttgttcagttaattctccactcactctattacctccttaaaggctattgtcactctcctcctgggttcccaccactacatcctgaatggagtcctgcctccaggctcacccccatctaattcattctccacattgcactgagaatggtctttctaacaagttgagcttaaagtccaccaaaagactcttcctccaattgcctccataaatgacatgatcccatccctgcttacatccccagcactctctctcctccatcccacccaattcttgctctgtctcctgctaaaccttcaacttctcaaaggggccgtacttttgcacaggtctggaacacccttctccaccaatttgtggccagcatccaggtcagttcctaaagtaactttctgattagcagttgtcaccctttgccctatcccgggcccccacttctcaccctgtccttgccagccaggcatcattgcacgcccacatccaggttttgccagcccacaatgtttatctctttcccagagcacttagagctcaaggttatatttgtttctcccaccacagcatgagcagcctgaaaggttgtgactgtgtcttttccttctttatattcccatcttttagcccagtatttagaacccaacagacactctgttatatatttgttgaattagtaagagtataaacaggtaaatatactggaagacgctgtgagaaagccaagtggctcaccccatgtgggctgagcaggtaaccttgccctgttggcagacttaggctgcccctgacagtctagccagctactctgcagatgtgcgccattgattctaacaagggagagtcaaccacaaacaagcttctgggaaaaagcaaatctaagtgttgataaccagaggtggccgcctgcacttctatggcgcaacactgtgttctgcgcttacagagaaacctgctgaggctgttttcagagacaaatgctgacattgtggcttcagtcctgatgctgaggccagaaaagtggacagacacttgccagggccattaaagctgatcattttaaaggaacacccaagaatccaaaacaagtaaagagcagggccaggacagagaaagtctgtcccagcagtggtggtcccctgactgcactgcgtgtcatgtagcttgctccactccactcagcattcagcctccacttcccaaaacaaaccaatttcagagcaattcttctggtgaacgccatggtcccgttgatctcacaattacatctagaaacacttaactatgagacatttcagtgtaccaagcacttgttgtggcttttctcttaacttagtaatcaccacagcctgtgctaaaaaaaataaaaattaaaagattctccatcggtctaggctccagttattgcaccaaaaggaagaaaaaccttccagttttgctcttggtcttaagattttgctttgggaaaaattactgagctgatatatgttggggtcagaggcgagtttctgataatattaaatggtgtgacatccagagagctaggagggcctgaaatttgccctgacagtctcctaaaatgtataaagccccagtacgttcacattgaatacagcagaacaggaaccagtgtgttctttattattagctaagcaaagtccaataacccccaaagcagaacaaaacaataaatactaggacacaaagcttagactccaggctaaatgcaatctcttatcccctctccttcctatcgcactcaatccaattcttggaaccagcccactcaagacatacctactgggaaagggaaagagggggagagggaaagaggaggaaagggggcaagtgggagagagagacagacattcaatctacagtattcatccacacagccacaaggatctgggcagagaacacagaccacagggctcctctgaggcattgcttagtttaccaattccacttcttggcctctagagaagaggaaaatgtgccagacaaagagaaggttcaaatctagctggtcttcagacttgtctgagaagcttcagtaaaacactgattccctgcgccatcccctgatattctgattcagtgaatctgctatggaaaccaggaatctgaattttaataaggtcccagtctgagaaccattagtgagcctctgccttctcttgtctgcaaaaaaaggaataatattttggacaaggactagagttgcaggctgaagcaggttgaaaaggaatggttttgctgtaaatgtgaggtcttctccaagttccgaagatgtgaaaatcccaggttgctgctcttgatagtctgtgtgagcaaaatgcttgttgtctttacattaatgccacagactaaatcacagcaaatggaatctataaacaaccaaatggccttgcaatttgtcaaagggaaggcaagcgcacccagcaacgatgcatcattgcctcatgcacatctggggagtacccgccccccgccaccccaccaaccagctcattgccggcctggaaggaagaaagcatggtccttcctctcccagggtgtaatctgggacgtttatcccatccagtgtttggcaccccttagaaaacacttttttcttaagataattttattcttatttttctaactttaaaaaatgaatcactattttatatgatagccattcaggtattcaaaactccccttgtctaagtcatctcagtttactgtatttgtctgtaggtctagctttaaagcaactaatatgtttgagcctttaaaaagtatctgtaatataaatattaaatcaatctacattatcaatatgaagaagcctgcatgagatcgtttgtttccccattctgatgtttagatttatatgtgtatttgtatgagactgtcattttgagatttgtggggagatgttttgttggggatacattggatattggaaagaaatttggggttctggctccttcaagaagctgagtttattgcatgaagaaacctttcttcaggaaaaggggctattagtgcataccttaggagtaagctaaagaccaagggcactaattgctgatcttctaaaatgagaaactcaaacagtgagatgaaaggggagaaagaaaggcagacaggctggttgttccagaggccaggtcaagaatgaggagataatagcagtgctcccaaatcagcagggaaggagacagagacagctcacacctgtctcctgaaatgtaactgtagcctctaggggtaggtgggatcaggaactatgaagagttctaggacactctgcagatgacagttagcttttctgcagctattaaggaaatcagtttgagagggtatggatatttgatttgaacatagaaatttttgagatctttaatctttggggtttttttgcttgtaagataaatgcaggtattaattaatcctttgctgtatgcatagatttctatcttcagtaaattcaatcatgcattatatttcctgctttagtagagtgcaaacagcacttaagccatctgaaaatatgagttccagcaatctgagtcatgtaatctttctgagtgcagtttccttctctgtaaaataagtatatctataccaatctgctgtcctctcaagtttcttgcaagaattaaatggaaataaaaacacttggtaaaggataggttctatagaaatttattgtcattccctggtataaccatgcctgcagtaggcaatgcctttgttctaaactacgttaggccagtgcgccctcgacgggtgtgtggcagcaagttgaagggcagtcctggtgcgggggcagttaacacatctccaggggggccttccataaaccgactctaaccacctcttcctgacacaggaggcttcactggtgatctatgatggggtcttaggtgctcagggttttcggtgaggttgctatgttgccatccttgggtaggtgctgtcacttactctgacccaccagcgggccctgtgtcacacctgtagtgcaccggttctgccactagggtatactgcagtaactgacacgtgcggtccctccccagcctctcttcctgactgcaacagttcaaggatgcagaactagatcaatcgcagcatgctcttcatcaacccagaagatcatactatttacagagcacccaaaccaccctttcccacacagcaagctctgcctttagcttgctctagcagctcctgcagttcagaaaagctcctccggtgggctttctgcttcttggcttgcctgctcagcattaaaatttgccctgaagctaagctcttcaagacacaggatttaagctcctctttcagctaattagatattgttctacaaattgggctgttgtctctgaaagatgagctgcaatttacttcccctgccctctccttaaacttaaactgaactgtaaaacatggctacttgattgtttagtccaatcaggatgtattttgtacaaggaatagataattcatcttcttgctaatgccgagcttgtttgggcattccttaatggctactgtaaagatgacagaaagctttgctcagatgcctctcattcttttgaaaggtggagtctgcagtgatttattttggcccatgcatctgtaatcattgcctgagtaaccaatcactacctgcattaacacatctttgcccttcaagggggagacttttattatccccattttactgataagaaaactgacgcccaactgatttacttaaagtcaaataaataggtaactggtggagctagaccatgaacacagacctttagttctcagatcccatgaaattgtatgttgtctgataagtctaacaacagttgtggaagggaaatccaagatgatgccaagtccccacacccacaccttgagctccgttgaggatttcttacagctgttgatgatgtaccaggaggcctgctaagaccttctatgatccaaggagctcttgtgcactgtgagagaaagaatcctttctggacattgtctattttccttgcaggaggccgggtgttccctcatccccaagactgtgcccagcatttgatgaatggagacactttgagtggggtttaccccatcttcctcaatggggagctgagccagaaattacaagtgtactgtgatatgaccaccgacgggggcggctggattgtaagtacaatctgtgctctccttgcacagaagcgtcctcagtgttctagtctacctagctcagcacctgccaagccaacttcaccatcctcctggccatccttttatcaccccccacatgtccatcttggggctcctcattgccctcaaggcccatgttcagagtccaatcatatatctggccaggcagggaaaggaataactatatctgtcctcacagaaggaggaggaaaggacagttaagcaggagagtgctggggaaaggcagtcgcgggtctgttgggcccaaggatcttgcctgctgagaaatgcatctctaataaagcagtggaggtgctgggcagagtggctgattcctgtaatcccagcactttgggaggccaaggcgggtgatgacttgaggccaggagttcgagaccagcctggccaacatggagaaatcctgtatctctactaaaaatacaaaaattagccggtcatggtggcacatgcctgtagtcccagctactctggaggctgaggcaggggaatcacttgaacctgggaggcggacgttgtagtgagacgagaccatgccactgcattgtagcctgggtgacagagtgagtaagactcaaaaaacaaaacaaacaagcaaacaaacaggcagttgaggaaaactatttctctatgaggaggtgatcaccaccacagagagatgatcagaagcctccaattgaggattgcagttgggaaagcagatgaggccccaaacatggatagctggctccccttccccattcttcctggggtctccctggttcttccccagagctgacacagccttcagggagcaccagtggtcaggaaaagagagacactgtttcctgtcaccaccctcctcccatgcctgatagggcaatacagagtgagggaaaataagggcagcctccttaatgcaagccggtcggagcagccgggagttcccaccacttggccctaaagcagcccaacattagctggatcgctttaggatggaaaaccagcccctccgcccttctttggatgccctctctcgctctgctaacagtgctggatgtttcctggtgcaaaatgggtaggttttgaatggtgatgtgctcataacagctactcttgggagacattttcttttatgtttctgacatatgtgtgcctccttcttaaagcataactggaaattgaagccaaggctgatatattggaggctaaataaaataagcacttaaacagctcagaaagtgaatgatatgcaatattgctttgcctgcaataggacgatgacagttactagctgatttgaagttggtcctgttcttttggtgagaaatgctttctactgcactctgtagtgcaaaagattcgtttgagagccaagcctatttcccctgatgtttagggcttgatatgtatcctgagtcctttctacattgcaggggtgcaaattagtgtcaacatcacactggagcctattcatcaggggcctctacacttcaagagaaatgctctgagtgtctcctacaaaaactgctgtgtaaatactgagctctgctctgaaatgttccttctttggacatctttgtcattgcagatataaaacccagttatatcaattttacttatcacagtttattttccttagcatctctttgggttttgtttttttgtttgtttgttttttgtttttttatttccttcataggtattccagaggcggcagaatggccaaactgattttttccggaaatgggctgattaccgtgttggcttcgggaacgtggaggatgagttctggctgggtaaagcctccttattgctttccattgatgtgcttctctggctttttgtccatctctctcctttttgtgtccatctgagattatcagaaaccctgtgtttgttgagaagctaacagctcctgaattgctttcagaacctcttgctctgtttagcttcactattgatctgtttttatcttactgtggtgtttccctcttttctctgtctcttcccatcctcattaatagtctcttattctgatgggttttgacatgaggctgccacaaagggagtgagctgcctggtcggtgaggggcacagggagcaacaggctgcctggccatctcccagaagcaaggcaaccagccagccagcctgcaggtcaggggagaaatgaggacagccactccgcttagttccttggagaatgttattacctgacctgggaaagaaaagggaaaaaatgaaagtggcattagaggtgactggcaatttcctagaagtctgacaccggcaggaaatatagatcgagaaccaaactggcgtgagatggtaaacacacatccaagccaggcagatggtggtggtgccaagttctggaaagtggtccatttattatgacctgtgtccccctcttagttagattttcatagtgatggataaagggaggtagaggaaaagattatcaagttccatatttgtggtctcctctctgtcttccctgccactatctcatctcatcttcttctcctgggtgcctagataacaagcttcttaccggcctctctgcctctaggaccaccccattgtccacatggctataatcacccaacaggttcttcttgtcttttgcacagataaacccaattctctgagacagcattattgcaataaagaaagagtttaattaacacaaggccaccaagtggaaggactggagttattactcaaatcaatctctccaaaaactcagaagctagggtttttatggataatttggtgggcagggggctagggaatgggtgctgccaattggttggggataaaatcataggagtgtggaaaatggtcctcgtgccctgagtctgcatctgggtgggggctgcaggcccagttgagtcatgtgtcactggtccaggtggggtcacttcgttgcctgaatgcaaaagtctgaaaaacatctcaaaagaccaatctgcaatagtgctgttatctataggagcaactaggaaagtcacaaatctctggccacatgaccctgagcagtaaggaattatagaaactatgcctacattttagcagaactcaaatccctccgtaatcctaatctcttggcctttcgttagtcttgcaaaggtagtttcagtccctgaaaaaggaggggagcagtttcagggaggactattatcatccttgctttaaaattaaactataaactaaattcctcccatggttagcttggcctatgcccagaaatgagtgaggagggcagccagccagtgaggccagaagcaaggaatcagccatgttagatttctctcactgtcatgatctttgcaaaggttggttcatgaccactataatgatcttcctcataccccaaatatgggcgatggctaatcccctttgtaaaacttttcaatgactccacattaccaccaggagaaggcccaatgccttagccaaagtacaggccctctctcaccagcctctgaagactcctctacaccctaagtacctcacctgctcttcccccgactcctctccaacaccaaactccacacatgcaaaacccccgatgcttcctctgccaggagcactcctagccaactgtcctcctttccccacattccttgtgtggtgagtgccatctgtgtatattcagagacacagctaagcaccttctcctccacagagccagtcctcaccagttttctcccctattgcctgtgggagaagtggccactccttcttttgtggcacagatcatagtgtccattttacttcctgtctgtctctgctatgtgagcttcattgagggctgggaccacctcatatttatcttctaaccccattacctatgtacctatgacagtgcctgagagatagtaggtacctaaaatgtagataatcaataaatcaatcaatgataagaattaatggaatgcatattaaatccacagatttgtgtttgctgatatagacaataaaaatgtaaggtaaatgccatacaaaaacattgacataaaagtcaaacaaattgaaaaatattcttaccttgaaagcatcagcaagcaacttgggagacaagtgtaatacccatgaatcgatacatccataagcagacaggactcacgtttcccaaagctgagctgctgtataccattttcacaatttgtgtcatattttctgaaatacataaactatcatgcacttaaaatttctataattactctttaattaaatctatttttaaaagaaatgttatagcattgccaaaaatagaaagctagttatcatgtgccataaataaaaaagaaaacctcaaaaataaatgcaattaaaagaaactatattaatagtactaaatgagagttaaatacagggactccaagcctgttgttgctggcagtggtggtggtattaaaaatggagattaggaagtgtttcatgcttttcatgctaaacaaaccactaaaacactagaacaaaactgagactgtgagtgaaggttaggatcagggttaaggtatctccttcttctattacaaaagactgagattaaatttggaaatacctttcttcctattattcaaggttatttagtgccttatatatctcatgtcatcagagatgccatccacactgggtaacactgttctaacctaagagtcactgaaaagaaggccacagatattcaaagaaggaagagaccagcttcctggagaaggcattgagggatgagtcagtcagaagaatggaggaaggaaagggatgaaaaggagggaaggcaggaattctcctgacaactgcaaacttaggccagggaggaaacccaatcccagtgagggaaagaaaacaatgaggtgagtgggttgaatagaggcacagtagggaacttaaaaatcagaaagagaagtctttacttgatgatgtaggtaagagggagacagggagggctcttgaagatgctaggcctggtgtggtgtagtttggaagcaatactcaagttggggataacactgtgacccatagtttatgtactatatggggttctctagaagcagagatcaaaacagggattcttgttcaagtgacttactgggggacttcactggggagaagggaatgggggaacaaaaatagggcagagaaaactgcaaaaatgtggttttggctggagactcacttcagtgtgatccctaaggaagcttgggagcatgaattgctcctcagagctggtcaccacttaggcaaggaggccaagcttttgaacccctccacatcagtcactgatggaggtctgctccaaggcatggtgggagagagcttagcttccaggatgaagtgactcccatttgctcaagggcaattttccaagaagaaggcagctgcaagttgctaacagccaacacttgtagcagcctgggggatggatctatctgccaattaaagacatcccagcagaacaacatcagcatctactacatctgcacaagcacaagtctagggtgagttgtgggtcagcaactcagtcaacagcaaacagcagtcaaacagcctttgacttataatcaaggtaaagctctaagtctcaaatgggacaggaaagccaaaagatctggatgaccttcagccaatcatttcacctctcttggactttagcttcctcttccgcaaaacagacactggcctgagtaaccactaaattcccttcagtctctgcaattgtttgattctaaatcacggcatactcaagtagagatcagatgtcacagcaaagcaaggggactctagttcagtaagcagataaaaattaggactcagagaaattaccagcaacacaagatgaatggttcaaagtttgggcaggtagatcaaaattggagagtcccagggcatggctaatcatgacaagcaggcaagaaaatgtatataagaaaatatcggccaggcacagtggctcacgcctgtaatcccagcactttgagaggctgaggcgggcagatcacgaggtcaggagatcaagaccatcctggctaacacggtgaaaccccatctttactaaaaatacaaaaaatgagctgggcatggtggcgtgtgcctgtagtcccaactacttgggaggttgaggcaggagaatggtgtgaacctgggaggtggagcttgcagtgagccgagattgtgccactccactccagcctgggcaacagagagagattccgtcgaaggaaagaaagaaaggaaggaagggagggagggagggagggaaaggaggggaggcaggaaagaaggaaggaaggaaggaaggaaggaaggaaggaaggaaggaaggaaggaaggaaggaaagaaaaagaaagaaaggaagaaagaaagaaaagaaagaaagaaagaaaagaaagagagagagaaagaaagaaagaaagaaagaaggaaagaaagaaagaaagaaagaaagaaagaaagaaagaaagaaagaaagaaagaaagaaagaaagaaagaaagaaagaatcaccaagagggatctggactctgcctaacctggggacttacaaaggtttgcaccttaaaagaatatattagaccaaggcctgggaagtttagaggcaaaggaagaagcagatgaatgagggtaactggctgaaaaggccagtggaaaggtagcagtgcaaatgtagcaggcagattagagagaaagggactggagtcaggaggcagagaataatattctatgacctggctatggagccccaggaagcctaggctgaaggcaggagaggcagtgtaaggaaagttcgacagagcccttcctacatgctactaggagatgttaagatgttccagatgctctgaactcctctaatcaatgttttcacctcttgctttcgatcactcatgcccaagggctcacatccatgtaatacctcttgtaattttcttctagtaccatggtttggcagaggaggtgagaggggacagggccaggaatcctgaggctcagggcttgtcagttactgggtcaagaggaggtattagaacccctgagtttcctgtgttggaaacccatcagcagacctggactgtcctctttgcaggaagaaattcagtctggcagggtccatttgataacaacctgtgaagcaccaagagcaaaagcaatctggagtcccctcctcttccctgtaacatgttttgaagccacagacgcatttccctcccattttccaaagctgctgggggccagtctcagtgcattttctgctcttctccacagggctggacaatatacacaggatcacatcccagggccgctatgagctgcgcgtggacatgcgggatggccaggaggccgccttcgcctcctacgacaggttctctgtcgaggacagcagaaacctgtacaaactccgcataggaagctacaacggcactgcgggtacctatggctcctgagcagaccccaaggacagtgggcatgggacaagagcccccagattctaggcgtaagctgcctcaggaagcagcagcacccacagagttccagcattcgctgctggccagggagaagaagggccatgccactgggaaccactggcactggtcccagctctccctgaccagtcacctaaaagcaactttgcaggacttcagtttcatcatctggaaaatcataataaggatgcctgccctacttcactgagtagtcagaaaaaaatcagtggagtgattgtacttttaaggtttaaaaaagatgcaatgtgaagatgaagaaggattgttttctttgtctagattagtcactatgggctcttatgcagtgagagcagaatcatctactgtctgggtagaaatctcccatgcaatgacatccaggaaaaccatctttgaattagtgcaaatcatacagatgtcacccctctctgagatgcccctaacaccccaccctgtccatcagcagtcatgctaacacctagtcaaggagcaaacaatgccacttacctgttcctcatttgccatgtttcttttcattcctccgcaagaaccacatagacagtcaggttttctgtgtagatttttacagcatttctaccaagcagaacaaccatcccatcaagcttggttgcattagtagttttttcagaacataacacccagtctgcttcttgggctttgccaatctgtttcccatgttctattataacacatttcacaaaacctgctttttcaaatattctaatgtttgatacttggcattattggccctttcattaacaccaattctagggttaaatgctggtgtataattttaacaacatttttatgactcttgaaattaagaagagcattaaggtgttgtccttccagttactgcatctgttcaattatttctcttcttagccagatactccaaagagaagacatgctttcctttattatgctcacatctgagatcatttccaacagcaatgagatcagcctgaagtgcccccaacaaaaggcccaatttgccacactttgggcataaaatagccattgaaatggagcatattaaacaagatgccggactaaatcatttaaaaaatcacctgacgctattcacttctaagattagaattgtgcctgtagaaaagccattctgatttctcctacaggaaaagaagccagccctccaacttccctacagcaccccctccctccctcctcttcatccgcctgtgctttcatctgccttgcttgggcctggcccttgctccctctgttccagctctgtcttgcttctgggcctatggaggccagaacagttggactgtgcgctattctcatgtctcagaggcagatcctgccaacagtttggctgttcatcatcagctaattagggtcttatctctcacctcgaatattcagttcatcttcttcaaaagatgaaaagctaggcttccgttaggctgccatcccctctaggcaacaccacacaatggttgttctttctagatcagaaggtttctggagaggaagagcccatcccctctcttctggcatttaatattgcccagttctcctggaccttatctttagtagtggccttctgaatcaacccatctccagggcctccgatccaagttcagccttttctcctgctccccatttcccaaggctgcaaacattcaaatctctaggatgctacttggatcagaactgaaaattacaaattaagttatcaatcagaggttgttgagcagctcctaaaagtttattgtgcaagttgtggggactcaaaagaagcataaaacatggcctttacaaaaactaaacgtctagttttaaaaagaaacaggaagtaactcatcacacaatcaatggtactcacttctagttttttctgtttttgtttttgtgtttttgagatagagtctcactctttcacccaggctggtgtgcagtggcgtgatcttggctcactgcaaccactgcctcctgggttcaagtgattctactgcctcagcctcctgagtagctgggattacagacacatgccaccatgcccagctaatttttgtatttttagtagagatggggttttgccatgctggccaggctggtctcgagctcctgtcctgtggtgatccacctgcctcggcctgccaaagtgctgggattacaggtgtgagccactgcatctggcatctcatttctagtttaaggggtgttcgtggaagaggagtctgggtggtggaggacggcatcataaaggcagctgcattcgactgggattcccatggtaaggaaaataaaccctggaagttacagaaggagcagatgctgtggaggaggggaggctgtgaagggactggcagagcagggcaaaatgtaaattcaggaggaatagagaagattggtgaggcaggtagagccagatccagaagctggaaaaccaaggggcagaggaattcagtcttaacatggtagcactggagggccattgtaggtcccaagaagaaaaatagaagtggggtttaggaagattcctgtgacagccacaaacaggataaagtaagtccgagcgaagaacatagagcggctgatggctgctgcatcagacctaataggagacaataggagtcttgactaatgttggaaattaagaaaaaggtattataaatctgaacagtggtttgagagacagaaaccaggacttagtgtgttaaacacatgaggtggctatatgaggcagaaatgggaaggggagccaggctttgggaggatgtaaagaccaacactgggagcaatctgcgacagtggaaggcagcctcagagtggaagctggagagaactgctccaggggaataatgaagacaaattctagatgacagagggagacgcagggagtgagaagataggatgtgggtggagaccgcataatcaaggaactgatagtgaaagaaataatcattaaggagtaggattaatctaagaatttttaagacaaaggatataaatgtaacttaaggtgagaggaggtgaaaacttaaaaaaaaaaaatagaagtaaaagggctgggctcacacctgtaatcccagcactttgggaggccgaggcgggcagatcatgaggtcaggagatcgagaccatcctggctaacacagtgaaacctcgtctctactgaaaatacaaaaattagctaggtgtggtggtgcatgcctgtaatcccagctacttgggaggctgaggcaggagaatcgcttgaacctgggaggcagagattgcagtgaaccaagattgtgccattgcactccagcctgggcaacagagcgagactgtctcacaccaaaaaaataaataaataaaagaaaaaggaaaaagtaagcaatatgttttaacttttccaggatctggaagagatgggaaagagtgagttgcagatggtggggttaactctagatgggcataaaaatctgagtccctggagactggaaggggaagacgaagaagacggaatgaagatcatgtcatgttgagttagggcctccccagtgagggcgtcagccttccctataaaataaaggtcaacctcctgagagttaagttgtggtgggaggcatcagaggcattgagtggccctgtgagcctggactcagaagccacagaatcagaataggtctttcctcgcttaacacaagctcaaaagcacccaagacctctttcattcaataagtagcatgagcccccttcacaacatcctgagccacaaatcctgatcctgctataagttttataaactgttataatttaattacagtctgatccctcaccttaaatacacaatttacctgagccccctgcacaatatccccaaaagagaacacgcagcctgtttgcccctcagaataaaaatctcaccacctctttaagcagtctattccacttgtgaacacctctaatatttaggtaatttatccttgtatatttagcctaaatatgcctctctttttttattacactctaagttctagggtacatgtgcacaatgtgcaggtttgttacatatgtatacatgtgccatgttggtgtgctgcacccattaacttgtcatttacattaggtatatctcctaatgctatccctcccccctacccccaccccacaacaggccctggtgtgtgatgttccccaccctgtgtccaagtgttctcattgtttaattcccacctatgagtgagaacatgctgtgtttggttttctgtccttgagatagtttgctgagaatgatggtttccagcttcatccatgtccctgcaaaggacatgaactcattcttttttatggctgcatagtattccatggtatagatgtgccacattttctttatccagtctattattgatggacatttgggttggttccaagtctttgctattgtgaatagtgctgcaataaacatatgtgtgcatgtgtctctatagcggaatgactgataatcctttgagtatatacccagtaatgggatggctgggtcaaatggtatttctagttctagatccttgaggaatcgccacactgtcttccacaatggttgaaatagtttttagtcccaccaacagtataaaagtgtttctatttctccacatcctctccagcacctgctgtttcctgactttttaatgatcgccattctaactggtgtgagatggtatctcattgtggttttgatttgcatttctctgacggccagtgatgatgagcattttttatgtgtctgttggctgcataaatgtcttcatctccacctactaatcctcatacttccccacagaatttatttaatttttttctcaatagcccatcaaatatttggtgacagtgatcacaggccatgtctccctcttgaagtccgctcttccccaagatacagcccagatgtcccaagcacttctcctttgacatggttatgtttttttcatcatcctgtttcttacggatgggaattctaatttgctgatgcccctcttcccatgtggcctcaagttcagaatgcagtttcttgggtgtcatctgagcaggcctggtaagccagggagaagccaggctgaggctgcatggtggtgccctagaatggcccaagtctgcctggctcatcaccatctcctctgaagacaggaggaaccatgagtggcctgtgtccacgtacaggctgggaggaaacagctgagggttgggggtggggtgggcaatgagatggggttaagtggagaaaattctcagcaaaggtggtcaaagggattaggaagtgggttggagagagtagcatggaagtggttggccccaggggtaaggtggagtaagagttcagcacagccactctgagaaactgggtggaaatgaaaaggttccataagtggaagccaggtttgctggaagtgggtcaagtgtccagaaaatcctgataaagcagtgacaaatgggacagcctaatgaatgtatcttttttgcaggggactccctcagctatcatcaaggacgccctttctccacagaggatagagacaatgatgttgcagtgactaactgtgccatgtcgtacaagggagcatggtggtataagaactgccaccggaccaacctcaatgggaagtacggggagtccaggcacagtcaggtaagcgatgctccacctctgctatgaatgagccagagctgtggaatccgtgctcccttagctttatgttttaaaagcacatgtgagtccttcatttccctttaaaaagaaatattttgagtcttgagaaaaataatgcagacaatgggataagatcaggacagagtagaagccagaggaaggaaaggaaaggacccaggagccagaacttacccagagaagcccttggatccagaagatcccatgaagagagcttatcagtcctggggacagcttcacagactcaactttaccctaaaaatggtcccaggaaggtagacatcgaaaataccagtgtgaactggacaatctttccctatcagagaccacaagtttataggctaagctgggtgacagggagaccaccatgaccaactagactttctaagtgttaacactgaaacagcccacatcagggaagcccttcagttctaggcaaaccaaaagggtttgtcaccctaggtagaaaccgcctaagtctcccattaggagtgagcagtcaaacacagttattctcttccaaatgcttccaccctgttgggatttcacaaccatctactggtgcatgccactcctggaagccaaaaacaaagctggcaataaggaatgacctgcaacatgttccctggaaagacccaggccaccggcacatttaaggagaaagctagaaagagactctgcccctttcactttattgggaactcggccttgaagcttcatgttagctgaaaatagctaaccccacattgtggattccctgttcccataattaccccttttttgaagtggggcgttccatggtgggggatgacctgacatgcttatctttctcacgcccagggcatcaactggtaccattggaaaggccatgagttctccatcccctttgtggaaatgaagatgcgcccctacaaccaccgtctcatggcagggagaaaacggcagtccttacagttctgagcagtgggcggctgcaagccaaccaatattttctgtcatttgtttgtattttataatatgaaacaaggggggagggtaatagcaatgtgttttgcaacatattaagagtatgtgaaggaagcagggatgtcgcaggaatccgctggctaacatctgctcttggtttctgctgccctggagcctgaccctcagtctccattctccctcctacccaggcctcctcaaccttcacctcctttcccaccaaggaggagaagtaggaagttttcttaaagggccaattcaaagccaagtcgtggggtgcagattgttatggtgacaggcacacacatttttctacccttcttctgagatgtcctctgccttccaggtatttgtgattttgtcacagcctgacatggccaggttctcacactggcccagagaaaagagcctcagcaagagagttttgccaacaattccccttaaaaggaaacagatcaactacaccgcatcccaacaacccaggttcttttccttccttccttccttcctcccttccttctttcctgccttccctccttccctcctttctttcttgacagtatctcactcttgctcagtctggagtgcagtggtgcaatctcagctcactacagcctcgacttcctgagcttaagtgatcctctcgtctcagcctcttgagtagctgggactacaggcatgagccaccatacctggctgatttttcttttattttttgtagagatgggggtctcactgtgttgtccaggctggtcacaaactcctggccttgaacaatcctcccacctcagcctcccaaaatgctgggattacaggctacagccactgcatccagccccaagtcctttataatgggccaaagattctcatcttctgacactcttattataccagccacatgtcctgttacctttcaagaacagtggctcttttctggccctgatggagtcttttgcctaatcccatcctgtcttagaccccagagcctcaaaagcccaaccagcattttggaatctagttcccaaggcattgcctgctcctggccctgggtggcacagtggctatgtgcctgtgagtcatcagccactgcccccaccctcaggtcagacagacagtcactttctgcaaaggtaggagggggagatggttgtagtttttagcacttttgggtcaagcattgaggaaaggactgaagaagtcaaaatcagggcactgccatagagattatagtttccatgggaaacacagatcttccctagccctgttttctccatttctggtcctatttgtcacagattctttttttctgaattgcaaaccgaaggcctcatatctatcttcacccaagccctccttagtgtaggtggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagccaaaggaaattacatccagaaatccaaaggtgaataggtgataactgtgggcctacttcccattttatgagatgcactgtcttcactagcacaatttgatcttaagcccaagagagctagatgctctagaagccgtgacctttcaatttctcctccaaatccaatatcagcaaccatccccgcaacatctgcccaaatccatgcccagttccctgagctgtcttctccctttcctctcccattcctcaaggcccagcaccattttctgtagtgcctatgtttgtctgaccagagcagtgtgtacctttgccaaccagttactggatgagccttagtgtcggcaattttctaatggaaatatcctcactcttaccaagctttgagaaccaagatgaaaagtcccttgggctgaccatcaggcctcggacctcatggggatgcagccagccaccattgaatggaggcgcttcccttgccgcaggcttctaggctttgttcactgcggcagtgtggatgtgacaggcataaccctgaaaaacctaggcaccacttgcatttctcagttaaccatgggcttcaacaaactgggaggaggaaaaaacagaaacagatcctttcaacaagcatgtaaattacagaagacttacctagagacggggcaacaatgaatagtaggaagcacattgcatgggaaacttgagggccgaggtacaggccaacagctgtcatcttagctacgacatgacatcggctgggttgtttcacctctctgggccagtttcttcatctgtcagatgagagattagactagaatgagttctaatttccctttcagttttgacggtcaatgatgctaatctgtgatctgaaaacctaagtagaaattggcatggtgggacagcacaattaggtaatgaaaattcactagactccctgtttaatgaggaaagaaggaaagaaggaaggaagg

SEQ ID NO: 640 - DNA, 40653 bp, Human
ctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaacatcttgcttattcttagcaggtttgggactccccaggaaaggggtggggaagatgtgggacccaacccgatatatgcaaaatcaggaacatctacctctcttgtttaagcaaagggaggccaggcatggtggctcacatctataatcctggcactttgggaggccagtttgcttgtgctcagaagtttcagactagcctgggcaacataacaaaaccccatctctacaaaaaaatacaaaaattaagcaggcatggtggtgcatgcctgtggtcccagcttcttgggaggctgaggtgggaggatcgcttgagcctaggaggccaaggctacagtgagccatgatcacaccactgcactccagcctgagtgacagagtgagatcctgtctcaaaaacaaaacaaaacaaaaaaggtgttgcaggggaggaatgtgttggcttttactctgccttcaggcatggctggatccggggcttcaaacactaattcagaatatctttttttcttttttcttttcttttttaaagtctcactctgtcatccaggctggagtgtagtggtatgatctcagctcactgcaacctccacctcccgggttcaagcaatcgcaatcctcctgcatcagcctcccgagtagctgggattacaggtgtgcaccaccatgcccagctaatttttttatttttagtagagacagagtttcaccatattggccaggctggtctcgaactcctgacctcaggtgatctgcccacctcagcctcccaaagtgctgggattacaggcgagagccactgtgtccggcccagaatatctttttatctcctaacttcacttacctctggaatacatcttcaatcaggttttctctctgtggcaaggtgactctaagcagctgcttagcaactctttcttccctagcaacagcaaaaatcacaagactgattttcattggcttgaattaagtcaggtggccattcctgaaccaattactgtggccagtgtgatgaaggccttccattattgcagcctggatcatgtgtcctgctgtatttttagtagaggcagggtttcaccatgttggccaggctggtctcaaactcctgacctcagatgatccacctaactcggcctcccagagtgctgggattacaggcgtgagccacctttcctggctggccttgggattttttttccccaaataatgcccgttcctacggcacttccttgaggagattttctgcatcttttttccttgtgccaataaaaaagggacagaaagtggggacagactaggagtagagaatactagaacatgctaattctagaattccatagtttctggaatgccagagcttctgaaacatagtagagaggggtctcgaacattaggacatctcggacacaaggatattctggagtgctcatggattaacaatattagagttctcccctgcttatcagagaatccagaatatagaagtttctgacaaaaaggacctgaaaaatcactgattctagaataggggagtgtcaaggggagttcatacccatgaatctccaccggtaggaatatcttgcatgccaggatgtctggaatgctgagaattataggatacagaaaggaacctggattactaggaaatctagagaatgggagagatcctggactatccgcccttccagagcactggaaggtttgtttgcgttccaagaaatccataatggcaggagattccggattatcagagaatctggaacacaaatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccaggggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtccgggcttagaaatgctcttagaaatcaagtcttttgtttttgtttttgttttttaatcacttttaaaaggctttaaaataacgtattttttcaataaaatcttacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctataccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggcgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacgctgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcagggcctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgcgtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctgggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccagggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgatggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatcttttgcctcctcctgtctatttctccaagtctaccccagtttgtgctttgagtcactaaatgacattcccttcccttctgacccctagtttcgtctgtctctctgcctctcttggtctctgtcttccttctctctctgtctctgtcgttctatctcatctctgtctctttctgatttgttttctctgcctaacctctacatcctgtcttttcatttctgtttctgcatgcgtctttctcttttcccttctctttgtttggttctttcatctcgagagcaatcttgcctctggattttttttttttttttttttttttttttgagatggagtctcactctgtcacccaggctggagtgcactggcgccatctccatccactgcaacctctgcctcccggtttcaagcgattctcctgccttagcctcccaaggagccgggattacaggtgcacactacaacccaggctaatttttgtatttttagtagagacggagtttcgccatgttggccaggctggtctcaaactcctggcttcaggtgatccacccaccttggcctcccaaagtgctgggattacaggtgtgagccaccgcacccagcttttattttttagagatgaggtctccctatgttgcccagtctggtctcaaattcctgggctcaagtgatcctcccacctcggcctcccaaagtgctgagattatagatgtgagccaccgtgcttggcctagaagtcttaagctgtcctggaacaagtggggcaagagcagggagcaggagtccctggagggccaaacccagacctgacgctccagctaggagttggctgtggatggagtatggagcggcagtcctgacagctggaggcgggaatgagctctgtgtgtgatggtggagtgcccagcacggacctcctccatgtgccctgcctgcttactggccatgttcctagtccagactcctcctccctaaaaaacaagaacggcctagatcagcataaacttagggcaggagtaggggtcggggatcgtgggtgatcaacttggcactgggccaagctgggaaaaaaaaaaaaaatgtacctcagccaggcgcgatggctcacacatgtaatcccagcgctttgggaggcccaggcaggcggatcacgaggtcaagagatcaagaccatcctggccaacatggtgaaacctggtctcaactaaaaatataaaaattagcccgccatggtggcatgcaactgtaatcccagctatttaggaggcggagataggagaatcacttaaacccaggaggcagaggttgcagtgagccgagatgacgccactgcactccagtctggcgacagagccagactgcatctcaaaaacaaaaacccacaaaactgtacctgtcattcttcacccacctgtcaattcttgtgtccccagggtttcaaactcatatgctgcaaagaccagaaccggaatgttagcaggaagcagggaaaattgaggcacacattaccttctgcctaaggcttggttagactaggaaggggaattttccccattgttaatacttttttttggcctggcggggtggctcacgattgtaatcccagcacttcgggaggccaaggcaggatgatcacttgagctcgggagtttgagaccagcctggcaacatagtgagaccccatctctacaaaaaagtagctgggtgcgatggtacatgcctgtagtcccaactacttgggaggctgaggtgggatgattgcttgagcccaggaggtcgagactgcagtgagctgtgatcgtgcctctgcattccagcctgggtgacaaaggcataccttgtctccaaaaaagttttttttaatgtatatttttaataactatctgatattgtttggctgtgtccccacccaaatctcatctcaaattgtaatcagaattgtaatccggggaaggacctggtgggaggtgattggatcatggggacagtttcccccatg

SEQ ID NO: 641 - DNA, 21561 bp, Human
ggaggaagagctttggggaagatgaggtaaggaaagatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacatttggtctggtccctcattttttggtaatttgaggcccctattcctgtcactgtggtttgggtttttctcgggattagccactaacatcacccacattatttttcttgagcacctacagtatgtaaagcaacatacttagtgggcatccaaaaatctaagaagctccacactcccaactttaagaagtttataacctagctgaggagttggggtggcagaggagtggtctaatactaaagttattgtcctggctccacaaagcacatctcataccagttcagatataatccctctaagaagcagaatgccatatgacagcataggctaagagccaaggacagaaccaagtggagtggggctggtaaggatttggagctgtgtcttcacaagttgagactcccctgggtgggtagggaaatgataccactgctatcagctctttcattttccatattccaggttgagataaataaggttaggaagtgaatctatcggccaggcgtggtggctcacgccggtaatcccagcactttgggaggccgaggcaggtggatctcttaaggtcaggagttcaagaccagcctggccaacatggtgaaaccctgcctctactaaaaataaaaaattagccaggcatggtggcatgtgcctgtagtcccagctacctgggaggctgaggcatgagaaatgcttgaacgtgggagacagaggttgcagtgagccaagattgtgccactgcactccagcctgggtgacagagtgagactctgccttaaaaaagaaaaaaaaaaatctgaatctatctcctatctcccagctgggtgcagtggctcactttgggaggctgaggtgggaggattccttgagttcaggagttcaagaccagcctgggtaacatagtgaaaccctgtctgtattctcaatataaataatttgtctaaaacttttaaacaaaagtttaagattcttttcttataaaaaagaatccatctcccactcctgttccaaatttgaggaaagcattattgacctggcaacaataaacagtagaaaaaaagaaatagcagaaatgggcaaaaaaatatgttctctggatatagagatgaggcctccagggggcagcaccaaggcagagaaatagactaagatcgctcagtgttttccttggtctggggctccccacagttccccaccatcactcctcccattccttccaactttatttttagctgccattgggagggggcaggatgggagggaaagtgaagaaaacagaaaaggagagggacagaggccagaggacttctcatactggacagaaaccgatcaggcatggaactccccttcgtcactcacctgttcttgcccctggtgttcctgacaggtgagggaagttaacttcttggtttctggtggggatggaagatacatagattgtttggaattgggaccattatagttaaaattctttgggatttaggttaggaagcgaacactggttgtacatttcttgtatgtgtgtctgtgtccttgtgcatttttatgccctcacatatgactgtttgaatattgagactggcaggggctaaagctgcctaggaccttgtgtaagatttgtatctaataattatataatatataattgtataattatatattatatataatatacatataatatataacaattatatattatatataatatacatataatatataacataattatatattatatataatatacatataatatgtaacataattatatattatatataatatacatataatatataacataattatatattatatataatatacatataatatataacataattatatattatatataatatacatataatatataacataattatatattatatagttatatattgtatataataattattattattttttaaagatagggtctcactttgttgtctaggctggagtgcagtggtgcaaccacagctcagtagttgggactactaggtacgcgccaccacgcacagctaatttttttttttgaaacagggtctcactctgtcattcaagctggagtgcagtggcatgatcatggctcactctagcctcaacctcccaggctgaggtgatccttccaccttagcctcccgagtagctgggactataggcgtgtgctaccacgcctggctaatttttttttttttagagacagagttttgctatgttggccaggctggtctttaactcctggactcaagcaatccgcccccgacagccacccaaagtgccgggattataggcatgagccaccatgcttggctgagatttgtatctaaatatataaaatcttcatcctaagccctataggggtaaggagacaaaaaagaaatgtgatgtgaccttccacgtggctagtctgattcctattatcccctccctaacttcttacccttggtggtccctggggcctgaggcataactgactaactatgtggtcagaactctgggtttatctaaccaatgagctgcagtttctggtcatacagccctgccagttttctggatgcaaaactgctcacatactaaacacctttctgaaaatgagcatggtttgggataaagctatagccattggtaatggtgagggggtagcctgagagggggttgcttagaagtacagagcaagacatagttggggaaaggaccatgggaaggacaagaggcctggaatttttccttggcagtgccctgtaatcattgtttcctaaaataccagctctgattttaaaggcattggggtcaaaagggaagattagctagggtcgggcacctttagaatgggctgaaggctgaggaaaccatggaggtaggtaggggaccagttgggagagtagattagttaaaaaggaagcaggttgtgggaaacttcaggatgatgggacccttggaaaggatggatggcaaactatgtgtgtgggcaggcgagtggccccacccagttaattaccactgagatttccaaggctggaatcaaccagggacctagacattggaaaaagacagtgagagtgtgacaatgacactggaagtcaggaagagatagagaaggagagagccagacatgcagtgctccttagcttcctttcattccccctattttggggagaattggaagcaatggttgttctggggatacagaaaggccctctccctcttttgaccctcacagtttgttgaggagagtgtgtggaaggaatgttgtggaaaagagtagccaggcgcggtggctcacgcctgtaatcccagcactttgggaggccgaggcgggcggatcatgaggtcaggagatcgagaccatcctggctaacacggtgaaactccgtctctactaaaaataagaaaaattagccgggcgaggtggcaggcgcctgtagtgccagctacacgggaggctgaggcaggagaatggcgtgaacccaggggggcggagcctgcagtaagccgagatcacgccactgcactccagcctgggcgacagagagactccgtctcaaaaaaaaaaaaaaaaaaaaaaaaaaaaaagtaacttgaccttttcagacatgtctgtgaatgaaatttcaggggtgggaatggaaatacagctgtacatcagcatggcagagggccacagtttaggcatctggacacaaacacaggaagggaatcatctttgcctggagctctgagtacatgacactgagagaggccagaaaagcttatgagtgaaaaagcaggcaggcagactgagattaagacgcttcctcacagcttctctcgggctgtgcctctagccattcactacctcatactaacattatgatcctgaccccacaggtctctgctccccctttaacctggatgaacatcacccacgcctattcccagggccaccagaagctgaatttggatacagtgtcttacaacatgttgggggtggacagcgatggtgaggaagaaaccggagtgccaggggattgggactgcagtagtgctaacaaaggggaggcaagatagatgggactctaaactaatctggtcttttgaaagtggctggggctctaaacttaccacctccatgctctttccctttggcctatgtcaagggtcatgtttgccctgtgcttacttacattcacatcctcttcccaggatgctggtgggcgccccctgggatgggccttcaggcgaccggaggggggacgtttatcgctgccctgtagggggggcccacaatgccccatgtgccaagggccacttaggtgagaagatgcctgacccttctcctcctaacccctgactttgatactctagaagcttcaactccctatacctcagctttttcacccctaaaatccgcatactccctgtccccaatctgataccaatccctgctcattctcctccaaaatcacatgaattcaagcaccccatctatgaccccatgatctcattctcttccacctccttccaaccaggtgactaccaactgggaaattcatctcatcctgctgtgaatatgcacctggggatgtctctgttagagacagatggtgatgggggattcatggtgagctaaggagagggtggtggcagtgtctctgaaggtccataaaagaaaaaagagaagtgtggtaagggaaaatggtctgtgtggaggggtcaaggagttaaaaaccctagaaagcaaaaggtaggtaatgtcagggagtagtcttcatgcctccttcaactgggagcatgttctgagggtgccctcccaagcctgggagtaactatttcccccatccccaggcctgtgcccctctctggtctcgtgcttgtggcagctctgtcttcagttctgggatatgtgcccgtgtggatgcttcattccagcctcagggaagcctggcacccactgcccaacgtgagccagaggaaggctgagtacttggttcccagaaggagatactgggtgggaaaaagatggggcaaagcggtatgatgcctggcaaagggcctgcatggctatcctcattgctacctaatgtgcttgcaaaagctccatgtttcctaacagattcagactcctggccaggtgtggtggcccacacctgtaattctagcactttgggaggccaaggtgggcagatcacttgaggtcaggagttcaagaccagcctggccaacatggtgaaactccatctctactaaaaaaaaaaaatacaaaaattagctgggtgcgctagtgcatgcctgtaatctcatctactcgggaggctaagacaggagactctcacttcaacccaggaggtggaggttgcggtgagccaagattgtgcctttgcactctagcgtgggtgacagagtaagcgagactccatctcaaaaataataataataataattcagactccttatcaggagtccatgatctggcctggcacagtaactcatgcctgtaatcccaacattttgggaggccaacgcaggaggattgcttgaggtctggaggtttgagaccagcctgggcaacatagagagaccccatctctacaaaaataaaaaataaaaaaattagctgggtatggtggtgcatgcctgtggtcccagctactcaggaggccaaggtgggaggatcacttgagcccaggtggtccaggctgcagtgagccatgattatgccactacactccagcctgggcgacagagtgagactctgtctcaaaaacaaacaaaatgggccaggcgtggtggctcacgcctgtaatcccagcactttgggaggccgaggccagtggatcacgaggtcaggagatcgagaccatcctggctaacagagtaaaaccctgtctctgctaaaaacacaaaaaattagccgggtgtcgtggcgggcgcctgtagtcccagctactcgggaggccgaggcaggagaatggcgtgaacccaggaggcagagcttgcagtgagccgagattgcgccactgcactccagcctgggcaatagagcgagactctgtctcaaaaaaaaaaaaatgttctctacccacatgcctttcctaatattctcttctccttaaacattttcagtcttcatagttgctaccatgtttcattcctcaccatcagaaccactctgcttttgttcccccaccatacagtcattgctatgttcctacatagcatttaattccttcttgttttttagaacattgtatatataaattatatctatgtatataaatgtgtaggtgtgtgtgtttatatacctatatatacatatatacatatatatacatttatatgtatacttacatacacacaattactaaagattactaaaggaatattttattaatttctacacttacacagagcctggcacagtaccttctttgcatgtaagaagtgccttataaatgtctaaattgaatgtgtcctcctgtgacctctttcccttgttgcccccagctcagtgtcctctacctcagtgttccccttccttctaggctgcccaacatacatggatgttgtcattgtcttggatggctccaacagcatctacccctggtctgaagttcagaccttcctacgaagactggtagggaaactgtttattgacccagaacagatacaggtaagagaaggcaatatgagctgggcacagttgcttgtggcacctacttaagaggtggaggtgggaggatcccctgaggccaggagttcaagactagcctgggcaatacagtgagacctcatctctaaaaatatgaaagaaaaaaaaaatagccaggcatggtggcatgcgcctacagtcccagctactcaggaggctgaggcaagagatcagttgagcccaggagtttgaggctgtagtgagctttgatcacacaactgcactccagcctgggtgaaagagtgagacctcatttcttagagagagagagaaaggcaatatggatgggcttggaaggggagagacagagagagaggggataaatgtaggtgttgtcttcagtagtatccaggtgttcatctctcctctcttatatactttcttcttcctcctctccccccatctcacatacatacatttcatttgaatgcgctttattcccaggtgggactggtacagtatggggagagccctgtacatgagtggtccctgggagatttccgaacgaaggaagaagtggtgagagcagcaaagaacctcagtcggcgggagggacgagaaacaaagactgcccaagcaataatggtggcctggtgaggcattgggaagacaggtgtgggaggctagagcaatgaaggcttagaagagttagggcggggccaggcatggtggctcacgcctgtaatcccagcactttgggaggcaaggcaggcggatcacctgaggtcaggagttcgagaccagcctgaccaacatggagaaaccccatctctactaaaaatacaaaattagccaggcatggtggcgcatgcctgttcagaggcatgctacttcggaggctgaggcaggagaatcacttaatcccgggaggtggaggttgcagtgagtcgagatcacaacattgcactccagcctgggcaacgagagcaaaactccatctaaaataaaataaaataaaatgaaatgaaaatctttcccttaaaaaaaaaaaaagaagaagaagaagagttagggcaggtttggagtgcagtgtgtatatcccaagatgtcttgcatactttctttgtatgtacactaatggtacaaagaggaaggctaagtgggctgtcattgtactccctctcactgcatttctacaaagtatctatgtctgtgtctctccatatttcacagacagaagtctctttctatccctccactccaacaatgatcctggcccacaggttctccactactgatgtcctagcccacgttccaaacatgatccaaaactcatctctaggggcacggtggtaaaattgaaacaaaacaaaacaactcatctctgggaggagtccctgcccagatcattcttttccgttctatatttcatcgatatttcccctcccaagtgcaatatttgttgaatgaatctgagtgtatgaacgttgtacttatttggactgataagctactctgtatgttctatgaccttcaaacatttgagctctcactccatgccatctccatgttaaatactcaggaaatggcctaaaaggcaagatgcctgacctcagggaagtgctgatgttaaatcctgtgtgtgtgtgtgtgtgtgtgtgtgtgtgtgtgtgtgtgtgtatgtgtgtgtgtgtgtgtgtgtctgcatacatctgatctcacctcactcctttctcttctcagcacagaagggttcagtcagtcccatgggggccgacccgaggctgccaggctactggtggttgtcactgatggagagtcccatgatggagaggagcttcctgcagcactaaaggcctgtgaggctggaagagtgacacgctatgggattgcagtgagaattcaccctggatctggaagagttggggagtggcaggggggcagtgtcttgtgaactgtccaaggactgggaacttgaggaaaacaagggcattaactacttcccagacttcagccacagcatgttagttggctgtgttctgtaccaactctaatgcctcattccttgatcttatgacctcttaggtccttggtcactacctccggcggcagcgagatcccagctctttcctgagagaaattagaactattgccagtgatccagatgagcgattcttcttcaatgtcacagatgaggctgctctgactgacattgtggatgcactaggagatcggatttttggccttgaaggtgaggattactctggagaaatggacagggcgggagaagttctggagtgtaggtggggctctggagtgagttcagtaggtcaaaggggaaactgtcttcccctgatattgtctcaatgttttctcatgaccaagggtcccatgcagaaaacgaaagctcctttgggctggaaatgtctcagattggtttctccactcatcggctaaaggttggacagattgaccccttcattacttctcccattctctgactcagataacttcaaccacagggccctccagattcctcctttaaccagcctccatgctcaccttcccatgcctttccaactgagcccagcagaccctcagtgatcttttcactcctggaacgtttttctctctttattccccactgtcttctcagtgaccccatctgcttctgtcccacaggatgggattctttttgggatggtgggggcctatgactggggaggctctgtgctatggcttgaaggaggccaccgccttttccccccacgaatggcactggaagacgagttcccccctgcactgcagaaccatgcagcctacctgggtgagcagcagagagttgcagaggacttacagggtaggggaggaaatacatccctagtgggggcgggtatgaaatactccctcttaactcatgcggtttctcactgacctctggctacttcccttgggacctcctgctatgcctttagggaacccccctactctggaccccatcttcttttcctttacctctgttactttgcccacttctaggttactctgtttcttccatgcttttgcggggtggacgccgcctgtttctctctggggctcctcgatttagacatcgaggaaaagtcatcgccttccagcttaagaaagatggggctgtgagggttgcccagagcctccagggggagcaggtagggcatccaaggaagggtgggacctttggattcccagggacctctgggctgttggggaggagtgtgaagtgggtaagagagaggcctccaaagtctgtgcggaattctggttggcagagtctgtcagggatgtaaggagcagactagcaggctggtgagtgcttcccactgagtccacttgtctacagttaccttcccttttctctggggtcatcatcacccaccattccccagattggttcatactttggcagtgagctctgcccattggatacagatagggatggaacaactgatgtcttacttgtggctgcccccatgttcctgggaccccagaacaaggaaacaggacgtgtttatgtgtatctggtaggccaggtgagacttgctgggaccccctgccctggacttgcattgtgggggtggagggaggaaaggagggaaggtgcacatatttgagggtttgctgagaggttgggtctgccagattagcatcttctatcttctctcctccaccagcagtccttgctgaccctccaaggaacacttcagccagaacccccccaggatgctcggtttggctttgccatgggagctcttcctgatctgaaccaagatggttttgctgatgtggctgtgggggcgcctctggaagatgggcaccagggagcactgtacctgtaccatggaacccagagtggagtcaggccccatcctgcccaggtcaggagtacccaaataaagcaggggcacggttgtaggaagaggaatagggggatgctctttgcttgtcaatagtctccttggcttgagacccaaactgaacaagtgcttttattagtaggcaaaaacataaggcagtggacaggttgctgaactaagaactcctgaacacaggcaagtttctcttattcccaggactgacgggagcattataaagagcaaggcatggccgggtgtggtggttcacgcctgtaatcccagcactttggaaggctgaggcaggcagatcacctgaggtcaggagttcgagaccagcctggccaacatgatgaaactctactaaaaatacaaaaaattagccgggcctggtggcgcacacctataatcccagttactcaggaggctagggcaggagaatcgcttgaacctgggaggcggaggttgcagtgagccaagatcacaccattgcactccagcctgggcaacaagagtgaaactccatctcaaaaataaataaataaataaaaagaaagagcaaggcaggaggcctgagaaactaggtgtatgggtccctgcctcagtattctctctcttcctctcagaggattgctgctgcctccatgccacatgccctcagctactttggccgaagtgtggatggtcggctagatctggatggagatgatctggtcgatgtggctgtgggtgcccagggggcagccatcctgctcaggtgaggggtcccagctcaggtggtggtggacagcatagcatagctgttaaaggcaagggccttaaagtcacagatggagatttggttttcttggtcaacttactctgtgcctccattcttagtttataaaatgacagtagtaatagtacctaccttataggtttattgtgaagattaaatgagataatccatataatgatttgaacacagtgcctagcatgtaagtgcgtattgaagtgaatctagggctgggtacagtggctcacacctgtaatcccagcactttgggaggcgaaggtaggaggatcatttgaggccaggagttcaagaacagcctgaccaacatggtgaaaccccgtctctactaaaaatacaaaaaaattagctgagcatggttgtgggcaccagtaatcccagctactcgggaggctgaggcaggagaatcacttgaacccaggaggcagaggttgcagtgagctgagatcgccccactgcactccagcgtgggccacagagtgaaactccatctcaaaaaaaaaaaaagatcaatgacatgaatctattatcttacttctgtcagagggttcgggggagggtgacatgtgcattcagcccctccttctttgttttgaccatggggaagcaaacactgggcttgcacttctcagagggcttacctcctactgctagaatttcttttccacactgttcccagctcccggcccattgtccatctgaccccatcactggaggtgaccccacaggccatcagtgtggttcagagggactgtaggcggcgaggccaagaggcagtctgtctgactgcagccctttgcttccaagtgacctcccgtactcctggtcgctgggatcaccaattctgtgagtgactaaaatgcattacaggcaactctcaattccttgcatgccttcctcactagacccctttccaccctcactcttgcctccttcattcagacatgaggttcaccgcatcactggatgaatggactgctggggcacgtgcagcatttgatggctctggccagaggttgtcccctcggaggctccggctcagtgtggggaatgtcacttgtgagcagctacacttccatgtgctggtaaggagagggcagtaactgcttagcatcagggcctgagaatgaggagaaagctgggtcagaggaggaattttagctgaatcagcaagaaagccaaagccgggaaaatgagatgattcagactttggagtcagggctgatctgggtttgaatcctagctctgccatttaccacctatgaattctggcaagtccaaccctcagttttcttgtctgcaaaggggtgataataataactgtatcataggagttgtattaaaattaaatttagccgggcgcagtggctcacgcttgtaatcccagcactttgggaggccgaggcaggtggatcacaaggtcaggagatcgagaccatcctggctaacatggtgaaaccccatctgtactaaaaatacaaaaaattagccgggcgtggtggcaggtgcctgtagtcccagctactcgggaggctgaggcaggagaatggcctgaacccaggaggcagagcttgcagtgagccgagatcatgccactgcactccagcctgggcgacagagcgagactctgtctcaaaaataaataaataaataaataaattaactaattaattaaatttagtaatacagttaagatcttaggacagtgcccagcacacagaaaatgcttcataaatgatcactacaattatcacaagatccttgactctgtgactctgtgactctgttttccttcaggatacatcagattacctccggccagtggccttgactgtgacctttgccttggacaatactacaaagccagggcctgtgctgaatgagggctcacccacctctatacaaaagctggtcagcagtgccatgccctgccccttgctcccaacactgccctccttcaagagaaaagggagggagggagaagacatgagatcatggtgaaatctgacctgggctcctctaatcaaaatatacccacttttgtcttttcactttccccctattctattcctttcctccttgctttcctctcaacccttagccccttccctttcttccaggtccccttctcaaaggattgtggccctgacaatgaatgtgtcacagacctggtgcttcaagtgaatatggacatcagaggctccaggttggatggacatgtactaggcaaaccagggtgacctgagacagactggaagggactcgaagggcgggtagggggttgtttcttacccatgataacaaaagtgagacttttggcactcccctccttcaactcctggtctctccctcattcatcattcccaggaaggccccatttgtggttcgaggtggccggcggaaagtgctggtatctacaactctggagaacagaaaggaaaatgcttacaatacgagcctgagtctcatcttctctagaaacctccacctggccagtctcactcctcaggtgcctttggaggagggggtgtgggagaaggaaagaaaggaggaggaagaagattggggtattggcctcagctgtgaggtcctctagagaaaggctcagtgtttagaggctgtgggtaggacagcagttgcagccccagctccagcttctatctccattcccctgccctcagagagagagcccaataaaggtggaatgtgccgccccttctgctcatgcccggctctgcagtgtggggcatcctgtcttccagactggagccaaggtgggttggggtctaggatgaaaagagggctctaggagggcagaggctgggatctgagggtcctgggacttcagggaagggggcgcacaagggctcctgttcctctgtagttgttccatgaggaagactctaccattaccctgtgtcccctgcccctaggtgacctttctgctagagtttgagtttagctgctcctctctcctgagccaggtcttcgtgaagctgactgccagcaggtgagaatgaagggaactttcttccagacctctcctcctactgagtcttgactggaggggtggggaggaacaacattgattcctctattaacagagaagggtgtcttctgaggaggggttgagatgtgagcctctcccctctgaccctacagtgacagcctggagagaaatgggacccttcaagataacacagcccagacctcagcctacatccaatatgagccccacctcctgttctctaggtatgcccagcttctagggtgggacccagttctgacctcagactcatacccttatgctgcttccctccccttccatgtgcctcagtttttccaaaaacccaagcccttgcggctgctcagtctttttgccctcaatcctattcatgctgaatcttcccttttaagcatcttactttcctaggtatagtgttttgccaggccttgggcactggagctgggatgaggggatatgggatgtagccataaagcttgcattgtctgtgtcatgttctacttctgtcttctccatgtacccccacctctttatccatgtgctggccctgcctcctctgaatccacgtctgtgtgctgatcatgtgcccctgtgtctgtgttatggctgtgaccatgtacttcctgacttggtgttcacacagtgagtctaccctgcaccgctatgaggttcacccatatgggaccctcccagtgggtcctggcccagaattcaaaaccactctcagggtgagaagctggaggggtcttggcatgaggagaatgtgggggaacaacagctttgtgggaaaaggatgggaagggtctctcttggattttaatggtatctagggtgaaggggaacaaatgaggaagggtcttctgtctcccacttcttcctattcccaaccttcctcttaggttcagaacctaggctgctatgtggtcagtggcctcatcatctcagccctccttccagctgtggcccatgggggcaattacttcctatcactgtctcaagtcatcactaacaatgtgagtctggtctaggagggcatggaatcctgccaccttgagctggtggactcactgaagctggacaccacaccagctccctatctgttgggcctctgctcttggggctcttctctctggggggctttctttttacacatgtggcttattagagagaagaaaaaggtattataaggggaagaactacaagggtgtaggtatgttccaactcagccttgagtggctagcgccaccccatcaggagggtctttcaagttggatcttcctctaggcaagctgcatagtgcagaacctgactgaacccccaggcccacctgtgcatccagaggagcttcaacacacaaacagactggtatgagtcacaaaggggtgtccagagtgggaatgcaagtggagttgggtgacttgggacaagagggtaggaactggagtggggaagaagggatctttccaccccagggtcctgatctggagtgggaatgaaaatggagtcaggtgccttgggacaagactgtgtgaactagaggtggggaaagaggatgtttctaccccagagtcctgatctgtctctctctgtctcttctgttagaatgggagcaatactcagtgtcaggtggtgaggtgccaccttgggcagctggcaaaggggactgaggtctctgttggactattgaggctggttcacaatgaatttttccgaagagtaagcctttccttttctagtactccccacttctgctcctttctggaactttagcataggttttggaggtagacagacccacgttcaagtttcacttttgcctcttactagctatttgaccatgagcaagttatttcatctctctaagcctctttttcctaatctctaaaatgggaagataataccaatttcatggggttgttataaagaataaatgaataatgagctggacatatggtgaacactcagtggaagctagttattatccttgtattttcctccactgaccattacttttttttttcctgaccattccttagtgctgtatcaatcaacatttgcaggatacctaaatttaatcagttaagaatccatcacgttcctattacgtaaaaggccctgtattaggttgacactgagaatatctccaacatttagcctcatgcctaactcattgtaggcgcttaacatatttttgctaaatgaatgaattattgatattacatgcaggatttgtactggggagtggtgggaagtaagattgtataggtgagagggatctagattacgaaaggcctctgaagccagggagaaactgaacttaatatgacaggtagtgaggagtcagtgtgagttcctcctgggcagggaaatggcatcttaattgtaatggctgtttggcactaaggtcaatgttgtgctttcccatatctacctggaataacacaagatccctgggatgtcatcatatgttttagggaagttaagtccaataaaccacccttctccaagtctctgtccttctttggtatctttttttcactagtctattcatgctttcaacaaagatttattaagaaaccactacatggccgggcgcggtggctcacgcctgtaatccctgcactttgggaggccaaggtgggcagatcatgagatcaggagatcgagaccatcctggctaacacggtgaaaccctgtctctattaaaaataaaaaaattagccaggtgtggtggcaggcgcctatagtcccagctacttgggaggttgaggcaggagaatggcattaacccgagagatggagtttgcagtgagccgagatcacgccactgcactccagcctgggtgacagagcgagactccatctcaaaaaaaaaaaaaagaaaccactacatacttggtactctgctatctagtaggcactaaggacacaaaggttagtaaggcacagcctttaacctagaggatcttatagttcaggagtgaaaaacagaagtaaacaccagtgttggtgggggttaggaggaatgatttccctaaatcccagaggggatgacatctaaacttcaatctaaaggaggggtagaggtcagccaaaggaaagaggagtagaatgcatttcaggtaaagcaccagatgtattgattgtccttggaaaacaaacagcagcagcagatgtgaccaggggttttccatctattacccttcctctcttttcccattggtcttcagccttttcttctggtcttgagagccctcaacattatgcctctcagcctcaactttgctgttgggattccaaagaactatatcacctgataatggctcattttaaatgtcttcctatccacttgttccataggccaagttcaagtccctgacggtggtcagcacctttgagctgggaaccgaagagggcagtgtcctacagctgactgaagcctcccgttggagtgaggtagggctggagaccgagtctgagagctgtgaaaataatgatgatgggtatgtggtagggccacccgtgggctttttcagaacgaaggcatctccatcaggcagcaggatcctagtgttccactgccgccattcctgcctcagtttctttcctttaagtagcaggaggttatttattctatttgggggctggctttgatataatgtggggtgaggctagctgggttataggatgcatgtagaaaactactcttctgtccacgcagagcctcttggaggtggttcagacccggcctatcctcatctccctgtggatcctcataggcagtgtcctgggagggttgctcctgcttgctctccttgtcttctgcctgtggaaggtaagcactgctttagtggggagtgtggagcatgatgcccatgagttgagggatccttgattatagcagagagaacaggatttgtgctgggcagctaaccaggctgtggatgtcatgcccagatctccttcactgtaccccacaaatgttggttaaattattctaagccaaataaaataaatttgaattccatttttggaaacagaacaaaagtgaagacctcagataagtctgagagctactggcaaggttcccagtctaggcatttggcagtgacgcttatcttttcttctacagcttggcttctttgcccataagaaaatccctgaggaagaaaaaagagaagagaagttggagcaatgaatgtagaataagggtctagaaagtcctccctggcagcttcttcaagagacttgcataaaagcagaggtttgggggctcagatgggacaagaagccgcctctggactatctccccagaccagcagcctgacttgacttttgagtcctagggatgctgctggctagagatgaggctttacctcagacaagaagagctggcaccaaaactagccatgctcccaccctctgcttccctcctcctcgtgatcctggttccatagccaacactggggcttttgtttggggtccttttatccccaggaatcaataatttttttgcctaggtgcctgactcctttcagattccctctttatcttccctcacagtttggaaaggatgagggttatcttcctcgattcttccaccctctcactttcctgcctgttccccactccacaggagggagctgacgttggcttgaaaggagtaaagtcaacatctgctgctttcctgtggactctggtgattcatagagccggatggggagagtcaacaggaaaaaaggagggaggaggaaaagccacaagagacattctgtacaattccaaggaacagagaagcctttagacaggcaactgccatcccccctgaaacctgagacctgtagtgcactcgaccgccctcaggtgttggtgaaacagagctgcccccaggctcgctgggcataggcttcctgattccaagccttttctgggagcaaagccagggcctggtgcctgattttctgaagccaggagccctcaggtggctggagctggaatagcagggaggactgggtgtacctaggcagtattttctctacttctctcaagtcttatactcactcttgagccctccttggggcctgcttagaaagcagacaggagagagagtactgctacttgatgatgggaaatgctttcactttaccagctttgggaagcagcagccccatgggatctaaaagtgtggagtctgcattaagaaacctacatgggtggcatggggctctggggagcaagcccttacttgctcagcactggttatgtagcacaaatagctcctaggaaaatgtttctggggcaaccctagaaccctggtcatattttgcagggtttctctggtggaatcagtttgccagcccttgcttgatgcttactggaaatctccaggttaatttctatctctgatccctccccaacccactccatatttgggtcatggacagtaaaggcagttggattctcacagacaactgggtaacttatatttctttgtaatcaagacttgagatatcgaagtcagttattggtctccagagtgcagctctgggagccttttgaagaatcagcactcattaagagctgagaagagagaagacctgattgggtggttgactagcagtcacagaacctgtcctcccaggctgttcctgaggcctgaccacagtatttattttggcatgtctctggccttctgcagaggcccaccctcatgggcattgtctctgtttcccagtggggtggacagtatatcagatggtcagaacaaataaagttcagtgtcaaatgacttttggctctatatgtattccctaggatatagactgctcagtaatagtgagaggtagatacttgttttgcctgggattttacagagtggagtccctggaaggcaaagttaagaagtattttaaatgttttctgtggctttcccacaggagatgtattctagcctcctgtaattctcacctgcttaagtgaccagaaagtataaaggtctgggaagcacagaggtttagattgaaatcctatctgccatttattagctgtatggccttcagcaaatcataacttccttgaggctcagataataaaaggctgtgtattacagtggttaacaatgaaggcagatttgggtttaaatctaggctacacaacttaaaaagtctgtttgacctaggacagacttaacttctctaagtcttggctttctcatctttaaacctattagggtcatgaagacaaaatgaaataatccaagaaaagtgagcatttagtaaatgctcagtaaatggtaactattattataaaactattttgtcataaaataatctaccatatcatgccttgtgaggattaagggagaaagtatactggagcaccaggtggtggtgttcctgctctctgacccatctcccagattgtgaagatgtgtttctacgtgctgttgtctcatccactaaatcttgtcctatgcctcatcttttttttttttttttttttttttttgagacagagtctcg

SEQ ID NO: 642 - DNA, 66955 bp, Human
gaatcgcttgaacccgggaggaggaggttgcagtgagccgagatcgagccattgcactccagcctgggcaacaagagcaaaactccgtctcaaaaaaaaaaaaaaaaaaaaaagacttgtttctcatagctaagagttcctgatacagctctgccttaaagaactggcaaattagtgtgcatttgtgtttcaatttcaaataaaatgtttaaggcaaaaaaaaaaagtaaatgttgtatgtcaggggatccccacattactggctttgtgtggagaccatggttcctttgggcttggctcttcctccctgcaccagtgcagggccccaggaacacatctgccacacacggccgccatgtccctctgctgaagctagtcagggtcatcctcactcctcagtgaccctcatgatggctccaccaggtaggtacttttattctccccatttaacaggtgaggacactgaggggcacagggatgtaagttaccttccctaggtccactatctaggaagtggtgggccagggtttggtccatgctgtcagctccttgaccctgcatctataactactaactatactatggagagcctcatgagctcctgcgaggtgtagaaccttatcccgcaggcggggcagtggcatggtcaggtctaggagtgaaaagatcctgcgatggttggagttgcgggcactgaagaggtgagcctggcgttagggggagcaggggagaccatcttccccctggtgaaatcctgttctaaaattggtgatactcctgccttggcctcccaaagtgctaggattatggcctcatatctatttttaaaaaataagaattcaagctgggtgcggtggctcgcgcctgtaatcccagcactttgggaagccgaggcaggtggatcacttgagttcagcagttcgagccagcctggccaacatggtgaaaccctgtctctactaaaaatacaaaaataattagccgggcgtggtggcagatgcctatgttcccagctactcgggaggctgaggtaggagaatcgcttgaacccaggagacggaggttgcagtgagccgagattgcaccactgcacaccagcctgggcgacaaagagtaagactccatctcaaaaaaaaaaaaaaaaaaaattcaaaacccatcgagttgggatgacgcttagtgctgggcttcaggaagagtaggcaggagggtagtatgggaggtttctaggagccactcttggaagcggtgctccccacagatgcccgattgcactgactggaactcggtcacatgaccacataactcgctcacatgaccacacctagctgcaaaggtgctgggaaatgtggtaccctgttgggaggccacttctgggcttcaaaccttcactgtgaatggagctcacaggttttctaaaaatggacattaaatgaaccagagttggccctaaggatctggctcactgcaacctccacctcccaggatgaagcacctgcctcagcctcccgagtagtagctgggattacaggcacatgccaccatgccgagctaatttttgtatttttagtagagaaggtgtttcaccatgttggccaggctggtctcgaactcctgacttcacatgatccgcctgcctcagcctcccaaagtgctaggattacaggcgtaagccaccacgcctggcctcaatatttctttttctgggtatttgagtatgatattatatatgatggttattagacagccagatgcataggaggattagctaatctgttttgaggaatacttatctccaatatagttatataacgacaacattctttttttgaatactggtctcgggtgcctaatgacagaagggtgacatcactaaggaagcctggaaagtcccagccctccacgtgatcccacggatgaaaatagctccgggtgagctctggaacagctgaaaaagctggagcaaccaagcagggcctacaagccgaggagggctgtttaaaggcgcaggggccattttaccctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcccaagcctccgcaccggattccggagcacaagctccaccgcgcatgcgcacacgccccagacccaggctcaggcaagccgtgggggcagggagggctgtttcatcccgctggggcggccataaccaagtaccagggattgggtgcaattaaataacaggatttctttttcttttttattttattttattttatttatttatttattttttttgagacagcatctcgctctgtcgcctaggctggagtgcagtgacgcgatctcggctcactgcaagctccgcctccggggttcaagcgattctcctgcctcaacctcccgagtagctgggattacaggcgcacaccaccacacccggctaatttttgtatttttagtagagatggggtttcaccatgttggccaggctggtctcaaactcctgaactcgtgatccaccccactcggccttccaaagtgctgggattacaggcgtgagccaccgcgcccggctaggaatttattttctaacacttctggaagctagaagtccaagatcaaggtgttggcagggttggtttctcctgaagcctcttgcagaggccctaatctctccttataaaaccaatcaggctgggcgcggtggctcacgcctgtaatcccagccctttgggaagacgaggcgggcggatcctgaggtcaggagatcgagatcatcctggctaacacagtgaaaccccgtctcaactaaaaatacaaaaaattagctgggcgtggtggcgggcgcctgtagtcccagctactccggaggctgaggcgggagaatggcgtgagcccggaaggcggagcttgcagtgagccgagactgcgccactgcactccagcctagggcacaaagcgagactccatctcaaaaaaaaataaaataaaataaaccaatcaaaccaaattccaggccaccctcaggaccccactttaacttagtcacccctttaagagcctatgtctggccgagtgcgatgactcatgcctataatcccagcgttttgggaagccaaggtggaaagctctcttgagcctaggagttcaagaccagcctgggtgacataacaagacctgatctctacaaaacataaaaaatttagctggagatggtagcatgtacctgcacttccagctactcgggaggctgaggtgagaggctcgcttgagcccaggaggctgaggctgcagtgagccacgatcacaccactgcactccagcctgggtgacaaagcaagaccctgtctcaaaaagcaaacaacgaaaaagaatcctatgtccaaatacagtcacattctgaggttctgggggttacaagtccaacatatgaatttggaggtggtggggggaagctgattaatttcataaggggggtcttgaaactgccttcgcagaaatgtaagtaatgagagaaagctaacatgactgaccatcttgtttctaacctcacaggctagatttttttttcttattctagtgcagaggccaaaattaccatgagaggaatttaattcatagttaaactttgagacaaagaaaactgacccccagtccttgttgagagattgaagccacattcatttactttttatttatttatttatttttgagacagagtttcactcttgttgcccagactggagtgcaatggcatgatctctgctcactggcacctccacctcctgagttcaagtgattctcctccctcagcctcctgagtagctgggattacaggcgcccgccatcatgcccaggtgacttttgtacttttagtagagataaggtttcaccatgttggccaggctggtctccaactcctgacctcaagtgatcctcccacctcggcctcttaaggtgctgggattacagccatgagccactgtgcctggcctgaagtcacattcataagacaaggttagaatcatgaaggtgctggaactttgctaaagaacagtcgtgggttgaagaatgacctgccatcccttagcttccttttctatatgtgctccagagtcacgtaaccaggggtcgcatgatttataacttccccagctacttctataaataatatcactgtcgtgaaacacagaactcagctttttagtggggtgtggtagctaacacctgtaatccccacttcttgggaggctgaggcaggaggattgcatgagcccaggagaatgagaccagcctgggcaacatagtgagacctcaatctctacaaaaaaattaaaactttgccagacgtggtggtgcatgcctgtagtcccagcaacccaggaggccaaggcaggaggattgcttgagcccaagagttggaggctgcagtgagctatgattgcgccactgtagggaccagccctgcagggtctgtgggtctttctccccatgtgcggagacgagagatcgtagaaataaaaacacaagacaaagagatagaagaaaagacagctgggcctgggggaccactaccaccaagacgcagagaccgatagtggccccaaatgcctggctgcgctgttatttattggataataaggggcagagtaaggagtgtgagtcatctccaatgattgataaggtcatgtgagtcacgtgtccactggacagggagcccttctatgttaggtagccaaggcgtagagagagaggatagcttatgtcattatttcttttatgttcttttcagaaagatcaaagactttaatattttaatactttcactaattctgctactgctatctagagggtgcagccaggtatacagagtggaacaggaaagtgaaacaggagtgtgaccactgaagcacagcatcacagggagatggtcaggcctctggataactgcgggcgggcctgacatcactcaggccctccacaggaggcggtggagcagagtcttccctaactcccccggggaaagggagactccctttcctggtctctaggcactgacgcaaccgctagaccaaggtccgctaggcaatgggcatcttcccagacgctggcgttaccccaagaccaaggggccctctagtggccctattcgggcatgacagagggctcacacttgtcttctggtcactcttgacctcaagtgatctgactgcctcggcctcccaaagtgctgggattacaggcatgagccactgctcctggcaataatgtttcgttttgtttttgttttaaaaaaaagaaattgtctttgagatagttttcagagtgagcattttggcagaccaagagctaccacctggtcctgagacccgctcccaggaactgactcagctatacaaagatagttttggacacacctgtgatttcatccatagccgatcaattgttccctcagccccttgcccaccaaagtttccttaaaaaaccctagtctcaggtcggacgcggtggctcgtgcctgtaatcccagcactttgggaggccaaggcgggtggatcacctgaggtcgggagttcaagcccagcctggccaacatggagaaaccccatctctactaaaaatacaaaaattagccgggcatggtggtgcatgcctgtaatcccagatactcaggaggctgaggcaggagaatcgcttgaacccgggaggcggaggatgcagtgagccgagatcatgccaatgcactccagcctggtcaacaagagggaaacttcatctaaagagagagagacagacagagacagagacagaggcagagaaagagaaagagcgaggaaaaaccctagcctccaaattttcagagagacgcgcttgaaatatttctcccattctcctcgcttggccgcccctgagattattaaactctctctctttgctgcaacacctgctgttcgcattggttttgtctgggcagtggacaaggagaacccatgagcccgtgacagtcccagccctcccccactgtctttgctaagcccaacagtgggcacaggactaagaagagccatttctttggcaggaggactgagaattttctgaccgcagtgcaccatgggaaggtaagtcctcttagagctgaccactatggggaagcagagcatttgtgtaatggaatgcatagtaagtgtcaagaggtgagggctgtgacagttcctctcgcttggtggagatagatggaaagagctgaaggttgggcatggtggcccatgcctgtaaccccagcacttttggtggccgaggcaagaagatctcttgagccccagagttcgagactagcctgggcaacatggtgaaaccctatctctacaataaaagaaaatatttttaaaaattagccaagcatagtggtacacacctgtagtccaagctacttaggaggctgagacatgaggatcacttgagtcccggtgttcaaggctgcagtaagctatgattgcaccaccgcactggtggtgggcaacagagcaagaccctgtcttattgttgaaccggggaggtggaggttgcagtgaactgagattgcgccactgcactccagcctgggcaacagagcgagactctgtctcaaaaaagagagagagaaagagaaagaaagaaagaaaagaaagaaagaaagacagaaagaaagaaagaaagaaagaagggagggagggagggagggagggagggagggagggaaagaaggagggaaggaaggaaggaggaaggaaggaaggatggaaggaagggagggagggagggaggggagggaaggggagggagggagggagggagggaggtatgtcaccatgttggccaggctggtcttgaactcctgggctcaagtgatccacccacctcaccctcccaaagtgctgggattacaggtgtgagccaccgcgtctggccccaaaattaaccattttgaaaagtgaataattgactggcattcaatgcattcacagtgttgtacaaccatcacctctatctagtttcagaatattttcctcaccccaaaaggaaaccatgtacccgtgggctggtggctacctgcttggacagcccagttctaggtcaaattctgtgttttatcccttttccctgtgaattttctggacttctttgtgttttctcctgggaagctctgaagtttccataattcctgggctccagaaagaagaaaaggcggccgtggagagacgaagacttcatgtgctgaaagctctgaagaagctaaggattgaggctgatgaggtaagtgaggggaggagggtggccccagagatcccagaatcgccccctctgtgcccagtgtccagggcccaactcagccagggagagctggaccgaaggatatgaacttctatgggatagaaatagaaggatatgaacttctatgggacaggcattgcccctgcctaagggagatcctaggtctcctccttctcctcctcctcctttctttttcttttcttttctttcttttttttttttttttttttttgagacaacgtctcgctctgtcacccaggctggaatgcagtggcatgatcttggctcactgcaacctccacctcccaggttcaagctattcccctgcatcagcctgctgagcagctgggattacaggtgtgtgccaccacacccagctaatttttgtatttttagtagagatggggttttaccacattgaccaggttggtcttgaactcctgacctcaagtgatccacctgcctcggcctcccaatgtgctgggattacaggcgtgagccacggtgcccggccccaggtacccttcttcttgttcccacctccatcctcaggctctaaacctctgatcgattttctccccaatgcctaggccccagttgttgctgtgctgggctcaggcggaggactgcgggctcacattgcctgccttggggtcctgagtgagatgaaagaacagggcctgttggatgccgtcacgtacctcgcaggggtctctggatccacttggtaagcatcactcatgtttcagattgctttctgacacataaatgggattatttttttcctcctgacaccaaatgtgtgtggttttttccaacgctgcttctcgagctctctggtactagctgggtgtcctacaattctgagcaattctgacgctggctacctggagttcacatcagattccacaggtgaaaggggctcagtcccaaaaaactgctcccacttcagacacgagttgcaattacctagccgctggtgcttctgaccgactggcaatagtttggggtttcccacagcttccgcctcatgttcaataatttactggaatagctcacagaactcaggaacacactttacttacaattgctggtgtattacaaaagatgggccaggtgtggtggctcacgcctgtaatcccagaactttgggaggctgaggcaggaagatcgcttgagtctaggagtttgagacccaggcggggcaacatagcaagaccccatctctacaaaaagtgaaaaaattagccaggcgtggtggtgcatgcctatggtcccagctactcaggaagttgaggcaggaggattgctttagcctgggaggctgaggctgcattgagctacaatcacaccactgcacaccagcctgggtgacagagagaccctgtctcaaaaaaaaaattttttttttctaaaaaagaaaattccaagggttttaggaactctgcaccaggaagcaggggaaaacaccaagtatctttctttgctacacaaagccatggacaaagcataataatactaccttctgacattaaaggaggatttacatgttcaggtgcacttttcacactgcaggtggatagaatacagcccttttaacttatcagcctctatgataaagtattgcattaatccgtgtaggactgtctcattcaggaggccccagatggcaggtatgaaacactcatgtctgcatgtttgttgccaagcccagggcagacatgactaatcgatcttggcacattttcagagcaggaggtaaggctaggcagagcagcagaggctcgagtgtgagataggcagggcagaggcatgaatgttgagcctggctggcctgatttgttttcatttctgtgctcaaagtttgatctggagctgggttctgagctggatgtggaggatgaggttcctggaggcgacagcatgaagagcagagctgcagagcttgggagtgggaaaggtcctgcagagtcacaccggacccctctattcctccaaggctcatctaacatgttgagtgacatggcgtgggggtttagctgtactgcacattgcagaactccagggggcgctattgagataggaaccccatgatttcttctggaatctttccgagactgctgtggttaaaaaggcaggcctggctggacacagggactcacacctgtaatcccagtactttgggaggtcgaggtgggaggatctcttgagcccaggagttcaagaccagcctgggcaacatagcaagaccccatctctacaaacaacaacaacgaaagccttatatttcaacagctttgggttagttcctggagctgtcctttgtgggctgttacgagcccagacatacttctttgtgccttggtttcctccgctgttgagcattgtaagtgtggacgatgaagactgggaaaggatgtgtgtgaggaggtccttcacaggaacgcctgcctcatggagagggcgacacacagaggaaatggaaaatttacatgaaataaatataactgcagaacggtcaagttcaaaggagcactcaaaatcatctgggacagtccttccatttcacaggcaggaaaatgagagcacgatgggagaaaggcctcatcagagtcaaatgttttttgcagccagcatttattaaaggtttacatgtgacagcaacaaactgtgctgatctcacagggctgtttgagaattaaatgatgaaacacatgcaaatcgtcccaacctgagctatcaagtagagctatgtaacatgagccacatctattctatcattttaaattttctttctttcttttcttttctttttttcttctggagacacagtcttgctcttgtcgcccaggctggagtgcagtggcgcgatcttggctcattgcaacctctacttcccaggttcaagtgattctcctgcctcagcctcccagttagctgggattacagacgcgtgccaccatgcccagctaatttttgtatttttagtagagacggagtttccccgtgttggccaggctggtctcaaacttctgacctcaggtgatctgcctgccctggcttcccaaagtgctggaattacaggtgtaagccaccatgtccggcccattttaaattttctagtagcctcttcaagaaggtaaaaagaaacagtgaaatgatccattttctttaacccaatatatccaaaacattagcattttgacacatcgttaagaaaaaaattgttaatgagatatttgacattccttttgtcagactaggtctttgaaagctgctgggcgttttatactgagcgcattccaagttggatgcagaagtctcattagatgttaaaggaggcccggggcagtggctcacacctgtaatcccagcacttcaagaggccgaggcaggtggatcacctgaggtcaggagtttgagaccagcctggccaacatggtgaaaccctgtctctactaaaaatacaaaaattagctgggtgtggtggcacgcacctgtaatcccagctacttgggaggctgaggaaggagaatcacttgaatccgggaggcagaggttgcagtgagccgagctcgaaccactgtacttcagcctgggtgacaagagtgaaactccatctcaaaaaaaaaaaaaaaaagatattaaaggaaagaacttttcatacccagcttgttccaaacatacttcagagtttcccaataactgaatggagtaccagtgtttaaatttaagctaattaaaatgaaataaatattttaaatcatgctagccacacttcaggggctcaagagctatgatgtatgtttaatacattggatggtgtgagggtagatagcacccgataagcagcattaagaacatcaaaaatttttattgagcccgggcacggtggctcacacctataatcccagcattttgggaagctgaggtgggaggattgcttcaggccacaagtttgagaccagcgtgggcaacatagtgagactccatctctacagaaaataaatttaaaaatgagcagggcatggtgatgcacctggtgggtagtggtcccagctacttgggaggctgaggtgggaggatcatttgagcctgggggtttgagactgcagtgagccaagatcatgccactgcactctagtctgggcaacagagcaagacctgtctcaaaaaaaaaaaaaaaaatatatatatatatatatatatagactctatgtgacacaccagctcccttgccttctgccatgagtagaagctttttgcaccatgcttcttgtacagcctgcagaactgtgagctaaataaacctcttttctttataaattaatatatataatatatatttattgagtgaacaaatgaatataaagtcttttttttctttttttttttctttttgagatagagtcttgctctgttgcccaggctggagtgcagtggcgcgatctcggctcactgcaagctcagcctcccgggttcacgccattctcctgcctcagcctctcgagtagctaggactatagtagctgggtctgcaaccacacccagctaattttttgtatttttagtagagacggggtttcaccatgttagccaggatggtctcgatctcctgacctcgtgatccgcacaccttggcctcccaaagtgctaggatcacaggcgtaagccaccacgcccagctttttttttttttttttttttttttagatggagtcacgctctgtcgcccaggctggagtgcagtggcacaatctcagctcactgcaacctccacctcccgggttcaagcgattcctctgcttcagcctcccgagcagctgggaccacaggcgtgtgccaccatgcctggctaatttttgtgtttttagtagagacagggtttcctgagtatccggcactagaggtacccaccaccacgcatgccatcacgcctggctaatttttctgtatttttagtggagacggggtttcaccatgttggccaggctggtctcgaactcctgacctcaggcaatcctcccgcctcgtcctcccaaagtgctgggattacatgcatgaaccaccacacctggccccgttcattgattttctaggattatgtgagttaataggtataaaagactaaagacagtttgttgctgtcacatataaaccttttaataagtgctggctgcaaaaaacatttgactctgatgaggcctttctcccatcgtgctctcattttcctgcctgtgaaatggaaggattgtcccagatgattttgagtcctccttcgaacttgatcgttctgcagttgtatttatttaatggaaattttccgtttcctctgtgtgtcgccctctccatgaggcaggtgttcctgtgaaggacctccttgcacacatctttccccagtcttcatcgtccacacttaaaatgcccaactcactctcttcctctgtcctccagggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaagtaagtcattcccagctggggacctggggtgggggtaggagcaaggggtctcagggtgtggggttaccaaagatgctgaccagcaccaccttttaagtccttcaggattttcaagtcatcaaaatctgggcacttcggttgatgcctcaaaactaaagtatatcaggattactgtggttgcaagtgacagaaattgactctgattcgtttatgcaacaaataaagtgatatgatttactagaaagatacacagacatccagggcaagaagaacaatgaggacttatgatggaataaggcagaaatagggaaagtgtcagacccaagacaactttcctctccatctctgcttggccatttgatgtcttgaattcactattttattttatttcattttatttttgagacagggtcttgctctgtcacccaggctggagtgcagtggcgagatcatggctcactgcagcttcgacctcctgggctcaagcaatcctcttgcctcagccttttgagtaagctggggcaacaggcatgcaccatcgtgcctggctaatttttaattatttttttttttgtagagacagggatcttgctatattgcccaggctggtctcaaactcctgagctcaagcaatcctccaactactgggttcaagtgatcctcctatctcagcctcccgaagtgctgggattacgtgtatgagccactgcatccagcctatcctaacacatcgggtttttgttgttttttgtttgttttgtttattcttgagacagggtttcactctgtcgtccaggctggagtgcagtggtgcaatcacagctcactgcagccttgacctcctgggctcaagcaatcctcccagctcagcctcccaagtagctgggactacaggcacgcaccactgggcctgacaaatttttttttttttttttttttttttttttttttttttttagagatagggtttcgcttttttgctcggggtggtctccaaatcctgggctcaagtgatccttccacctcagcctcccaaagtgctgggattatgggtatgagccactgcacctagcctatccaagcactttgggtggctgaggcgggaggattgcttgaagccatgagttcgagaccagcctgggcaacatagcaaaagcctgtctctatcaaaaaataaattagccgggcatggtgacatgcatctgtagtcccagctacttgggaggttgaggtgggtggattgcttgagcccaggaggttgaggctgtagtggcccattattgtaccactgcactccagcctgggtgacagactgagacccctctaaaaaaaaaatgtggcctacgtgcagaggttccaccctgtgggacccacatgcctccctcacactgtcttggcacattctcccaaagctgccggagtctcatttgtccaatatgaagaagcccgtggaagaagggacactaccctacccgatatttgcagccattgacaatgacctgcaaccttcctggcaggaggcaagagcaccaggtaagcaaacatttagagggagggagaggtagtaagggatggaacagcacggagtggaatggaagaatgtttccctgccctccccttggggagcccaggaagagggaagggctcaggattgcagaaaacagggtgctcagcttagacgagagaagagggaagtcccagaagtgaccagaggacatgcacttgctttgcatggatcaagaaaacctttaagaggccaacatggtggctcacgcttgtaatcccagtggtttgggaggctgaggtgggaggatcgcctgaaaccagaagttggagaccaccctgggcaacatagtgagatcccatctcaaaacaacaacattaaaaaacaaaacaaaacaaaaaaacacaataaattagccaagcatggtggcaggaacctgaagaatctacccaggagactggggcaggaggatcactggagcccaggaattcaaggcttcggtgagctgtgattgcaccattgtactacagcctgagtgacaaagtgagaccctgtccccccaaaaagaagaaagaaaaaagaaaacagaggagaggagggacaaaagacaaaaaggggccgggcgcagtggctcacgcctgtaatcccaggactttgggaggccgaggcgggtggatcacgaggtcaggagatcaagaccatcctgactaacacagtgaaaccccgtctctactaaaaatacaaaaaattagctgggcgtggcggcgggcgcctgtagtcccagctgctcgggaggctgaggcaggagaatggcatgaacccgggaggcggaggttgcagtgagctgagatcgcgccacagcactccagcctgggcgacagagcaagactccgtctcaaaaaaaaaaaaaaaaaaagaaaaaagaaaaaagtaaagaaaactgtaataagggatgtttgaaggatggcggggtgggtgggtggggctgtctctcacttttttttttttttttgagacggagtttctctcttgttgcccaggttagagtgcaatggcacgatctcggctcaccacaacctccgcctcccaggttcaagcgattctcctgccccagcctcccgagtagctgggattacaggcatgcgccatcacgcccagcgaattttgtatttttagtagagacgtggtttctccctgttggtcaggctggtctcgaactcctgacctcaggtgatccacccgcctcggcctcccaaagtgctgggattacaggcatgagccaccgcacccggccatctctcactttttagatgtcttccttctccataggtccgattatcacccaaatgctggcagctctccagacattccagtttctcttttgagctcatctctctcctgagatccagacctccttaccctatttcctaagcataaaatgcactcacttgttcagcaactgtgtcctggtaagttctcacgatacatcaggcaatgttaccagttacctgtggttgggcgtctcctggcatctcaaggctcagaagcccccagtgtgaatggtgtttgtctgtttgtttgtttgagacagagttttgctcttgttgcccaggctggagtgtaatggcacgatctcggctcactgcaacctctgcctcccaggttcaagtgattctcctgcctcagcctcccaagtagctgggattataggcatgcgccaccacgcctggctaatttttgtatttttagtagggatggggtgtcaccatgttaatcaggctggtctcgaactcctgaccttaggtgatccactcacctccgcctcccaaagtgctgggattacagacgtgagccaccacgcccggccatgaatgttttatctctctcctcggtgtggatccttgtgctgttttctcaccagagcagatacagctgactccgtcctttccataagccccacaaattcagtcattcccagacctagaaatcaccccctcctcattttcatcctttgtgctcttctacatcacccccagaccaggtctcccagtctcctgggagactcttgtaattagttcctcactggcccgcccatcccaagctgtccacctccttccctggctacctgatggaagtttccaggatgaaaatctgatcatgtcattttcttccctggaatattctaatgactcacattggaatcatgcattagatttatgcccacagacaatcctccatgcaatcgtgtggctacactcttcccttgcactccaggattccatggagttgcagccacaatgagatggaagagagaggcagggctgagggttcaagctctggaaaatattggaaacaggctgctgtggaagttatgagctgccaccagcagcgtagactcaggtctgaggatgagatccccagtggtttctgataccacacagtccatctctaacattctcctgtcatggttgtaattcctcattaatagatttctttttcctgcatacccgctacattcctggttctgtgctgggactcacttgccgttgtatttcctctgcagagacctggttcgagttcacccctcaccacgctggcttctctgcactgggggcctttgtttccataacccacttcggaagcaaattcaagaagggaagactggtcagaactcaccctgagagagacctgactttcctgagaggtcagcgctggggtcagaggggattaaaagggggtgggaagtggaggagaggcaagaattttccttctgagggtctagtttgcccagctcttaaatttcttgggggaaagaaaaggacttggtaggcttccagaaagaggaatggtgtattccttctgctgagtcttcagtgtctctcaaaggtctccttaatgcggcagatacctgatatcctatcaaacaatccaggagagggagcttaatagaggggctcaagtccagggctgtggcttccaataagcagattcagaatgtgtttgggattacatggtgctttgggaggctgacctgggaggatcccttgagactgggagtttgagaccaacctcggcaacatagcaacactgtgtctctacacaagatttaaaaattagccaggcattgtggcatgtgcctgtggtcccagctactcaggaggctgaggcagtggaaggatcacttcagcatgggagttcaaggctgcagtgagttatgatcgccccactgcactccagcctggatgacagagaaagatcttgtctcaaaacaaacaaacaaacaaacaaacaaacaaaaaactagaatgtgttttgggcaccagcaaagcaaggggcatacaattttttttaaatggggtatttccagaaaaaattacaacaaaaaccaaaaacaaaacagtcatagtgagtaaaatcagaacttgattaaatgtccttgactgtagcttacacactggtatcacttttagttgtggcttcataatcttctcagcattcagggtctgaaggcattaccctgctgggcagacagctcccctacataggaccaaccatgccagcttgagaaagtcattaatgttacctgagcctcgtttttctcatagggaaagtacttacctcaaaatgtgggtgtgagagttaggtatgatccacaaataaaacactcagcccagtgtccagcacatggtaggaaattaaggatggttgactctccatgattttagcatacacttttgagacacactaggagcctgatactattttaaatgcaggggattcagtcatgagcaggacagtgaaggctcattccctaatgaagtttgcactccagggaaggagatgatgaatgaacacacacaaaaataagtatgtattataatgtcagatcatagtaaatgctatcttgaaaaataattcatggtaagggactggagagtgactacagtattatttttaattggtggtcagagcttctgacaggagatggcctttgagcatggacctgatgaaaagtgaagccatgcagatatcttagaggaaaagcatcatggacagagggaagagcaaatgcagagaccctgtattagtccgttttcatactactataaagatactacccgagactgggtaatttgtagacaaaggaggtttaattgactcacagtttcacatggctggggaggcctcaggaaacttacaatcatggcagaaggtgaaagggaagaaagaaccttcttcaagtggtagcaggagagagaagagcaagccaaagaagagctgcccaacacttatcaaaccatcagatctcgtgagaactcactcgctatcacgagtacagcatggggggatctgcccccatgatctgattacctcccaccaggtctctccctcaacatctggggattacaactcgagagatttgggtggggacataaagcttaaccatatcagaccctaagccaggaccaagtttgtcttactctagaaccaatgagaagaccagtgaggctggagcctcctgaatgaggctgagagagagggctagagaggtaggcagggtccagatcatatgggaccctgaaggacacagatgaagtttagtttggattccaagtgcgataggagagccagggaggcagtttaattagggtggtgaccgattcagtttatatggtaaaacatctcactctctctctctctctctgagcatggattaggggtgggtgtgtaaacttagaagttgggagcagttgagaagctaatggtcctggtgacagataatggcagtttaaggttgggtaccagaatggatatgggagggaagtggatggactctggaaacctggagatggatgaagaagaattacacctggattggatgtggagagtaaggagaatcagagatgacatcaaaggttccagcttctgcaacctggtagatggaggggtgttctcaggggaggagaacaaggtaggatgaaggggatcttccccttttctctggtctggacagacggggtccttcacattgccaagcctggctcctgtctcctatccccaccatctctttgctaaatctggtcttgggcatcagagattttgaaattgtcactcccaggtactccctataacattattatttccttagatgtatgtatcacctactgaagggattctgtacgtgtattttatccctcccctcacacaccagggtgctttttatttattattataaaataaacataacataaaatttgccattttaaccattttaaagtgtcaagtacagtggtataaatacaatacattcataatgttgtgcaaccatcactgccatccatctccataacacttttcatcttgtaaaactggaactctacgcccattgaatactaagtccctgtcaccccctcccttagcccctgacaaccacaatgctaccttctgcctctacgattttgactactctgagtatgacatgtaaatggaatcatgcagtgcttgtctttttgtgtctgtctgatttcactgaggaaaatgacttcgaagttcatccatgttgtaccatgtgtctgaatttcctttctttttatggctgaatcatattccattgtacgaatataccacattttgcttatcaattcatccatcgatggacacatggattgctttcaccttttggctgttgtgaaggaacctgccatgcacatgggtctatgaatatctctttgagaccctgctttcaattcttttgggtatatactcagaggtagaattgctggatcatgtatgtggtaattctacttttaaaattttgaggccaggtgtggtggctaatgcctgtaatcccagcactttgggaggccgaggcgggtggatcacctgaggttgggagttggagaccagcctgaccaacatggtgaaaccccatctctacaaaaaatacaaaattagccgggcatggtggtgcatgcctgtaattccagttactcaggaggctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctcatcaacacttattgttttctggggttttttggataccagccatcctaatgggtgtgtcttttttttttttttttttttttttttgagatggagtctcactctgtctcccaggctggagtgcagttgtgtgatctctgctcactgcaacctcccaggttcaagttattcccctgcctcagcctcccaagtagctgggactataggtgcataccaccaggcctggctaatttttgtattttttagtagagatagggtttcaccatgttagccaggctgactttaaactcctgacttcaattgatccgcccacctcagtctcccaaagtgttagcattacaggcgtgagccaccgtgcctggctgattattcattttttatgtctccctgtatcatatacaaatgtgtttggctaaaagtcactaaccaaccacagtgccccgaggacatgtgggattaattttcttacaaaagaaaaagacagactgagcaccgtgactcacagctgaaatcccagcactgtgggaggccgaggcgggcagatcacttgaggtcaagagttcaagaccagacgggccaacatggtgaaaccccgtctctacttaaaaaatacaaaaattagcagggcgtggtggtgcatgcctgtaatcccagctagtcgggaggctgaagcaggagaatcacttgaatctgggaggcagaggttgcagtgagccgagatcacaccactgcactccagcctgggcaacagagcgagatcccatctcaaaataaataaataatacaaagttaggtggctggtgacattggtttagctgtgcaacattaagcagaaggacccaggtttattctagattttctgctcctccatccttagcatattaagtcaccctcatgctgaactcctccacaccacgggatggcggctgcatccaatgaagctgcaacttttttttttttttttgaagtcagggtctctctctgtcactcaagctgccgtgcaaaagcacagtcatagcccaatacaggtcttgaactcctggcctcaagtgatcttcctgcctcagcctcccaagtagctgagactagagttgcatgccaccatacctggcctgctccttctgagaaggagaacaagcactttgcagaagtccccccagcagtgtgcatggaccagagcttgaccgtcccctagctgcaagggaggctgggaaatatttgcccttcctgcctgtgtgctgagaagggttggcatggacaggagcttgaaatggccttggggtagccagtctacagtgcccggctggctccacccatagaaggttcgtgaggacaaggaccttatctgtcttgtttactgctctattccaacagccagaagagtgccgggtgcccactaattgcttcataaatatttatggaatggaagaaagatctttcttcctgctgcagatccctgcagtgctttatgccagtctgctggtgctttgaatatcaaacatgacagtcacgtgatggagaatgtttgaattttattgctcttttcttggcaggtttatggggaagtgctcttggtaacactgaagtcattagggaatacatttttggtgagtatttggggaacagaaaggtcaaaccctagagatattttatgcaaggagattcacagtacttttcctactcatggcagaagagagacctgtgtgtaattgttctagcaactgcttttcctgacatttattctcatataattgggcagccaggatgaccacagagtggatgagagtacagactcccttggaaggaatgttgctctggtacatgtaagctttgtgacctccgaaaagttacttaacctctctgtgcctcggtttctgcctctgtgccatgcgggtgataataacagtagttatgaatatttgatgagttaattcattgaaagcttgtaggacagtgcctggtagataacggcactcagtaaacattagcaatcattacctggtccctcatttaacatttaacccctttaataccctaagaggcagacgcttttgtcccttccattttgctgagatccaccaagtcgtgggaaggatgcgtgactcacccacactgctggtcagtgagtgcagacgcggggatctataggagaactgggtggtggatctctaggggaatagtgtggtggttctgatccaaagcctgtctgcctggatccacatcccggctctgcttctcctgcactgctcactctggaaagctgcttaaattctctgtgacccaatttccccttcctaaaatggagacaatagtacgtagtcgcagtctcgtatatttgatgtggggtttaaatgacctcatgtatgtaaaatgcttagagccaagcctgacacatgggagtgtttcattacatgttaatcttatttttaggatcattactgagttcacaccctaaaccactcgtcattcatttaatgtatattcatgggacctcctgtgtgccaggcactgtcctagttcttacactttgactttttttgttgtttgtttttttgagacagagttttgctctgttgcccaggctggagtgcagtggtatgatctcagttcactgcaacctccacctcccaggcttaagcaactctcctcccgagtaactgggactacaggcgcgcaccaccgtgcctggctaatttttgtatttttggtagagacaggatttcaccatgttggccaggctggtcttgaactcctgacctcaagtgattcactgcctcagcctcccagtgtgctaggattacaggcataaaccaccacgcccgggctgatgttgttctttgacattggtgttcaccatagcttggttaaaaacaaaactaaaaagggaatctatctatatccaacctccaaatggctaactaaaggtgtgagatgggtctgagtgttacttctccagtgggtctgctaagctttctctctaaaaaacaaaaacaaaattcctgatatgtagtgtttgccaattcctgtggtgtaaatgttcccaccgtggccaacttcaggctaccaacatgaggtcactgagcacagagttggaagagaggtgcaaaattggctctcgagagccattggctgccattggagcccatggctgccatttctattaatgaaatatccctgcaggtcatctgtattttttatattataactagggactttgttgtacagataaacattcctcctgcttctactcttttgcagaccagttaaggaatctgaccctgaaaggtaagcatcctacttcatcatgaatccctgatgataatggggaccgcacacttgcttgaggccagccattgtcctaggaacattacatgtatgattcatttggtgcccatttgaattctttatctggtatttcaaagatttcatcttgatttggatctgttgctggagaggtagtgtgatcttttgggggtgctgtagaaccatgttttgtcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttggatatagggagtcttcgtgtgatggctttctcatatgctggttgtagaagcgatgtgctcactgtgtgagcaagttcactgttgcctacagggctggaatggtagaagactcttgaagcttaactcattccccacaaggcatgcaattttttccccagtattttattgactggtttgatggttcaggcttcaggtctgtaggggagtgcataggaagtgattgtggccaaaacatgtgagtaaatgcaacacccaatggtgagcaaaggtcccagccttgacagaggtggctggaggagctctcagtgagttgcatcgagattttttttttttttttttgagacagagtttggctcttgttgcccaggctggaatacaatggcatgatctcagctcaccccacaacctccgcctcccaggttcaaggaattctcctgccgcagcctcctgagtagctgggattgcaggcacttgccaccatgcccagctaattttgtatttttagtagagatggggtttctccgtgttggtcaggctggtctcgatctcccaacctcaggtgatccgcccacctcggcctcccaaagtgctgggattacagccgtgagccaccatgcctggctgtgcaccgtggtcttatcaggcagaagggttggagccacctcagctcccctgccaggtcagccagaaagccatccatctctcagacacactcgtgatccagtgctccagctattcagatcagacgggcacctcttttcatctgtaggaatgttggtgttctgagtagagaggaactgtgaatctgtctcttatgcaagcctaaacctagaggggctcctcctgtggggatgcagtcgccctgatatgttccagaaaggctgtctatagttgtacccatgctgagctcccatgggagaaaccccaactgtgcctgtggcagtggaagagaggggaaagacatccccttatccaagacccttcatgcacaccagggctgtctgatggttgggttagagctgtgggctttccgtgctgagcccagcactgaaactgtgtccctgctgaaagaaacttcccaccagcagaaagatctgattttcaagtcctgctgtccagattcttttgtcccatggggtgttcccttgatgtggtgcactccccattcccctaggataggagtcactgagcaccagactacagtgagtgttattgttcctctgggtctagccacccagtgaagctgccacacttcaggctggttcttgggaatgtctccaaggaatccggtaatgtcccctgtcctcgagactcccagcaatgggaagcagcaccagctctaatgggggtggcaggagagagacacaggctctgtgagattccttgctgatggacagccttagtaggttggcttccttgaatgctagttatagtagtaatgaactgatcatgtggacagactcaggacctcctggttagccagagtggtgcatgcagtggtgatagctgaggacatagagccattttctccttcctgggcccagtgttatcctaccaggagatgctgtcatggactgtgttggttggcctccacccagcaggtggagcaccagctgcagtagtagcagtgggatattcacttgccctatgttgcccagggtggctactcttgtttctcaggcaatgggcagagccacagagttcccaaaagtttccgtcctttgtattaaagccaccagggcgggtggcagggcaaagccaggtgtgggctgggtcaggcagttttgtgctctaactctccctgtgcagggcaagcagcagctcctgtgggtatcagggggtgggggtggttttcagacccatgtgctgataatccagagaggaatgtttctgcctctgctgcacagaagagtttgtgtagggagtggggagtggcaggtggcagtaagccccacgcggatcccacacacttggcgaggcagatcccctcccaccctgttccactggcagtggtgagctaagttccaggcagcctgtgctcagaacttgcaaatgcccccaagtcataagctttccctgcagagatagcaaccactgctctcaggccatgcccctccccatctatcccacctagccatgtgccagggtcctgcacacgtgtctgcagcttgcttttcattcaccccatgtgggtggagaagttcacctccacccacagttatctcatgaaacccagctgggggcttctttcaacctgcgaccacccacctgaactttttggctgaccactgcagggtgccctgtgaggaacaataaggaatggcttccctgggtccatactgggatctgggagtgcatgcagggttcttcccacagctcctacttatattccacgaacctccccaagtcatatcctgcactgaatagggttaaggccttaccccagagactggactttcaggctccctggtgtggtgggggcgtgtgtcctgcaaacagtctttccccatctcacaccctggggactcgcagcccttcacttgagtcacagtataggctgcagcccgtcacttccttcaaagggactgtggattccttcagatttcctgtctaattcctgaatcacttcttgaaaaaaaagttcacagtgtgaatctctacacagtgttttgtccttccaagtgggaggggtatgccagcaatgcctctaatccaacatgtttgctgtcctgctctttcatagtaggacagctaggactttccagaagtgcccccataaatctgcatgggccagagcttgacctccctctagctgcaagggaggctgggaaatatttgcccttcctgcctgtgggctgagaaacgttggcatggaagggagcttgaaatggccttggggtagccagtctacagtgcccggctggctccacccatagaaggttcctgaggacaaatctgtcttgtttactgctctattccaacagtcagaagagtgccgggtgcccactgattgcttcataaatatttatggaatggaagaatgatctttcttcctgctgcagatccctgcagtgctttatgccagtctgctggtgctttgaatatcaaacatgacagtcatgtgatggagaatgtttgaattttattgctattttcttggcaggtttatggagaagggctgttgctaatgctaaaagcattggacaccttatttttggtgagtatttggggaacagaaaggtcaaagcctagagatattttatgcaaggagattcacagtacttttcctgcatgtggcagaaaagaggcctgtgtataatggttctaacaaccacatttcctgacatttattctcatacactgaacattgattatgggcagccaggaagaccacagagtggatgagagtacagacacccttggaaggaatgttgctgtggtacatgtgagctttgtgacctctgaaaagttacctaacctctctgtgcctcagtttctgcctctgtgccatgtgggtgataataatagtagttatgaggattaaatgagttaattcatcaaaagcacataggacagtgtctggtagataaaggcactcagtaaacattagcaatctggctggatgcagtggctgacacccgtaatcgcaacacttgggaggctaaggcgggcggatcatttgaggccaggagttcaggtttctgatcctggccaacaggtgtgtggagctggtgcctgctacttccaggcctggctacaaaaggccttctgtggctctccagctctctcctctcatggaacagacaaggagaccttgtgccaagaggagaagctcttaaacccaggaggcggaggttgcagtgagctgagatcacaccattgcactccagcctgggcaacaagatgcaagcagcctggcccggcgcagtggctcatgcctgtaatcccagcactttgggaggcccaggcggacagatcacttgaggtcaggggttcgagtgcaagctgggtaacatggtgaaaatgcgtctctactaaaaatacaaaaattagccaagtatggtggtgcacgcctgtgatcccagctactcaggaggttgaggcacaagaatcgcttgaaaccaggaggcaaaggctgcagtgagctaagatcacaccactacagtccagtctgggcaacagagcaagactccatcacacacacacacacacacacacacacacacacacacacacacaaaattggcattcgttacctgttcatcatttaaccctttgaatgacctgaagaagtggatgctgttgtcccctccattttgctgagagccaccgggtcatggaaaggatgcgtgactcacctatgtaactggttggtgagtgcagacacagggatctataggggaatcgtatggtggttctgatccaaagcctgtctgcctgaatccacatcccagctccacctctcatgcgttagtgaccctagaaagctgcttaaattctctgtgaaaaaaattaaaaaataaagaaatgaggggccgggcgcagtggctcacacctgtaatctcagcactttgggaggctgaggtgggcagatcacctgaggtcaggagtttgagaccagcctgaccaacgtggagaaaccccatctctactaaaaatacaaaattagccgggcgtggtggtacatgcctgtaatcccagctacacgggaagctgaggcaggagaatcgcttgaacccaggaggtggaggttgcagtgagctgagatcacaccattgcactccagcctgggcaacaagagtgaaacacagtctcaaaaaaaaaaaaagaaaaaagaaaaagaaaaagaaaaaaaagaaatgaaacaaacaaaaaaaaaaaaaaaaagaaaagaaaatcaacaacaacaacaaaattctctgtgacccaatttctcctttgtaaaatggatacaatagtgcatagccccaatcttgtatatttatatcaaataaatgtaaatatacatcaaatatacaagattgggactatgtactatttgatgtggggtttaaatgacctcatgtatgtaaagtacttagagcaaagcttgacacatgggagtgtcctcttaaatgtcaatattatttttattatgtcttgtattgttagaaaaagcaagccagggccaggcgcggtggctcacgcctgtaatcccagcactttgtgggggccgaggcgggtggatcaccaggtcaggagatcgagaccatcctggctaacatggtgaaactccgtctctactaaaaaatacaaaaaattagccgggcgtagtggcgggcgcctgtagtcccagctactcgggaggctgaggcaggagaatggcgtgaacctgggaggcagagtttgcggtgagccaagatcgagccactgcactccagcctgggcgacagagcgagactccgtctcaaaaaaaaaaaaaaaagaaagaaagaaaaagcaagccgggcacagtggctcacgcctgtaatcccagcactttgggaggttgaggtgggtggatcacttgaggtcaggagtccgagaccagcccagccaacatggtgaaacctcgtttctactaaaaatataaaaattaactgggcatggtggcgggcgcctgtaaccccagctactcgggaggctgaagcaggggaattgctcgaacccgggaggcaggggttgcagtgagccgagatcgcaccactatactccaggctgggcaacagatcgagactgtgtctcaaaaaaaaaaaaaaaaaaaaagaaagaaagaaagaaaaagaaaaaaaagcagacaaaatttatttattgacaattcaaaaatttgaaaaagatgaagcagaagcttgacctaaccgacgtgtatcaggacttagctttctatcgcattttcagcacatgtggaaaaattgaattttgatttggtctcaagtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtagtccacccatcagtgtatgttttagagtatgttgcattcaatatgtagttttttggttttgttttttgtgacagtctcactctgttgcccaggctggagtgcagtagcaagatctcgtctcactgcaacctctgtatcctgggttcaagtgcttctcctgcctcagcctccctagtaggtggaattacaggcacgtaccaccatgcccggctaatttttatatttttagtagagatgaggttttgccatgttggtcaggctggtctcgaacttctgagctcaagcaatctgcccgcctcagcctcccaaagtgctgggattacaggcatgagccaccacacctggccccaatgtgtagtgtttttttgtttttgttcttgttttttgagacggaatttcactcttgttgcccaggctggagtgcaatggagcgatctctgctcaccgcaacctccacctcctgggttcaagccattctcctgcctcaacctcccgagtagctgggattacaggcatgcaccaccatgcctggctaattttgtatttttttagtacagacagggtttctccatgttgctcagactggtctcgaactcctgaccgaaggtgatccacctgcctcggcctcccaaagtgccgggattacaggcatgacccaccactcctggccccaatgtgtagttttttatccccacctccctaccctcctctttctgaatctctgaagtccgttatgccactctgtatgcctttgcgtacccatagcttagctcccacttataagtgagaacatatggtttttggttttacattcctgagttactttacttagaatgatggcctccatccaagtttctgcaaaagacattattttattcttttttatggctgagtcatattccatggtgtttatataccacatattctgtatccactcatttgtcaatgggcacttaggtgggttcatatcttttttttttttttgagacagtctcactctgtcacccaagctggagtgcagtggcgcgatctcggctcaccgcaagctccgcctcccaggttcacgccattctcctggcccagcctcctgagtagctgggactacaggcacccaccactgcgcccagctaattttttttttttttttttttttgtatttttagtagagaccggtgttagccaggatagtctcgatctcctgacctcatgatccacccgcctcagcctcccaaagtgctgggattacaggcatgagccaccatgctcggctggttccatatctttcaattgtgaattgtgctgctataaacatacatgtgcatgtgtcttttttttttttttttgaggcagagtctcgctctgttgcccaggctggaatgcagtggtgcaatctcactgcaacctccaactcgtgggttcaagtgattctcctgcctcagcctcccaagtagctgggactacagatgtgcaccaccgcatccagctaatttttgtatttttagtagagatggggtttcaccatgttggccaggctggtcttgaacgcctgacctcgagtgatctcccctcctcagcctcccaaagtgttgggattacaggcgtgagccactgcacccagcccacaagtgtctttttcatataatggctgcctttcctttgggtagatacccagtagtgggattgctggatcgaacggtagatctacttttagttctctgaggactctccatactgttttccatagaggttgtactaatttacattcccaccagcagtgtgtgagtgttccatttgcaccgcatccacaccaacgtctatggttttttttgaatttttatcaatggccattcttgtgggagtaagatggtatctcattgtggctttcatttgcgtttctttaatgattagtgatgctgaccatttttttcatatgtttcttggccactggaatatcttcttttgagaaatgtctattcatatcattgggatgcttttcggtgggattattcgttttcttcttgctgatttctttgagttccttataggttctgtataatcgtcttttgtggatgcctagtttgcaaatatttgctcgcattcagtgggttgtgtgtttactctgataattacttcctttgctgtacagaagctttttaatttactcaggtcccatatatttgtttatttttgagacggagtctcactccatcacccaggcttcagtgcagcagcacgatctcggctcactgcaatctccgcctcccagactcaagcaattctcctgcctcagcctcctgagtagctgggattacaggcatccaacaccatacctggccaatttttgtatttttaatagagatggggtttcgtcatgttggtctggaactcctgacctgaagatccgcccagctgggcctcccagagtgccaggattacaggcgtgagccatcgttcccatatatccatatgtttatttttgtttttgttgcatttgcttttgggctcttggtcatgaactcgttgcctaagccaacatctagaagagtttttttgatgttatcttctagaatttttatggtttctggtcttatatttaagtctttgatgcaaattcacattgaatttgtgagttgatttttgtataaggtgagaaataaggatcgagtttcattctcctacatgtggcttgccagttatcccagcaccatttgttgaataaggtgtcctttcccccactttatgtttttgtttgctttgtcgaagatcacttggctataagtatttggctttatttctgggctctctattctgttccattgttctacatgcctaattttataccagtaccgtgctgttttggtaactataggcttgtagtataatttgattgggtaatgtgatgcctccagatttgttctttttgcttagtctttgctttggctatgagggctcttttttggttcatatggattttgggattgtggctgggcatggtagctcacgtctgtaatcccagcactttgggaggccaaggcgggtggatcacctgaggtcaggagtttgagaccagcctggccaacatggcgaaaccccatctctactacaaatacaaaaattagccaggcatggtgcatgcgcctgtaatcccagctacttgggaggctgagacaggagaatcgcttgaacttgggaagcagaggttgcagtgagccaaaattggccattgcactccagcctgggcaacagagcgagactaagtctcaaaaaaaaaaaaaaaaaggattttaggattttttgttctgtgaaaaatgatagtattttgatgggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgtttgtgtacattgattttgtatcctgaaactctactgaattcattcatcagacctaggagctttttggatgagtctttagggttttctaggtgtacaatcatatcatcagtgaacactaacagtttgacttcctctttactggtttggatacccttcatttctttctcttgtctgatggctgtggctaggacttccagtactatgttgaatacaagtgataagagtgggcattcttgtcttattgcagttctcagggggaatgctttaaacttttccctgttcagtgtaatgttggctgtgggtttgtcatagatggcttttattacattgaagtatgtctcttgtataccgattttgttgagggctttaatcataaagggatgtgggattttgtgaaatgcttctgcatctcctatgatttttgtttttaattctgtttctgtgatatatcacatttgttgacttgcatatgttaagccatccctgcattcctagtatgaaacccacttgatcacatcatggcaaatttcaagctaccaacatgaggtcaccgagcacagagttggaagacgggtacaaaattagctctccagaacccgtatcaacagactccaacccatggctgccatttctattaaagagacgtcgctgcaggtaatctgtattttctataactagtgactttacagttaaacattccccctgcctctgctcttttgcagcccgattactgaggctgcaagaaagttcacaaggggaacatcctcccccagaaggtaagcatcctactttgccatgaatccctaatgatagtgtggactgcacactggcttgaagccagccattgtcctaaaaactttacgtgtctgattcatgtggtgctcctttgggaatggagaggagcatggactctcccaggtgcctgaggccacgcagccaggaggggcaggatcggagttcaaactgacactctgtgaaaaatgatagtattttgataggaattacactggacttgtagattgcttttggcagtatggtcattttcacaatattgattctacccatccatgagcatgggatgtgtttccatttgtttgtgtcatctatgatttctttcagcagtgttttgtagttttccttgtagcagtctttcacctccttggttaggtatattcctgagtattttattttatttttttgcagctgttgtaaaaggggttgagttcttgatttgaatctcagcttggtcattgttggtgtatagcagtgctactgatttgtgtacattgattttgtatcctgaaactctactgaattcattcattagacctaggagctttttggatgagtctaaccataggatccatgtacatagtcgtcagatataccctaggtatgcctaggatccaagtgtcagaggcagaaaatgggaacagcctgaggcaattagcaaattgagaggaaaaatacttcccaaaactacataggttgggagtcatgaaggaatcagacttgacccatggtgggagtacggagaacaagaacaaagtatcagatgaattctgtatggagaagttagattatattatggaggagactatatttgttcaggagaggctatgctgcgcaaagaaaccacaaattgctatagcttaagacacaaagggtttatattttgcttacccaaaaagcgatatgggttgagtgttcctccagggcaacttggctccatgtggggacttaggcatccaagctgtttgcgtcttttttttcctttccttttcttttttcttttttttttttggagacagagtctagccgtgtcacccaggctagagtgcagtggcataatctcagctcactgcaacctctgccttccaggttcaagctattctcctgccccagactcctgaatagctgggattacaggcaactgccaccacacctggctaatttttgtatttttagtagagacgagttttcactacattacccaggctactctcgaactcctgacctcaagtgatctgcctgcctgggcctcccaaagtgctgggattacaggtgtgagccaccgcgctgggccaagctgcttgcatctcgttgcttctcctcttggcacaaggtctccttgtctgttccatgagaggagagagctggagtgccacagaaggccttttgtagccaggcctggaagtattgggcaccagctccacacacctcctgttggccaggatcagtcacatggccccaacctaactacagcagaggctgacaaagatggtcttccttccagttgtggaagatgcaagtgtggctttttcacaggtcaacagtcaggtacagagtgaaggtaggtcctgagcacagcccttcatccacttcatgcctccctccctgttttagttgtgaaggctgccagaacaaagtgccatacataggctggctggcttagcaacaacagagattaatttctcagttctggaggctggaagcccaagatcagagtaccagtagggttggattctggggaaccctcttctgggttgcagagagccaacttcttgccacatggcgggctttaatgttgttttttgacatcagcattcaccatatgctggttatagacaagtctggaaggagaatctatctccaacctgcaaatggctaactaatgttgtgggatggtaggctggtgattgtaccactgcactccagcctggtgacagagcgacaacctgtctcaacaacaacaacaacaaaaaagaaatggcaaccccaaggtgatggtattaagagatggggcctttgggaggtgttgagaccatgagggtggagccctctagatttggattaatcccttataaaagaagcctcagagagctcactccaaggaatgcggtgaaggttgaagggtagaatttatgcaaaatgccaagatgagcctggcaggtgacgttctcagcaaacgtgagcagagctattatcagtgtgtgtgtgtgagagagagagagttgaacatcatctaattcatgagtgtggataaaaataagaggggatgccaggcatgatagctcaatgcctgtaatcccagcactttgggaggctgaggggggtggatcacttgaggtcaggagttcgagaccagcctggccaacatggtaaaaccccatcagtactaaaaatacaaaaattagccgggcctggtggtggtgcgtgcctgtagtcccagatactccagaggctgagccaggggaatttcttgaaactgggaggcagaggttgcagtgagctgagattgccccattgcactccagcctgggcaacagagcaatactctgtctcaaataaataaataaataaataaataaataaataaataaataaataaatgggagactttgcctccaaccctgaagaaaataagcgtgcaaaagatgagtagaggtggaggcagagatgaaggagctagaaaaaagaggccagaaagtcagagagagtgaggtaacatgggggtcagcagaaggcaaggggagagagggtcacctggagaaggaggtcacctcaggaggaaccgcagggcattgcagaagatgaggcagagcagggtctgtgatgttcttggtagggtacttggacagtgtctgagaccacctggatttcttgacgtagatgaaggcggtgagcctgaacacacctggctgactgagatgctcgagaattggaccaggacctccctggaaaagcaggagcagccccatgaggaccccgaaaggaaaggtaccatgtgtagtgtgataagtgtcatcaacagtaagtgccaccaaccttctcccccctcttgctcttccccacccctgtgggccagtcctgcaggggacatgaccagatgtcccactggtacagtttggatatttgttcccttccacatctcatgttggaatgtaatcccccaatgtaaattagttcaaccattgtaggagacagtgtggaattcctcaaggatctagatccagaaatactatttggcccagcaatcccattactgggtatatgcccaaaggaatgtaaatcattctgttagaaagatacaggcacatgtatgttcactgcagcactattcacaatatcaaagacatggaatcaacccaaatgcccatcagtgatagactggataaagaaaatgtggtacatatacaccatggaatactatgcagccagaaaaaggaacaagatcatgtcctctgcagggatatgggtggagctggaagtcattatcctcagcaaactattgcaggaacagaaaaccaaacaccacatgttctcacttataagtgggagctgaatgatgagaacacatggacgcagggaggggaacaacacacactggggcctgttgggggcgggtggggagaagaagagcaccaggaaaattagctaatgcatgtggggcttaatacctatgtgatgggttgataggtgcagcaaaccgccatggcacatgtttacctgtgtaacaaatctacacgtcctgcacatgtgtcccggaacttaaaattaaattaaattaaattaaattaaaagaaaaagaaatgtaatccccagtgttggaggtggggcctggtgggaggtgattggatcatgggggcggatccctcatgaatggcttagcgtcatcctcttggtgattagtaagtgcttgctctgagttcatgtgagatacggttgtttagaagtgtgtggcaccttccccctcgctctcttgctcctgctctcggcaagtgatgtgcctgctccccattcactttccatcatgattggaagcttcctgaggccccaccagaagcagatgccagcaccacgcttcctgtacagcatccagaactgtgagacaattaaacctcttttctttataaattatccaacctcaggtacttctttatagtaatgcaagaatggactgatacgcccaccctctatccacccaaccggccatccatccatctaggatgtcttgagtcattagcatgaaataataactctcctactagcaggctgggggtaggggtgacaaaggggaaatgtcagaccaagtgcctgcctggaggactcatggtctagaggacgagatggagaatagacaggtaagccaaccacaggcaagtccatccccgactgggctaatttctatggagagggctgggtgcagtggctcacacctgtaatcccagcactttgggaggctgaggcaggaagatcacttgagcccaggagttcaaaaccagcttgggcaacatagcaagaccccatctctacaaaattttttgtaaaaaattagctggacatggtagtgcgttcccatggtcccagctactcaggaggctgaggcaggaggatcacttgagcccaagaggtcgaggctgtagtgaactatgattgtgccactgcattccagcctgggtgacagagcaagaccctgtctcgaaaaaataataaataagtaaattatatggagagacaaggagaggcgagagcaggtatccggtgaaaaattctgagagtgaagtagcgtggatgagggacaatgaagacagttggtcgctgaagccactgccttcctgagatgacccaggtacagccagtctcacccccagacatccaacctctcacctctgtgatgacccggtgtccaggcacagacacacccagagtcctcctgaccagctcatcagcagctcaccaaggaaaggaaatcaaggtgtactctcttcagactctagatttcccttcctcctccttttattcatgttacataaattcctgtttttatctctgttggatgaaatcagtctattctctggtttcctttgtctacaatttaaagagggagccgactattaacttgatgtctctgagctattgttggccaagctccccttagatgggattaatgaagaagcctccttttccaaggtgatagctcagaagcaacttgaagaatgagtgacaatgagcctaccaagtggaaatgtggggaaagtcagccagagttcatctactgacttcagtctggcagatgagaggcttgggtttacccctccggtgggtaatggagagagatggaatgtgccacacgaagcctcactatgactttctataatgcctggctcctgtgctgaaatgagaacatgcatcctagccggccatggtggtgcgtgcacctgtagtcccagctattcggggaggctgaggtgggaggattccttaagcccaggagttggaggctgcagtgagctatgaatgcaccactgcactcagagtgagacccccatcccttaaaaagttttcttttaaagaacgtacttttttttgttttgttttttgtttttgtttgtttgtttgagatggagtctcgctctgtcacccaagctggagtgcggtggtgcaatcttggctcactgcaacctctgcctcccgggttcaagcgattctcctgcctcagcctcccgagtagctgggaccacaggcatgcaccaccacacccggctaatttttgtaattttagtagagacagggtttcatcatattggccaggctggtcttgaactcctgaccttgtgatccgcccacctcaggctcccaaagtgctgggattacagatgtgagccactgtgcccggccaattcttaacttactataagatatacttgagcccaggtattcaagactagcctggaaaacactgtgagacctcatcttttttaaacaaaattaataaatagataaaacatttaaaaaagccaggtgtgatggctcacgcctgtagtcccagctactcaggaggctgaggcgggagggtcgcttgaggccaggagttcaagaccagcaagcctgggcaacgtagtgagacctcctctctaaaataaataaataaaaatataagatagaatggccgggtgtggtggctcatggctttaatcccagcactttgagaggccaaggtgggcggatcgcttgaggtcaggagcttgagaccagcctggccaacatggcaaactctgtctctactaaaaatgcaaaaatacaaaattcgccgggcgtggtggcacatgcctgtaatcctagctacttgggaggctgaggcaggagaatcgcttgaacccgggaggcggaggttgcagtgagctgagatcacgccattgcactccagcctgggcaacaagagtgaaactctgtctcaaaaaaaaagaaagtatggagtcctcaggccacatttagttttctttaacatgttaaatattaaagggctatcaaagcaatgtaggtgtgatttgcttttctgctgctaaactcttgtagaagttaatatttattaagtgcctactatttgctggatgtgttaggtttcttcagagaaacagagccaataagatatctatctatctatatctacctatctatgtctctgtctgcccaaatctatgcatctatatctatgtatttatagctatctatctctatctatctaactagagatatttattttaacaaattggctcatgggattgtgaagatgacaagtccaaaatccatggggcaggccaacaggccggaaaccgagacaggattttttaaaatttaatttaatttaaagtttgaggatacatgtgcaggacatgcaggtttgttacccaggtaaacgtatgccatggtggtttgctgcacttatcaacccatcacctagatattaagccccacatgcattagctgtttaccctgatgttttccctcccaccgccccctcaacaggccccagtgtgtgttgttcccctccctgtgtccatatattctcatcattcagctgccacttataagtgagaacatgtggtgtttggttttctgttcctgcattagtttgctgaggataatggcttccagctccatccctgtccctgcaaaggacatgatcttgttcctttttctggctgcatagtattccatggtgtatatgtgccacattttccttatccagtctaccattgatgggtatatttggttgattccatgtctttgctattgtgaatagtgctgcaatgagcatacgcatgcatgaggcagaatttgacgctccagtctggaggtagaatttcttcttctctagaaactgttttgccctcaaagccttcaactgagtagatgagacccacccacattactgagaataatcttcttgaagtcaactgattttagctgtcaaccacatctacaaaataccttcacagccacatctaggctagtgtttgattaaataactggttactgtggcccagcctagttgacatgttaaaccatcctcccaacatcctaagtgctataggcaggctcttacttattcttcataaatctataagggataggtgttactctcttcctggttttacagatgagaacagagatgttaagtaacttgctcaggggcccggtgcagtggctcatgtttgtaatcctagcactttgggaggccgaggtgggaggatcacctgaggtcaggagttcgagaccagcctgaccaacatagcgaaaccccgtctctactacaaatacaaaaaaatatttagccgggcgtagtggtgggtgcctgtggtcctagctatttgggaggctgaggcaggagaatcacttgagcgcaggaggcggaggttgcagtgagccgagattgcaccactgcactacagcctgggtgacagagcaagactgtctcaagaaaaaataaataaataaaagtaacttgctcagggtcacacagctaatgagtgatgaagtcaaattcaaatcagcatctagctcaagcacccacctccctactagctttgctctcttgccactctgcccctgctgttcagagaaaggattggagctgaaaaaccaggaagagggaaatcagagggggaggcagtgttgcatcctggatggaaaagatgctgcataaggtactggcagatgagattgggaggagcagagacactgaagaggaggtggaattggcaggtcttggtgatagtccagggtgagggtgaggaagaggcaggcgtctgggataatgacctggtttatccctgactgacttggcagcctcttgggctggggaagggagcacgggaaagtgtgctgggcattttggaacagctcctggaacattctgcgtcgttctcccccatgaacctaaagagaacaagctcatttccccagatacacaggtgatcatacagtcattaaatcgccatcttttccttgccaactcccccaaccccaatggctcaaagtcatctcacctgtggctcaatgatagatgctggatctgacggccaggacccccaggcccctgtatgccaacctttcccagctcaccagatttgtcagctctgctgccctaacaaaagttgaagtggggtggcttcaactataggcttttatttcctcaccgtttttttttttttttttgagatggggtttcaccatgttgcccaggctggtctcgaacccctgacctcaagtgacccacccacctgggcctcccagagtgctggaattacagatgtgagtcactgtgcccagccttattttcttacaattctgcaggcaggaagtccaagatcaaggtgccagtggggtcagtttctcctgaggcctctctccatggcttgcagagggatggccgccttctcaccgcatcctctcagcccagcctttcctcagtgcacacgcattcttggtattcttggtgtcttcctttttttcttttttttttttttttagatacaaggtctcccttgtatctaaatgatctgagtgatacaagtgaggctggaatgcccaggctggagtgcagtggcacaatcatacatagttcacttcagccttgaactactgggttcaagtgatcctcctgcctcagccttctgaatagctgggaccacaggcatgcattaatatgcccagctaatttgtttattttattttatttttgtaaagatgcggtctcgctctcttgcccaagctggtctcaaacttctgggctcaagcaatcctcccacctcggcttccctaagtcctgggattactctggtgcctggcactctttctcttctcataaagaccccagtcctattgaattaggatcccactctcatgacctcagttatcctgaatgacccccccacttttttttttttttttttttttgagatggagtctcgctccgtcatcaggctggagttcagtggcacgatctcggctcacttcagcctctgcctcccaggttcaagcgattctcctgcctcagcctccccagtagctgggactacaggcatgcgccaccaccacgcccagctaatttttgtatttttagtagagacagggtttcaccatgttggccaggatggtctcgatctcttgatatggtgatccttctgcctcggcctcccaaagtgctgggatgactggcgtgagccaacgcgccggccctgaatgacctctttaaaagtcctgtctccagatacaaccccatgggggatgagggcttccacatatgactttggtgggggcagaaaccactcagtctcctgaactcaccttggctgtctcggcttctttccctaggctcactcagtaacttgatggattttgtgaagaaaacaggcatttgcgcttcaaagtgggaatgggggaccactcacaacttcctgtacaaacacggtgagaagaccctcttcccaccgccctggtctgtccttgcgtgtgaatgggctggagtaggggaagggggtgggcctgaaacaatcccaggctggtccttccccagagctttggaggggggtggtgtcaaagtgcccagggatctgattaggggaactttcgctcagtggtgtggtccatactgaaaaatgtgtggcctcgctgcgagtcccagtcatcgtgaaaagcctcactgatggctttctctggttttgcaaaaatgcaaaaaaccctaatttcttgtcagctagtcctaggacctggtcttcaaaaacacttgtatgggctgggcgcagtggctcatgcctgtaatcccagcactttgggaggctgaggcgggcggatcacttgaggtcaggagttcaagactagcttggccaacatggtaaaaccctgtccctactaaaaatacaaaaattagccggacagggtggcgggtgcctgtagtcccagctactcaggaggctgaggcaggagaatcgtttgaacccaggaggcagaggttgcagtgagccgcgatcatcccactgcactccagcctggcaacagagcgagacaccatctaaaaaaaaaaaaaacaacacacatttgtatgggttttcccttcaggggactgaccctctcattcaggtggaattgatgtcagactcctgggaactcacactgaggccatttaatagtctccataagctccaatgttcatagctggtggagatcctctcctatgaccatgccaatccctgcaccactcatgtatgtgtatgtgtgtgtgtgtgtgtgtgtgtgtgtgtgtcttgctctgttgcccaggtgggaatgcagtggtgcaatcatggctcactgcagcctcagcctccccagctcaagcaatcctcccatttcagcctcccgaatagctgggaacacaggcacacagcaccatgcctggctaatttttctttttctttttcatagagatggggtctcactatgttgcccagactgatcttgaacccctgggctcaagcgatcctcccacctcagcctcccaaagtgctgggattacaggtgtgagccaccccacacctggccttccccactcttttgttacaagactatcgtgaacatctttatgtttgtggtcctgttgcccttgtgcaaatcgagaaaaggtgcatcttccaggggggtgaattccaaaatgtgcccccctggccagggctgtgtgtggcctgggaagggaaccctggctggatgtcagtcctgctcacctctcctggggtgcttcctacaaggcacacaggacttcagctgtgtctgcgcaccatgccatgcagctgccgggtcttatggcctcggaatacaccatcaagcatcaagtcactggatcatggcgatgagtgttttagcatcaaatttctccctgaaggggttggatgaagtcgctttctcagtagcaatatatgagagtgtaaaccaaaaataaaattctaagccccccaccacccaaccatctgaatagacctctcctgtcagccagggcactccaaagttaacctgaaaaatgggttcagtccctgatgggaagtgggggtcggacatgcctccttataccctcctcccttttggaattcaggaaaagctgactagcagtcatgtcaacacaaatttttttttttttttttgagatggagttttgctctttttgcccaggctggagtgcaatggcgcgatctcagctcaccgcaacctcggcctcctgggtttaagcgattctcctgcctcccgagtagctgggattacaggcatgcgccaccacgcccggctaattttgtatttttagtagagacagggtttctccatgttggtcaggctggtctcaaactcctgacctcgtgatctacccaccttggcctcccaaagtgttgggattacaggcgtgagccacctcaacacagattttaagtctgataagaaacatttacattctgttctctctgaagcctgctacctggaggcatcatatacgtgataaaactttggtctccacaaccccttgtcataacccagacattcctttctattgctaataactctttaaaccaatagccaatcagatatttttattttattttccatatatttatttattaattatttttatttatttatttatttattttgcgatggagtctcgctctgtcacccaggctgcagtacagtggtacaatcttggctcactgcaaccaccacctcagcctcctgagtagctgggattacaggcacatgtcaccatgctcaactgatttttgtatttttagtagagacagggtttcaccacattggctaggctggtctcaaactcctaacctcaaatgatctgcccaccttggcctcccaaagtgctgggattataggtgcacaggtgtgagccactgtgcccaaccgtcaatcagaaaactttaaatctacctataacctggaagcccccccccgacccctcctcacccctcacctctacccctccatgacttcaagtcgtctcacctttctggaccgaaccaaggtatatcttagatatatttgattgatgtctcatatctccctaaaatgtataaacctaggctgtgccccaaccacctaggccacatgttctcaggatctcctgaggactgtgtcacgggccattggtcactcacatttggctcagaataaacctcttcaaatattttccagagtttgactcttttcatcagcaagaggaaccattcccagaggtactgtcttagtctgctcaggctgctgtgacaaaatcccacagactgggtgacttaaacgacagacatttattttctcacagttctcaaggctggaagtccaaaatcaagttgtctgtggggtgagttctttctgaggactctctctgcgatttgcagacagccaccttctcatatcctcgtatggtctttgctccatgtgtgtctctgttctaatcccctcttcttagaagagcactagtcattctattggaatgtttcaaagttttatcatgcagatgtgtgagaggcattggaaccagagtgactctatcttgaatgagggctaggaaaaatgaggctcagccttgctgggctgtatccccaggaagttaggcattcctagcctctagatggttatggttaagggaacagattcataatgtttactaaacagactcagacccaggaatgtcctgatatcctgatatcttgagaacagacgcattcctaattttgctttaaaaataataatataagttcttgtaaaatatagtaattatggtttttggtttttttttttttttgagacagagttttgctctttgttgcccaggctagagtgcagtggcacaatctcagattactgcaacctccgcctcccgggttcaagcgattctcctgcctcagcctcccgagtagctgagattacaggcaggtgccaccacgcctggctaatttttgtgtttttagtagagacaggatttcaccatgttggtcaggctggtcttgaactcctgacctcaggtgatccacccaccttggcctcccaaagtgctgggattacaggcgtgagccaccgtgcccggccaaaatagagtaattatgaaaattaatcctttatcacaaatacttgtagcagagcacatctccccatgtttttttgttgttgttgttttcctatatataacaaaaggaggaggtggttgcatttctcctcttactttccgtaacaccctactctgtggagtaacgattctttcacccctttgctttcttaacagacttgctttcgctttgcactgtggactcaccctgaattctttcttgtatgagatccaagaaccctttcttggggtctggatcgggacccctttccagtaactgatgaaggctccaggtagcaagcttcagagagaatagattgtaaatgattcttgtcagacttaagctctgggtggatattaaatgctggtcagctttccttaaatccccaaagggaggagggcatcgtgaggcatgtctgaccctcccttcctgtcacggccagaactaggttttcaggttaactctggggtgccctggccaagaggaagggttcattcagatggttggggtggtgttgtgggggggtaggagttggggagggtgttggcggggggacgggagggatgggggtgggggggaggggcttatcattttatttttggtttacgctgtgaaaggaaaataaatctcgggaccccaaaatcaccaagttaaagggaaaagtcaagctgggaactgcccagggcaaacctgcctcccattctattcaaagtcaccctctgctcactgagataaatgcgtatctgattgcctccagttggaaaggctaatggaaactctaaagaatgttggccggcccgtggctcacgcctgtaatcccagcactttgggaggcagaagcgggtagatcacgaggtcaggagttcaagaccagcctggccaagatggggaaaccctgtctctactagaaatacaaaaattagctcagcatggtggcgggtgcctgtaatcccagctacttgggaggctgaggcagagaatcacttgaagccaggaggtggaggttgcagtgagtggagattgcgccactgcactcccgcctgggcaacagaacgagactccttctcaaaaaaaaagaatgcaaccattcacttcttatctacctgtgacctggaagccccctccctgctttgagttgtcccacctttccagaccgaaccagtgttcatcttacatatattgacatctcaggtcttcctaaaatgtctaaaccaagctgtgccccaaccgccttgggcacatgtcatcatgacctcctgaggctgtgtcacggttgtgcatccttaaccttggcaaaataaactttctacactgaccgagacctgtctcagaaacattgggttaacaacgctctcacatattgctgctgagaaggcagcttcatttggaacttcacgccaaaaaccccattttaccttaattacctctttaaagaccctgtctccaaatacagtcacattctgaggtactggaggtaagagcttcaacatgtgtttgtctgtttatttgtttatttatttgagatagagtctcgctctgtcacccaggctggagtgcagtggcgcgatctcagctcactgcaacctccggctcatgggttcaagtgatcctcctgcctcagcctcccaagtagctgtgattacaggcacccgccaccacgcctggctaattttggtatttttagtagagacagggtttcactgtgttggccaggctgatcttgaactcctgacctcaagtgatccgcctgcctcagcccccaaagtgctgggatttcaggcgtgaggcaccgcacccagccagggcttcaacatatgaatctgggaagagagagaagtcagctcctagttggcaacctcacaactgctgtctacactgacaacgatcattttcccatccccctctctgccttccatttccaagtcttgctttcagtccccagaagcagctgatcctctttcttcctgggcaccacaggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgaggtaatcgagaagggctttggggccggtcctgggtgggaggtgggctgcggcgaagctgactttgcggaggaactgaggacgcgggctgggaagcgggcaatggggaggtgctggctgggaagtccagagagccaaatcaactcacccatcgctcccgaagcacccgcagtcggccacatccaacgaacttctgatccaaagccatcccagaccttcccgggcccctcttcctggcagatgactctccccgcttctgcgtcctgcctgcccattcataccagtttgaactgcaacagcctagctcctcacctgtgcacctccttccccaggtgtgcacgtctccagccccgagcgcgtgtcttcctgctcatctgggtttcctgggcaaatagtggccctcaataaatgtttgctgagtgagaacatatgcaagtatatttgtcttagtacatattgcaccttcccagtggccactaggatccgttctccctgccttcatatcccagctctgccacttaccagctgtgtggcctgatccaatgtgcgtaacttctgtgcatgtcggtttcctcagctgtaaaattgggctaacgatggctccaccaggagttgttctgtggattaaattaatacttgttaatacatgtgaagtgcttagcacagtatctgccacttactgtggggtttataaacattttcctcccctcccctcccctcccctcatggcctcctttcgagactgggtcttatggtgtgatcatagctcactgcagcctcaacctcctgggctcaagcgatcctcccacctcaccctcccaagtagctgggactgcaggcacacaccaccacaccaggctagttttctaaattgttttagagacagggtcttgctatgttgcccaggctggtcttgaactcctggcctcaagcgattctcccaccacccaaggctaggattacaggcacaagccgccctgcccagctattttattaaaaaatatatacacctacataatatataactatatctattacatgatacataccaatacatagtagtatatataaaataatcatggtaaaacatatcatctattatatttatgtgtaatgtaatatatatttatattcacacacttctatcagtttacattctgtaatatgaattaggaacatccatcctcctccccataccatgatccagaaccaacttgtcaccatctttctagacccttggcccaggaatacccaggctttctggtcttaggatttctgctgaaataaatatcccaagacaatatgataaaggtggaatgagatatcaaggtcttgggagtccttttctgccaaatctctgctgcatgaccccgagcgataggcttaacctctgaacctcagttttctcatcctgaaaatgggaatcacatcatctggctcgcaggagatctgcagagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagcacttgaaatgtgcctggcccaagttgaagtgtgctatgaagataaaatacacctcggattttaatgaccgagtatggaaaacgcatgtcaaagaccttattcgtaattggtatattgacatactaggcagggctctccagagggacagaaccaataggatctatgtctagatgaaagggagtttcaggatcacaaggtggagtcctacaataggccgtctgcgagctgaggaagaaacaaaccaatagtggctcagtccgagtccgaaagcctcaaaagtagggaagcccagccaggcctggtggctcacgcctgtaatctcagcattttgggaggccgaggcgggtggatcagaagatcaggagttcgagaccagcctggtcaacctggtgaaatcccgtctctactaaaaatacaaaaaaattagccgggcgtggtggcaggtgcctgtaatcccagctactcgggaggctgaggcaggagaatcacttgaacccaggaggcggaggttgcagtgaaccaagattgcgccattgcactccagcctggtgaacaagagcaaaattccatctcaaaaaaaaaaaaaaaaaaaaagtagggaagcccacagtgcagccttcagtctgtagccaaaggccgtagagcccctggcgagccactggtgtaagtctaagggtccaaaggccaaaaaacctggagtgtgatgttcaagggcaggaagtatccagcacaggagaaagatgaaagccagaggacccagcaagccagcttctcccaccttcttctgtctgctttgttctagtcacactggcagccaattggagggtgtccgcccacactgtgggtgagtcttcctctcctagtccactgactcaaatgttcatctcctctgacagcaccctcagagacacatccggaaacaataccagctttccaggcacccttcaatcaagtcgacacctaatattcaccatcacaattgattacacatcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctcagcctcccgagtagctgagattacaggcatgcgccaccacacccagctaatttttgtatttttagtagagacggggtttcaccatgttggccaggctggtcttgaactcctgaccttgtgatctgcccgcctcggcctcccaaagtgcagggattacaggcgtgagccaccacgcccggccaataaacagaaatttaagcaagacatatctgtaacaatttaacagaacctgattgtctaagttttttttcatttttctcaaattcatctttaattctttccatgatggggcttataaggaaactaaccaacatgtagctactatagttgaatgtcaaatcttttttttttttttgagatggagtcttctgtgtcgcccaggctggtgtgctgtggtgcgatcttggctcactgcaacctccgcctcccgggttcaagtgattctcttgcctcagcctcctgagtagctgggattacaggcgcccgccaccatgcccggctaatttctgtatttttagtagagacggggttttgccattttggccaggctggtcttgaactcctgacctcaggtgatccgcccacctcagccttccaaagtgctgggattataggcatgagccactgtgcccagctgaatgtcaaatctttagaaggtacttatgacagtaaattcctctgtaatacaggtatgaagcaccttcatgatatttctgttttatgtgtagaaaagtggctgggtgcggtggctcactcctgtaatctcagtgctttgggaggccaaggtgggaggatcacttgagatcagcaatttgagaccagcctgggcaacatagcaagaccccatctccacacaaattttttttttttttgagacggagtttcgctcttgttgcccgggctggagtgcaatggcacgatatcggcttgccacaacctccaccttccaggttcaagcgattctcctgcctcagcctcacaagtagctaggattacaggcatgcgccaccacacccagctaatttttgtatttttagtagagatgggattgctccatgttggtcaggctggtcttgaactcccgacctcaggtgatctgcccacctcagcctcccaaagtgctgggattacaggcgtgagccaccacacccggccaaaaaaattttttttgattagctgggcatggtggctcacgcctgtagtcccagctacttaggaggttgagatgggataacctgagtctaggagcttgaggctgcagtgagccatgattgcaccactgcactccagcctgggcgacacagcaagatcctgtctctaaagataagtatatgtagaaaactgttagactcaaatattcaactcaatataaaataagaagaagccgggtgcggtggctcacacctgtaatcccagcactttgggaggtagaggcaggtggatcacctgaggtcaggtgtttgagaccagcctggccaacatggcgaaaccctgtctctactaaaaatacaaaaattagccaggcatggtggcacgtgcctgtaatcccagctgctagtggggctgaggcaggagaatcgcttgaatctgggaggcggaggttgcaatgagccaagatcccgccactgcactccagcctgggcaacagagcgagactctgtcaaaaaaaaaaaaaaaaaaaaaaaaaagaagaagaagaagaagaagaagaagaaacacttgttgagactgcatctccttttgctaatgagtggtttctagttgtaatatcactcctctgaataaagaagccacctttgagtacataaggaaaaataaccacatgttaaaaggataagacattactccgacatctctactgggccatctcttcctctaacacttcagaaacttagaaatttaaaatattcttacgttaactgcaagaacaagataaaggagaaatgccctttttcttgagatcacaactatgaagtcatatgcttatgcaacttctgcatttgtgtgcaaaacacaaacacactgatctttttttaacttttaagttcaggggttcaagtacaggtttgttccataggtaaacttgtgtcctggggatttgttgtaccgattatttcatcgccccagtattaagcctagtacccattagttatttctgctgaccctctccttcctcccgctctccacccaacactaggccccagtgtgtgttgttctcctctgtgtgtccatgtgttctcatcattcagctcccacttagaagtgagaacatgcagtatttggttttctgttcctggaaacacatttatacatttatcttttttttttttttttttttttgagacagagtctcgttcttgttgcccaggctggagtgcagtggtgctatctgggctcactgcaatctctgcctcccatgttcaagcgattctcctgtctcagcctcccaagtagctaggactacaggcatgtgccaccatgcccggctaattttttgtaattttagtagagatggggtttcactgtgttagccaggatggtctcgatctcctgacctcgtgatccacccacctcagcctctcaaagtgctgggattataggcatgagccatgagccaccatgcccagcctctttcttgctcttgtcacccaggttggagtgcaatggcgctatctgggctcactgcaacctctgcctcccgggttcaagcgattctcctgtctcagcctcccaagtagctgggattacaggcacctgctaacatgcctggctaatttttgtatttttagtagagacggggtttcaccatgttggccaggttggtctcaaactcctgacctcaggtgatctgcccgccttggcctcccaaagtgctgggattacagacatgagccaccacgcctggcccgcattgatcttaattctccttgcttagttttgtcagtcagcttgcaggacttaacagatgcctttctaagacacagagactgagatgtgttttatgtaagtttagtaacctcagtgctacagtaatgagacatgcagtgtccttttgctctggttcaggacagcacggaaggaggccacaggaaagagaataaatgaaacttgttacaactgagaaactacttctcattaagtttccccatggtgtcacctttatttaatatttatttttaaaattaatttctcctacttctttttactttcttcaagtgcagcaagtagacaattgaaaagtacctttacggccgggcgcggtggctcatgcctgtaatcccagcactttgggagactgagacgagcggatcacctgaggatcaccaacctgaccaacatggagaaaccctgtctctactaaatatatgaaattagccgggcgtggtggagcatgtctgtaatcccagctactcgggaggcaggagaatcgcttggaccagggaggcggaggttgcagtgagctgagatcatgccattgcactccagcctgggcaacaagagtgaaactctgcctcaaaaataagaaaagaaaagtaccttcacggtgacattatatttctgttacacagtgatgatggagaatatctcatttatcttccaaatacccctgtgaggtggctattacagagatcctttgcagaggtgatgagatgcacccataccacatatctcgttgggctcctgggctcaaatgatcttcccatctcagcttcctgagtagctagggctacaggtgcacgcccccatgcctggctaattgaaatatatatatatatatatatactgtagagatgaggtctccaacatctttctgtggcagagctgggattcaaagcctcatctaggcaccattttccttgccctctgagtcccgcagcccccagccccaaaggttactctctaacctcgcgaatgttgtctctaggtgggctggggagtgcgggtgatggcagaggcttactctttcccttacagaagatgttgtccctgtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtaggtgcaggggaggagcaggtgagaagccacctgtattagtccatgctcacactgctaataaaaacatacctgagactgggtaatttacaaaggaagaaggtttaattgactcacagttcagcatggatggagaggcctcaggaaacttacagtcatggtggaaagcgaaggccaagcaagtcaccttcttcacaaggcggcaggaaggagaagtgagtgccagcagggcaattgccagatgcttataaaatcatcagatcagccgggcgcggtggctcatgcctgtaatcccagcactttgggaggctgaggcgggcggatcacaaggtcaggagattgagaccatcctggctaacacagtgaaaccccatctctactaaaaatacaaaaaaaaaaaaaaataaattgctgggcttggtggtgcgtgcctgtaatcccagctactcaggaggctgaggcaggagaatcgcttgaacctgggaggcggaggttgcagtgagctgagatcgcgctcctgcactccagcctggggacagagcaagactccttctcaaataaataaataaatacataccatcaggtctcgtgagaactcaactcactgtcacgagaacagcatgagggtaaccacttccatgcttcaattacctcccacgacacttggggattatgggaactacaattcaagatgagatttgggtggggacacagccaaaccatatcaccaccaggccaggccgaatggagctgtgctgtgccctggggacatcttgttacgctccaacatctgatggttgagtgagtcatcctgtccacccttgggcctggaggatgccaggctgcctctctcggtcttgcatgtttatgcatgttgctgcctctctctgcagccttcttgtcctacctgaatatccaaccccttccacctgggcatcccacattcctcatccagtctcaggtgagcagctgcttggaaggcctagcatccaggatgggtggtcctccggggcctgattgtgccacttcccacagtgggctccttttagcttgtcaatcgtgtctcctgcgatgagactcccattagggataaattgtgtctgttttcttccttcatttaacgaacatttattggttacctatgctgcatcagccatggttccaggagaggcaggctagagtagtaaagaagacaggaagcgggggccaggcgcggtggctcacgcctgtaatcccagcactttgggacgccaagccggggcagatcacctgagatcaggagtttaaggccagcttggccaacagggtgaaaccccgtctctattaaaaaatacaaaaaattagccaagcgtggtgatgcacgcctgtaatcctagctacttgggaggctgaggcaggagaatcgcttgaatctaggaggtggaggttacagtcacccaagattgtgccattggactccagcctgggagacaagagcgagcctctgtctcaaaaaaaaaaaaaaaaaaaaaagaaaaaaggaccggaaggggcatggatcataaaaatatagataaatccataacctcatgtgtcaataaaactttatttataaagccaaagtagtgggccgactggatttggtccacaactgtagtttgccaagccctgatgtaaatagacaaaaatctgcagaattaattgtccaaactcatgatgccttttctttgttggtttggttatgcttcaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagtaagtatctgttggagaactttctctgcaacaggcaggagggttgcatgggtgaaaaaagataggcagtgtctcccctacttgagcttgcgtctcagcaggggacagaccatgaacagggtcaggagtgaatggttttctgaagagtgaagcaggctgtgttcgtttgctagggctgctgtaacaaaataccactagctgggtggcttcacagaaattgatggtctcatggtgctgggggctggaagtgtgaattcatggtatcagcagcgctggttccttctgggatctgtgagggagaatttgttccacgcttgtctccgtgtatattggtccgttttcacactgctgtaaagaactacctgagactgggtaattgatgaagaaaagaggtttaattgactcacagttccgaaggcttaacaggaagcatgggtgggaggcctcaggaaacttacaatcatggtggaaggtgaagggggagcaagcacatctttaccatggcagagaaggagagagagagagcaaagcgggaagtgctacacactttcaaacaaccggatttcatgagaactccgtcactatcacaagaacagcaagggggaagtacgctcccatcaatcacctctcaccaggcccctaccccaacacatgggaattacaatttgagatgagatttgggtggggacacagagccaaaccatatctctgtgaaaggaaaatgaaatctcaggaccccaattcactatgccaaaaggaaaaacttaagctgtggctgggcactgtggctcatgtctgtaatcccagcactttgggaagccaagacaggaggatcgcttgagcccaggagttcaagatctgcctgggcaacatagtgagaccaagtctctacaaataattttaaaaattagctgggtgtggtagcacaagcctatagtctcagctactcaggaggctgaggtgggaggattgccggagcccaggagtttgaggctgcagtgagctatgatggtaccaccccactccaggctgggcgacagagcaagaccttgcctctaaaaaaaaaaaaaaaaaaaaaaaaattaagctgaaagcttaattaagctgagtcatgcaagaaactgtctttccttttgttcctaagccacagataaaaggccacagatatctccacaggtaacttactctatcgatatggtttggctctgtgtccccacccaaatctcatctcgaattgtaatccccacatgtcaagagagggacctggtgggaggtgattggatcttgggggtggcttcccttatgctgttctcgtgagagtgagggagttctcacgagatctgatggtttttaagtggcagtttcccctgctctctctctctctcgatctctctctctcatctctcctgccaccctgtgaagaaggtgccctgcttccaccatgactgtattaggttggtgcaaaagtaattgcggttttgcaactaaaagtaatggcaaaaaccacaactacttttgcgccaacctgataagtttcctgaggcctccccagccacatggaactgtgagtcagttaaacttcttttgtttatacgttacccagtctcaggcagtgtctttatcgcagtgtgagaatggactcatacagttctagaagtcagaaatctgaaacgagtgttatggagcaaaacccaaagcgttagcagggccaactcctgcggaggctccaggggagaagctgttccttgcctttttcagcttctaggggccacccgcattccttggctcatggcccctccttcagcctcttgcttctatcatctcatctcctccttgctctgacctcccgccttgctcttataaggaaagatccatgggattccactgggcccacccagatacccaggatcctctcctcatctcaggatccttagattaatctcatctgcagagtcccttttgccatggaaagtcatgtactggccaggagccgtggctcacacctgtaatcccagcactttgggaggctaaggcaggcagatctcttgagctcaggagttcagaccagcctgggcaacatggcaagacaccatctctactaaaagtacaaaaaaatagcaaggcatggtggtgtatgcctgtggtcccagctccttaggaggctgaggtaggaggattgctgaaccctggggagcagaggttgcagtgagcccagatcacaccactgcactccagcttcgatgacagagcgagaccctgtctcaaaaaaaaaaaaaaaaaaaaaaaaaaaaaaaagtcacatactcacaggctccagggattaggatagggacatcattaggagacattattcaacctgccacaaagacacagacacaaccagatgacagaagccaggggaagagttggaatattattctgaatatggtgggaagctgctgttaagttttgagcagggaagtagctttatctgagtcaccttttcaaaggcccaccctagctcctgtgcggttggtccctaggtgagataattagcaccctgaggagcagtttgggtcaatgacctcagggtcgcaaggtagagggaagagaaagccattctgggcctctggaccagtctatgttccccagagagtttccccaaaagccctgcctggcatggggcagggcggttatttgctgctcatctgtcttctaatgaggggttgtatattagtttgctggggctgccattaaaaagtaccacagaggccgggcatggtggttcacacctgtaatcccagcactttgggaggccgaggtgggcagatcatgaggtcaggagttcgagaccaacctggccaacatggtgaagccccatttctactaaaaatacaaaacttagatgggcatggtagtgcacacctgtagtcccagttacttgggaggctgaggcaggagaatcgcttgaacccagaaggtggaggttgcagtgagcccagatcatgccactgcactccagcctgctgacagagggagattccgtctcaaagaaaaaagtaccacagatcaggtggcttaaacaaccgacacttattgtctcacagttctggaggctggaagtccaagatcaaggtgtgaacaggggtggtttctcctgagacctctctccttggcttgcagatggtgcctccctgtgtctacacatgattttcctctgtgcctgtccactccccaccttctcacctgtagaactcagggcttatttatgcttatttgttgactctctctcctcataataaggtgtgcagcagtgtggggtcaggaaccacatcactttgctcaccatggtgttcattctttcattcattgattccacaaacatttcctggatgcctgctagatccagtccgcccaggtcctgcagccgtggctgcatacaggtcagatgaggctcttgctcttgtagaatgtacctcctcccgggggggcaacatgacataaacaggtaaacaaagaagtcaacaggatggccatggagagtaagtgccatggagacgaccgaacgtgcggtgtgctgaggagtgaagtgaaagctttttaggaaagggtctgggggtctgggaaggcatcctgagggagagacctttcacctggggctgaatactgagaaggggtggccatgaggaagtcttggggaacagaattctgtgcaaaggaaaagtaaatgcaaagtgtctggagtgggaaagaccttgatctgtgtcttacctatgtctataacattctgtactaatataaaggcatatctgaggctcggtaatttataaaggaaagaggtttatttggctcatggttctgtaggctgtgcaagaagcatggcgcctgtatctacttctggtgaaggcttcagagagcatccaatcctggtggaaggggaaggggggctggcgtgttacatggtgagagagagcaagagagagagaagggaggaaagcaccagtttccttttaacaaccagatctcaagtgaactaatagagcaagaactcactcattaccgcagggaaggcaccaacccattcatgaaggatccactcccatgatccaaacatctccctctgggccccacctccaacactggggatcacatttcaacatgagatttggagaggacgaatttccaaactatatcagtctattcgaggaacagaaggaaagctgttattgctggatcagggtaggggaagcacggaatgaaatgtgattggagagatggacagagatcagaacttgtgaattctggcaggtatcatgacattcgatgtaggccaaagagttacctcctagcccagctcctgatacatgcttaataagcgtagtgttggataaataaacgtttacgtggtaaaagtagatcacaagagctccacaggaggaggtggtggagctccaggtcttctcaatgaatgaaagaatggatgaatgtctttctcctaagtcatgtatgacctgtagaggcttccaggtcttctaatcttatccagtgtgcaacactgcctacaaagcacagtggtaacttctaactttcctttctccccaggctctactacccgaaggatagtgcccgaagttgctgcttggcatagatgagcctcagcttccagggcactgtgggcctgttggtctactagggccctgaagtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggattagctgtgtgtgtgtgtcttggtctgccaccacccctgctgcggcccttttcaccctctgtgtaccctttacttgttcctttcttcccttccccctttcctttccatcttcttccatctatatctcagcaattaagcatggtggttccacagctgggtttggatcttacttctgttatctgcttaccatgagaacatgggcaagagccttcgcctccatgccccagttccatcgtctgtagaatagaccatcacggagcctgtatcctagaaaggcttaaatgagttcatgagtctcaagaccttagaatagttagtctggcaccgacggagttccagagcaattattattcatacaggctttccagaattaaagcaggactgttatgggatgaattgtgtgtcccacccccaccaaaagatgtggccattgtaacccccagtgcctgtgaatgtgaccttgcatggaaataaggtctttaccaatgtcatcaagtgaagatgaggtcattcgtgtggaccctaatccacaatgactagtgtccttatgaaaaggggagatttcgccgggcgcagtggctcacgcctgtaatcccagcactttgggaggccgaggcaggtggatcacaaagtcaagagattgataccatcctgaccaacatggtgaaacctcatctctactaaaaatacaaaaattagctgggcatggtggcacacacctatagtcccagctactcgggaggctgaggcaggagaaccgcttgaacccaggaggtggagcttgcagtgagccaaatcatgccactgcactccagcctggtgacagagtgaagactctgtctcaaaaaaaaaaaaaaaaaaaaaaaaaaaaagaaagaaaaggggggatttaggggagggagagcattatgacaaatacctaatgcatgcagggcttaatacctaggtgacgggttgattggtgcagcaaaccagcatggcacatgtatacctatgtaataaacctgcatgttcagcacatgtatcccagatttgaaataaaattcttttaaaaaagggggggggatttaaagacagagacaggcatgtatacagagaggaaaccatgtgaacatggaagcagggattggggtgaggctctactgaccaagggctgccaaactattgccagcaaaccaccagtcatccgaaagaagaccttgatagcagaaggatcctgttcagaattctgtgttgcattcagtcgtagcttttttttttttttttttttttttttggacagagttttgctcttgttgcccaggctggagtgcaatggcacgatcttgggctcactgcaacctccgcctcctgggtttaagcgattctgctgcctcagcctcccgagtagcagggattacaggcatgtgccaccatgccgggctaatttttttgtatttttagtagagacggggtttctccacgttggttaggctggtctcgaactcctgacctcaggtgatctgcccacctcagcctcccaaattgctgggattacaggtgtgagccatcgcgcccagcctcggccatgtcttcttagtctcctccaatctcgaacggttcctcaatctttccttgattttcatgaccttgacatttttgaagcttacaggccagttattttgtaaaccatccctccatgtgggttcgtctgacgtctgattatgatgagattcaggaatcttacagaagcgatgctgttctcgtgacatcctgtcaggtggtgtgaaattccaacttgtcacattactgatgatgtccactttcattgactaagatggtgtttgccacgtttctccactataaagtaactcctttgaaattggtattttgtagggaggtattttgagctctgtaaatatcaaacttctcacttagctttttatttatctgagtatggactcctggtttcttctgtggtcctgtataatttgttactatcattatttattttgactc

SEQ ID NO: 643 - DNA, 30649 bp, Human
  misc_feature (1)...(30649): n = A,T,C or G
cacagggcacagagaatgcgttgttacctgcagtctggtttctggtctatactgtgtggtccaccctccagggccaagggagctaaggtgctctaaggactttcctgcaggccctggtggctctgtgttaatgctgtcagtcttcctgaagtccctgacctttcacctcctgcctggatctgcaccccgcacacattcctgaccccacacatttctcattgcctgggtcctggcacacatttctgaccctagctcagtgcctggggcctggcacacatttctgaccctagctcagtgcctggggcctgacacacatttctgagtctagctcagtgcctggaacctggcacacatttctgaccctagctcagtgcctggaacctggcgcacatttctgaccctagctcagtgcctggggcctgacacacatttctgaccctagctcagtgcctggggcctgacacacatttctgagtctagctcagtgcctggaacctggcgcacatttctgaccctagctcagtgcctgggacctggcacacatttttttttcttttttttttttttcacagagtctcgctctgtcacccagactggagtgcagtggcacaaatctcggctcactgcaacctccatttcctgggttcaagcaattctcctgcctcagcttcctgagtagctgggattacaagtgcccgccaccacgcccagctaatttttgtatttttagtagagatggggtttaactatgttggccaggctggtctcgaactcctgacctcttgattcgcccacctcagcctctcaaagtgctgggactacaagcgtgagcaaccgcgcccggccctggctcacatttctgaccctaggtcattgtctgggccctggaaggtgctcagggtgatccatcactcaaatccaagcctgtggagaggatgacattttattcccaggtttctcatgagccaaaaaaccttcatttctatagcgctatcctcttctatctaccatgtgaggggtcaggagccgactcatcccaagggtctaggagtcctgccattgaccttactgcttagggtcacaagctggcacccttcaaaaccacacattgggtctgccctcacagcggcagtgtgttcaactggatggggaggtaagtagcccaaggtcagacagttggacctgggtagacaatagacttggggacagactttggaaggcactcccctgattcccctgtctccatggggcctcaatactagagccctcaaggttggtcagggagtgtttgtgctttgaccatgcaaagggtgccaggttgtggctagggatgcccccggcgttcctctccctcctacctactcctcagcctctgcaggtgcctgtcatggcctctgtgtccttcattctgtccactcatgtgttcactgggcccctccttggtgccaggcacccgctactgagggataccaagcccctgccagagaagcttggagctgggtcacagcagcaaggaggctggagacatcagtggcatcagtgcactggtcagtgaggccgctgtgggaggagggagtgggagcagaagctaagagtggactgaagtcctgaggccaggaagtagttcagggtttaagaagaggagagacaggcggcccggggagggagcaggctcaggatgggcctccagtgcctcctctggagctcactacccagactacagcagcgcagcgggcagcgcctcagctccttccccttctgctgcctacagcctggacaggacccggaatcaaaccgcaggccctgggtcaccgctgccggaaagagccagttcctgtccgtccatgcacccacccacacaacctgggccctcctggaggtgctgggggagacccagcctgagtgcctggaagtgactgcgggaagggagtacaactgaccacgccttttttccggggtataaaagcggaggagcacgttctattctggcagtgtagctgcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggactccaagatccttaagttcgtcgtcttcatcgtcgcggttctgctgccggtgagtctccgccgcggtccctggctggggaagagcgcacctggcgccgggagtgggcagggagagagggggacacggtggggatgcttggcccgggtcgcctgcggccgggcatgtctgggcaggacgaacccgccgtcggagtcaggggaagagtggggtgcccgggctgggcaggagcgaccgggccgcgagggagcagagcgcgcgctccccctggctgtcccgtgcggcgaggaccgcactgagctgccccagaggaagttccagaatcagcggagggagggagtcaagatggaaaccccggagtgaacctcaggaagccacagagcggttgcctctcgttcgttcgttcgttcgttcgttcataacgttaacccaggccggtcgcggtggctcacgcctgtaatcccagcacgttgggaggccgaggcgggcggatcacctgaggtcaggagttggagaccagcctagccaccatggtgaaaccccgtctctactaaaaatacaaaaattagccggacgtgatggcggtcgcctgtaatcccagctactcgggaggctgaggcagaaggagaatcacttgaatccgggaggcggaggttgcagtgagccgagatcgcgccatcgcactccagcctggtcaacaagagcgagactccgtctcaaaaaaaaaaaaaaaaaaaaaaaaagttagccaggcgtggcagcctgcgcctgtagtcccagctactcaggaggctgaggcaggagaactgcttgaacccgggaggcagaggttgcagtgagccgagattgcaccactgcactccagcctgggcgacagagcgagactctgccttaacaaaaacagacaaacaaacaaacaaaattaaccctatgtttacactgttacacgtgtttcttggagatcagtttaacaaacagcctgtgaaaaagctttccaacgctgttttttgtaactttcatttcctatagaaccctgaaagtggcaggaagcggttaaccaaggtgcttgcagtcagtgtcttccactgccacccgtgtgtcccctctgtatcccataggcaggaccgcgggatggccccttccttaggcataaaagatgtaaagttctcgttgtgagttgggtttggaaactgagattggtagtggggtgcacaagaaggacataaaaataagatgtgcagactgccaggactttttctgagtgactgacgtttctgccaacagtgctttctaaggtttcttacgtaataccaaaaaacaaaacggggaggataaaacaagattacatgaaccatgagagtctccatgttttctttcaacgaagtaatactaaattcagaacagcagtgacattttcacctctcaaaaattacacaactgacttctacaatagtttatagtgggtggacctacctgaggcagctagaagaatggctgtgtcaggacagtggccctgaagagagaatgtgtggatgacctgtgtagacaagaccagcaacctgaatttcacagttttgggaatgtgaactctatgcgtcccaaaggaggctttgatccctccatcaatcttgccttattaaatgcatttcaatgcacagttgctttttaaaattttggagctagcacaaatcacattagatgttttatggcagtacattcagattgattttcttttaaacaagggtattgtattttactacatgggtaagccacaggttaattcactgttgccatctagaggcagctggttatatcccatcccgatgggatataacccaaagcaaatttgcctttgctaattccaacagcattgtactaaatacccttgtatgtatcgtgtgtccacatgtccatgcgcaccagcttattgggcaactccttagaagtagaattttacttctacttccgtgggataaatcatttcagaagtttctttagatgtttacgaattttcttccaaaagaccattgaactcagcttacactcacacctagttcacacatgtgcctgtatccctacacccttgttacacttagctttcattcgttgctagtctaggaagtaaaaggtgattcatcacattgttatgtactttcattccttaatggtattaggaattttcaaggatacgggagttttggtagtgggagtagatgaccgggggatccagatgagacagcaggggagggtggcagggaagactgaattcccagctgtgaacttggagaaccgtggtcagctggggccagtaccctgccacctgccacgcctgtaaatggagataaggtctccatcttcaggctgtcaggaggacatcagatgagcctggagctgagctcagttcctgaccccaggtcctggctctgtcagcgttggactgttccaatctgtgtgacagaggcttccgccccgcccttctctttatcaaagtaggaatcgaaaagatccaacggcccagaatctcggactctgaggctctcaaggactcctgagattggaggctgggaacagctgggccctgctgtgcttcccctccagctctgtgacactggtgtggccccagctcctgcctgtaaagtgaagaggagataaaaatcttcagcagccctgtgtaaacctcagagggctgtgttagcaggtgtgggaggatgaaccacatcctcagggctggtgtcagtcactccggactggatccccagggcacatgtcctccacccagcagaggctgcacctgttcctacttgcacctccataccaggctccctggccttggggcagaagcttctgaagactggggtggagcaccatgtggaggggccatcgaggaacagaggagccagagttcaagtgaggacagcgatggcactgcagggccacagcctggtttacctgccaagtttccagttgtgcttctggtgggtgtccggcccgggttggagtttgaagatgagcaggaaaggtctccatccaggtggctgcagatggctgctcacccagcccctactgagaggccacggtcccagttctggttctctgtcctgtatccaggagtggcagggtagcgaggctctagcttccaggttggggatggagacagtggggacagtgccatgccccgagcctgtgctgttgggcagctggtatcctgctcccagccagagagtgtacatcttcgtgtagtggattttcctaacaaccaggggacatgagggcaggttgttttccctgttttacaggtggcaaaatgagattcaggagcaatgtctccagcatttttgtcctcaccttctgaataatagcagccatatttgggcctctgaagggctagagttctctgaggagctgcttctctgatctctgtcctgcacttggcctctgggagctcctatgggtcctcagcagagtccacagggctcttcggagtcccctccctgtgccacagcctggagcctgtccttaggtggtaagctgaggccgccactgcgctcacctcatgggcttggggggaaagtgagtcacccaggaaatagacaatgagctctttattgtctttggagtctgctggagccagggaggacagatgaaccccatgtgaatcctgcttcctggagcccacagtgtggtgggtgaggtgacaccaggaatcatataactaataggaggtagcatgagggaggcctgagatctcaccaccattgcctccccctcctccagagaggccgtgttggtgcaaggctataggatgtggtattgttggcgtggaggatggtgtttggttagagtcaccattgagagtcatagagggaagcgaagctccccttgaagggctttttttttttggctggacctgagaattaaattgacataagacaggtacacaggagaaaagcacgtacgacttcttttttcttgagatggagtattgttctgtcacccaggctggagtgcagtggtgcaatcttggctcactgcaacctccgcctcccagattcaagcgattctcctgcttcagcctcctgagtaccttgggattacaggtgcccacccttgcgcctggctaatttttgtatttttagtagagacggggttttgtcatgttgtccaggctggtctcgaagtcgagctcaggtgatccgcccatctcagccttccaaaatgctgggattacaggtgtgtgccaccatgcccagccaacacacacatttatttaatgcaagttttacctagcacagagaagcagtgagagtcagttacttatatattgaattggaccaagtaacttgtgaagaagctagtaaatatatggaggctaaaaagctgagtggttctgttctaacaaggtctgcacagtaatctcttggcctcgacttctcatccttaaaaataaggagatcgtcctatgtttccctggggactttcatctcctgcttttaggaaacacaaaagaggtcaaagcatcttattgcgcctgctgtttttcagtagcctttaactgataatagtcaatgggccagggtgggtgggcaggtgcgatggctcacatgtatagtcctgcccaggtgggtgcatccttagagcccaggagttcaagaccggcctgggaaacatagcaaaatgctgtctcaaaaccaaaaaccaaaataaaaccaaaaaccacagacacagacacacacacacacacagaaaatcatgtcgtgtgaaggaatacaagcagaatgcataccatgtgattcctcatcttattaaaatacaactaatctattgtgataaaaagcagaagaagcattgctggggacataggagcaaagcagaagagaggattacattgaaaaatgaagaaacactgcaggacggtagacatgtcattatcttatcgcggcgatagttccacagtgtatacgtacatctcaacctaccaaactacatgcttcaaaaatgtacactttgtttcatatccattataccacaataaatctattttaaaaaaaccttcaatagaatataagcacttgagtgtatactgtattccctatagcacttgcacatagatcatggaaataggtatgcataaaaagtcagtacccagttaaagtggaattctaaaaggtaattaacattaaaatgtgcaggggaaaaaggagtaaaaaaattagactagacaaccgtagtttaaatggtaaacgtataggtctattttgactaacaattattgcactccctgtaaatccactgagcactacagttcaatggtagaaatgtttggaagggctgaaaaaacaagactcagctatatcttgtctatatgagatgggccttaaaaggaagacacagatgctgtctgtggaaagcaaatagatggaaaaagataccccacgcagagtgtaaggccaagaaaactgccgtggctatctcagtatcacatgaagttgattttgttagcggtggacgagatccgagttaccctacgttgaaggcggcgaatccgtatgggtccacagcaccttcagctcttcgcctcctgagaagaaagaattggactgaggggcataaggcagaaggagagacagaggcaagtttcagagcaggagtgaaagtttattaaaaaagctttagaacaggaaggaaaggaaggaacggaaagaaaagaaggaaagtacaacttgaaagatggccgagcaggtgacttgagaaacagtgcacagccggactgcctgagttggggttttataggttggcctacttccaggatcttgccttacttctccccactcctgaaatcttattgggaagctgctgatcagtttcaggtgttttctatgtattaggagactgcctttttctggcattggctgtaaccagttcttactttagagacacggttatcaaccacctgatggtcgcccaacactgctggtgtcagaagcggggagccctctcctaccctgctcatacctgactagctgcctactgtaacaattttaggacatagaatattatgggagctcaaaagggacccttgtagttaaaaaggttaattcttcaaggagtataataataatcacaaattgtatatgcctagtaatacagctgcagaacacatgatgcaaaaagagaatgaaaaggagattaaatcagctgtttctctgtaattgacagaacggtcagatgaaaaccccggtaaagtggcaagcgatctgcacactatcaaccaccttgacttaactgacatttaaagagcaggagtggaacatccactgaacactgattcctttctatgctcatgatactttcaccaagatagactgggttctgggatataaaacacgcgatatgacctctaaacttaatgaaacgagactggaagtcagtaatagtatccatagggaattctaaaatttggttattgaacaatacacttctaaaaaatctgtggttcagagaagaaatcaaaagggaaggtaaaatgtttcaaaataaataataataatataacagcaaaactggtgggaaatggctaacagtgctcggagtgaaataatacagctttcaatgtgtctattaaaaaaattggggagatggggagttactcctgaagggtatgcagttcctttctggagtgataaaaacattctaagattgattatagtgatgattgcatagctatgagtatattaaaaaactactgaaatgtagactaaatgggtgaattatatgaataatcataattactaattatgtgatttgtgtctcgttaaagctgtcaaaaaaagaaaaatatgtgaaatttatggcctgaagatctacattaatcaatcataaaatataagcataaatttaaaccaaagtaacaaggaggaacataaatcaaggaaatagaatagaaaccacaaaaagaactgacaaaacggactgtgtgtggtggcttacgcctgtaatcctagtactttgggaggctcaggcaggcagaacgcttgagctcaggagttagaccagcctgggcaacgtgatgaaaccccagctgtataaaatacaccaatattagcccaggcattggggcactctcctgtctgtggtcccggccacttagggactgaggttggaggaccacttgagcccgggaggcagagattgtagtgagcagagattacaccactgcactccaacctggatgacagagggagatcccgtctccaaaaaagaaaaaaaaaaaaaaagagttgagaaaatgaatagttgctcttgaaaaggagtaagggtgtgagagcagagaaaggtgacagagacatcgcctgaacctagagggaccccagctctagaagggaggatttgggaaatgtgcattagcttcactgtcaccaactactaggcaggctttcatgtggaagaaagctacattttgtcttgctgagagccaggtagttgaacagagcccaaggtaagtagcttttattgtaaccattttgttttttctcaggagcaagattatattaaatttaattaaatgtaaatttacaattaaattaattttgtacttttacacactcccaacttaaaagttacaaaaactatgcaaaaaaaatttgaaaaatagctgttggcatgatgaaagctattattgaatttttcagtgtgtactttctacaaacaaggaaattaacatcaacacattaccactatctaatatgcagactctattccgattctccagttgtcttctcgtcgtcatttataacacagagatcatggccataatccctgaattgctgttttatctttttctgtcactctttgatatttagtgggaacagcttgtcaaggtcctttgtgaagcagaaattacttaatgtttgatgctatatcctgactttctttaaggttatattgtaaccctcatttgtaaaaatgtgtatttttatgtgtgtgtctgtgtgtgtgcgagagagagagagagagagaatattcacccactggtcaattaaacacttggtcaaactaaatacattagatgctatttctgcttgaagggctcatatgtgtggtttttttgttttttgttttttgtttttttttttgagacagagtctcgctctttcgcccaggctggagtgcagtgcaagctccgcctcctgggttcacgccgttctcctgcctcagcctcccaagtagctggggttacaggtgcccgccaccatgcccagctaattttttgtatttttagtagagacggggtttcactgtgttaaccaggatggtctcaatctcctgacctcatgatccacccactttggcctcccaaagtgctgtgattacaggcctgagccaccgcgcctggccttttgtgttcttataaaatcttttcttgccaactacagtggtgtgttcctgttacccaacttgcttgggagactgaggcaggaggatcacttgaggccagaagttccaggctgtagtagactatgatcacacctgtgaatagacactgcattctagcctgggcaacatagcaagactctatcaaaaaaaaaaaaaaactcttctgctcatattttctggggtaaatatattttatgttataatatgataaaaggatacggaggtgtttttctttatagaaaatagctacctaacaggccaggggacaaacacggatgcaaaagaatgaaagtttggaatgggaaaaaagtccaggctctcatgggttttgtcacttggggtgaagggaatgtgagacggagcctgggagaggtaaggtctggaagccactcaagcccatctctgccttgtccccacaggtccgggttgactctgccaccatcccccggcaggacgaagttccccagcagacagtggccccacagcaacagaggcgcagcctcaaggaggaggagtgtccagcaggtgcactcttatttttaaaaatcagtttatttttagttgacagataaacattgtatatattcatggtgtacaccatgatgtttggaaatatgcacgcattgtgaaatggctaaatcaagctaattcacatacttatcgtgtatttgttgtaagaacacttaaaagtctactcagcaattttcagctgtatggatacagagccctgggataagccctctttgccctcctcacctgtgggttctgtagccatcctcatctgtgggtgttgcatccgtggttgcaaccaacacagatcaaaaatatgtggaaaaaataatgaaaatgataacatgtcaataaaagtagataaaaagcaatgcagtaaagcacttatttacatagcatgtctattgcattaggtattacaagtaacctagaaatgatttaaagcatatgtacctggggtgtatgcaatactatcccaatttgtatcagggacttgtgtaagtgcagagtttgttccatggaatatattccctgtgaatagaaggcaggactgtacaacacattgttttaataactgtagtcaccatgtcacacaatacatctcttgaatttatttccccctgtctaactgaaattttgtatcctttgaccagcatctctccaacccaccgtgcaaatacagcgctggtaatcaccattctactctctacctctatgagatcaagttttaagattccacatatgtgagatcatgaggtgtttgtctctctgtgcctggcttatttcacttagcatgatatctccaggttcatccatgctgtcacaaatgacagaatttccttctttgttgaggctgaatagtattccattgtgtctatgtactacattttctttaccttttcatcatcgatggacacttaggttgattaatgtcttgaccattgtaaataatgctccaatgcacatgggagggaagatacctctttaacatactgatgtcatttcctttggatgtatacacaatactgggattgctggatcatatagttattctatgttttgttttttgaggaacctccatactgttttccataatggatgtactaatctccattcccaccaacagtgtaccagtgttcctttttctccccatcatcatcaacacttgttatcttttgtctttttggtaatagccatttttacaggtgtgaagtggtatttcattgtggttttgatttgcatttccctgattagtgatgttgagcatttttttcatatacctgtcggccacttctatgtcttctttttagaagtgtctcttcaggtcccttgcccatgcgtccgttttaattggattatttgattgcatactattgagatgtttgagttcctgtgtattttggatgttaaccaaaatcttggatcttttggatattgatctctcatcctgtatgttgtctcgtcactctgttcattgtttcctttgttgtgcaaaacctttctagtctgatataatctcatctgtctatttttgcttttgttgcctgtgcttttggggtcatagccaagaaatcaatgcccacaccaacgtcatgaagattttcccctatgttttcttgtagtagttttacaatttcagggcttatgtttaatctttagtccatgttgagttgatttttacatatgatgtgagataagggtcttatttcattcttctgcaggtcaatatctactttcctctacatcatttattgaagaggctgtcctttccccattttgtgttcttggtatctgtcacaatcagttgactgtaaatgcattgatttatatctgggttcactatttcattccatcagtttatcttcgtttatgccattactattcagttttgattactatacctttgtaatatatttaagaatcaggtagtatgatgcctccatcattgttctttttgtttgttttgcttaagatcactttggctatttgaggtcttttgtggttccatacacattttagatttattttgtctattttggtaaaaaatgtcattggaattttaataggcattgcattgaatctgtagatcactttgggtcatatgaacaattaagcaatattgagttttctaatccatgaacatgtactgtctttccatttatttttgttactttccgtttctttcatcaatattttacagttttcacatcttccacctctgtcacaaatttatttaaaagagttgctgccttgacatccatttttaggcccaatgtaagttgtttaaaacccaatcataccacagcatcttttgcccaattaataattcctttccctgttcaattgtttttgatctagcacatttgttcatcatctccctgaccccaaacccaacacatcccacaggagctgactacaataaaacctaatggttcacagcagagcagtgtgaaccttctttgcaggtgttgtcttccacaatccctgtgggaaagcctggggtataatgcccatggatctttataaaggtgtagtcccacgggtcctctctctctgtctcttgctccccacacaccggttagtgtcctcggactggatagctccccacttcccgtaagtgctgcaaagtgtgctatcctcttctctctggagtctgtaagtaatacaccacttctgtgtttcctgtgttttgttgtgttgcttcctctgtgttttccctaattgacacatctgaacctaacatccttctccatcttggctctcttaaagagtggctgtctcctaaagagtagagataacttaaaactggacataggtcagacaagagccaccaggtctactgctagtaaaagtaattgtcttgtggaagggacatgtacaagatgaacacccaattaggcattagacagtccaccgggacaaataagtttcctgtgaacatccatgatgaaatctcctggatcccccccagggcaaggctagaatttatagccactctacagagagaaacctcaagaccaaattagaaaaaaatacagccaccaccttggttaaatttattcctaagcattttttttgtagctattataaatgggatttttcagatagtttcttgtcagtgtataaaaacactactgaatttgtaagttaggttcatgtctaactttattttacactgataacaatttatctttgatctcataaaaaacttgacaccttttcttctcctgccttattttatgttttgtcattatttacgtctttttatgttgtgtattccttaacaaattgtattaagtatcatttaaaaaaatacattgggcttttaacttttatagtaatgatgtaagtaatttgtacactattatgattgtattagaatattctgaacttgaccatgtatttaaccacctagttttatattttcgcatggttttgtgtatccagttagtgttctgttctttcagattgaataactctctttaacatttcttgtaaggcaatacatgctaaagatgaactccccccgtttttttttttctttgtctgataaagtctttactgctctgcatttctaaaggacaggcttgccaggtgtagtattcttggttggcaaggaatttttcctttctgtactttgtatgattccactctctcctggcctgtaggttttctgctgagaagcctttggtagttttataggggttcctttgtacattgcttgtctcttgctggtttcaaaattctctttgcctttgatgtttgggaatttgtttaagatgtgtcttggtgaagatctcttcatatttatctgttaggggttttttgggcttcatgaatgtggatgtccattcccatcctgttttgggacattttctttaattatttctttaattacactttctgttcctttcactttctctgatgctccttggaccaccataatgcatatattgttttgcttcacagtaaccgttggtactgttggctttcttccctctttttcattctttattttttttttcttcctgtgacttggtaatttcaaatgatctgttttcaagctcactgattctttcttccgattaatcaactctgctgttgacattctctgtggaattttcttagttcagatattgtgttgttgttaattttagaatttctgctttcttctttattatgttgtctgtgtatattaaactactcattttgttcatgtattgttttcctgacatgacttagttgtctatccatattctctagtagctgactgagcttctgtaagatgactgttttcaagtctttgtcaggctgttgtaaatgtctattcctttcgggttggttacttgtgcttcattttgtttctttggtgccgtcactgttccctgattgctcaggagcctgtggcaatatgttggaatgtgcactttgaagaagcagggacttaatccagtatttacagactggctttgtcagggaacgcccttcaccagtcagcctgttcacagattctgggcaggccatgtggtgtggttcaagggtggtcagagccagtatccagagaggtgacctgaggcctggctccatgagggctgaactggcactggaataggccttgtacttgggtctgcagatgtcagccaggtgctgtgatgggtctcatccttgggtccacagggaagggcctggagcctgagttcatggggactgacctggcactaggacagatctggaagctgaatctatggaggtgggtcaggatcctgggtctgtagtgctagcccgaaggcacaagctaagactgatatcttagcttatcatgcctttatcatgcccttatctctatgtgtttccagacttctgtttcctgcactttctggttctttattccatagggacatgttggatgatttctgtcagtcaggcaccgtgctaatgggataattataagaggccctgccctcgtggaaccttttctctgggatagtattaagacacacagatcaaaataacagtcagaaattcctgataggaaccatgaagaaattaagtgatgagtgagacagagacgaggttggtggggcctctcggggatggtgattttggccagtctccaaagctggacagggatagttgtgcagagagccagaaatggtgctcctgagcagcctccctaggaatgacagtcccagggtgcaggcgctgggggataccgagcagagatggggccaccatagtgagtggacagcaaacaggtcaggtggaccagcatgggcagatcacatgtagatgaggttggattttattttgttattttattttattgttaaaaaaaaaaaaaagtagactgggcgtggcatggtggctcacgcctgtaatctcagcactttgggaagccgaggagggtggatcacctgaggtcaggagttggagaccagcctggccaatatgatgatacaccgtgtcaactaagaatacaaaaaattagctgggcgtggtggtgggtgcctgtaatcccagctactcaggaggctgaggcaggagaatcgcttgaacctgggaggtggaggttgcagtgagccaaggtcgcgccattgccctccagcctgggtgacaagagtgaaactctgtctccaaaaaaaattttaaaaaagataaaatatttcttttcttttcttttcttttttttttttttttttgagacagagtcttgctctgtcgcccaggctggagttcagtggcacagtctcagctcactgcaagctctgcctcccgggttcacgccattctcctgcctcagcctcccgagtagctaggattacaggtgcctgccaccacgcccggctaattttttgtatttttagtagagatggggtttcactgtgttagccaggatggtctcgatctcctgacctcgtgattcgtccgccttggcctccctaagtactgggattacaggcgtgagccaccgtgcctggccaaaaaaagataaaatatttcaaatatttatattgattacatattgaaatgtagtgttttggatatttttaggctaaaaaatagttaaaattaatttgacctcattctttgtactattttaatgtggctttcatagaatttgaattttgcatgtgatttgtattatatttctgtcagcagtgccagtcaaaggtatgtaatagtgtaatagatgcagaattgatgacaagaccaagccaagaagagtagatttctctgtctggattccactgagggccaaaagagaaatttgccagccattgtcagcctctgggaattctgtggtgactcattcattaacttttctctcccttcccaggatctcatagatcagaatatactggagcctgtaacccgtgcacagagggtgtggattacaccattgcttccaacaatttgccttcttgcctgctatgtacagtttgtaaatcaggtacagaatgtgtggaccccttgcccagaggtggagtgcatagtgatgaggtgggagctgtagccgatgtgagtcggggaaccaagttctagcccaacttggtagtcttcatcatgccctgttccatgattatgactagttgattaaaaaaaaaaaatagaaatcttttttttcttttcttttatttatttatttttttgaagacagtttcactcttgttgctgaggcttgagggcaatggcgtgatcttggctcactgcaacctctgcctcccaggtttagtgattcttctacctcagcctcctaagtagctgggatcacaggcatgcaccaccacacccagctaatttttttttttttttttttttttttgtgagacggagtctcgttctgttgtccaggctggagtgcagtggcgcgatctcggctcactgcaagctccgcctcctgagttcacgccattctcctgcctcagcctcctgagtagctatgactacaggtgcccgccaccacacccggctaatttttttttgtatttttagtagagacggggtttcaccgtgttagccaggatggtctcgatctcctgacctcgtgatccacccacctcggcctcccaaagtactgggcttacaggcatgagccaccgtgcccagccagttttttgtgtttttagtagagacagggtttctccatgttggccaggctggtctcgaactcccgacctcaggtgatccgcttgcctcagcctcccagagtgctgtgattacaggtgtgagccactgcgcctggccaaaatcttttctgtaatgcatgccaccaggctgggaaatcttctaaactattgcctgcagccgggtgggggcatcattacagcatagaggaggcctggcccagtggacagggctgggttccagcagcggcacaggtctgctccgtggccaggctctctcctcccgggctctgtgctcctgaaaggtgcttggcctcacttagccttcaggttctcaggccccttcctcttccccagcaaggccggggcttttgggaagtcccccaagggcccctctccttgcagagtctctcaggtgatgcccttgcgcctcccttgctactgaccatgccatctaaacaatgcttttcccctaacctgatataataaataatgaatcacggtccttttgtattggtccttacatacagggtgggtgtcctgtatgagtcccgagtgtgctggtgcagaaaccagccctcagaactccttggtgaactgagttgagctgagtgggaggggatggggtggtgaggaagggtggacagacatgtcagggaaacacattctcaaaaccttatgctctgttgtcaggtcaaacaaataaaagttcctgtaccacgaccagagacaccgtgtgtcagtgtgaaaaaggaagcttccaggataaaaactcccctgagatgtgccggacgtgtagaacagggtaagacagcagccaggggctcccaacagctttcaggaacctgaaaagacctgattcacctggtacctctatctctccgctgaccccatggatcctccaggcccgaggcctccctgagcctgtggggtttcctgagcctgcgttggcccctcctggtccatctgcctgtccccacccctaccccctgcagcagccccttcccataccctccccagcaggagtccctttgtccaggctgaattgttcactgggcacaggaggtgactttctaggtcccttgaaccttttcaggcaacctaggaaatgtaatttccttttgaaatcagaagaaaacacttgaatccagcctggcttgtatttttccttactctaagttggtttaaaaaatgtaatttttaatattttttatgtgggcagggacccataaagacaaaagtgtccgtagcccacaaaagtcataataaggccatgggtggagctcccttaagttcccatgaggacctgagcccacccagccggcctcacccctggcccccgatttctcactaagtccttctttatcctatttgggttttaggggcaaagagtaacttgctcttctctggccctccagtgtttgctgtggttgggaggaaccagcggcagacagggtggggcgaggactcacttgtactgtgtgttaactggaggaaggggctcagcttgtggccacaggggcttgtgatcttcccctggagtgcggctcctcctaacgcaggcctcccctgcagcccagggaagctcagtgtgtgcccagcacagaaggctcctggatctacagctctgaccccagagcagggaggccgaggggctgaagtgtgcatgctcagacccttccccagcctcaagaagggagcacagggggacccactgctgacacgaggagcctgtcctcctgacgccttctcagggactttgggcagggagggtggctcctctttcatcccacctggccagctttccatcaagagtccctgtctccctctctgtgtgtacccaggtgtcccagagggatggtcaaggtcagtaattgtacgccccggagtgacatcaagtgcaaaaatgaatcagctgccagttccactgggaaaaccccagcagcggaggagacagtgaccaccatcctggggatgcttgcctctccctatcactaccttatcatcatagtggttttagtcatcattttagctgtggttgtggttggcttttcatgtcggaagaaattcatttcttacctcaaaggcatctgctcaggtaggtgctggctgagggtgggagcgctgggcactgtctgccctgccctctcccactccgttcccacagacagtaatccccatccctgcccctggtccaagcgtctccagcctggcttggtcttccttcttgtgatcgccccatccccacgtcctgtgtatccccaaggaccctggtctcatcagtccctctctcagggctgggggacccctcatctcccggagccaactccaggagggcagggccagttcctcctatcttcaggcccagccaggcagggggcagtcagctcctcaactgggtgacaagggtcaggatgagaagtggtcgtgggatttattcagccttggtcagagcagaacacagagattttccacgtgttggtttttactctagttccccttctcatcccccttcctcagggtgtcccctaattgcaaggccccattctgtccccagccccagggctccttgtccagtgtcccagcccccagccagccctgcgccccactgtcctctgggagggaggtgctgcatgggcccctccccgcctgctcaggagactgcttcttttccaggtggtggaggaggtcccgaacgtgtgcacagagtgagttggtttctccagaaactgggggcttcgtgggttcaggaactgcttcccatccactgccgagcctgggtgggcacaatcccttgtcctcatggctgccctgactctctgacatggcctgggggatctgggctgactgtgggggacacacggccattttgagcagcacacagaccagcaggccgtgctgcagccctgtccttcctgcagcctcggtgacaccatcactccacagctggccccatggggatggggtgaccacctgacccacctcagcatggggtcctggatgtgctgagcctcagctgcctggggtgacctcattggaaggggttggggatggcaggtccagctgtgtactggggaccctgaagctgagcccggggtgtggacttgagtgggctctttgtcttcccaaggtccttttccggcggcgttcatgtccttcacgagttcctggggcggaggacaatgcccgcaacgagaccctgagtaacagatacttgcagcccacccaggtctctgagcaggaaatccaaggtcaggagctggcagagctaacaggtgtgactgtagagtcgccagaggagccacagcgtctgctggtgagttgaggagggactgtgccctgcctggcgtgcagcctgcacaggactttgtagacagtgggacatggcagtgcctcctctttcctggcccaaggggacatggagcctttgggagacaggggactgcaggggacggagcagctgcactgaggtggtgaccgtgccagtctgcaggacatctgcttcttactccctgtcctgtccttgctgtgtccccagagcctggatctccacaggcatagagtgggtgtcacagggttcactgaggactgaataaggctgcacagtctccatcgtgtgctcctaacagaagtcagggagcccttgcttgaaacagcggaagttttaaatgttcttcaaaattcttactacattgaacatatttcacagtaaatctttgtccagatttctgatcaagtatgtaaggaggcttctgggaagaagtaggatttctgagtcagtgtgtagaagtgcttttgtattacagaaacacacacatccagttattcacatcgattcactagttttgatatgacattgagtaggtgtgaaatctggacacacatttgtttttttttaagttctttccttcaggataaaataagatgatcctacctaattttttgtggacttttaaagaatgatttggtttgtagcatacaccagtggaacgtaggtgccatttcttttgtgatgctgtgtgaagtgaggaattccctgaattgttgtgagtcactgtctccttcctccacgcctgtttaggaactgattctcctatttttctctgcttttggctcctctttgatcacttgtcaaatacttacctagacaaggatcactttccacccattttcttcctttcctataactataccccattttttttaatgaagggaagtataaaaaggtaaggaaataaacaaaaaatatcaacaattactccacgctgctgaatcgcattgcacctttgttttgtaatttgtagagatctgatcttgctatgttgcccaggctggtctcaaactcctggcctcaagtcatcctctcaccttggcctcccaaagtggtgggattacaggcataagccactgcacctggccgcgctgcacattttttgaaagtggtaaatgcagagccacacatctgccacactatagaaaggtgctcagtcggccgggcgccgtggctcatgcctgtaatcccagcactttgggagggccgnnnnnnnnnnnnnnnnnnnnaggccgaggagggtggatctcaaggtcaagagatggagaccatcctggccaacatggtgaaaccccacctgctactaaaaatacaaaaaattagccgggcgtggtagcgggtgcctgtagtcccagctactcgggaggctgaggcaggagaatggcgtgaacccgtgaggcggagcctgcagtgagctgagatcacgccactgcactccagcctgggctacagagtcagactccatctcaaaacaaaaacaaaaacaaaaaaaaaacaaaggtgctgagtcatagtggtagtcccctaacacttcctccagcccccagcccttcttcattcaggtgaatacaacagataatttcttgtgattctttgtagaaatctttatgcatatgccatgtatattcatacaagcgtatgtacattttgtttacattacagggattactttacatataatacactgccaaggaaactttttttcattttttatttttcctttttcaaatttattttgattcagggggtacatatgtaagtttgtttgatgctgaaatttgaggtatgaatggttttatccaggttgtgggcacagtatccaacagttagtttttcaccccttcctcctctcgctccctccccgccctggtagtccccagtgtctattgttgccatctttatggtcgtaagtacctgatgtttagctactacttataaatgagaacacgcagtatttggttttgcgttcctacattaattcacttaggatgatggcctccagcttcatccatgtggctgcaaacaatatgatttcattcttttttatggctgtgtggtaacctatggtgtatatatgccacattgtcttcatccaatccactgttgatgggaacctaggttgattccatgtcactgctattatggatagtggtgtcttttggtagaatgatttgttttccctttttttttttgagagggagtctcgctctgtcacccaggctggagtgcagtggcacaatctcggctcactgcaacctccgcccctccaggtttaagcagttctctgcctcagcctccagagtagctgggattacaggcatgtgccaccatacccggctaattttttgtatttttagtagagacggggtttcaccgtcttgggcaggctggtcttgaattcctgacctcgtgatccatccacctcggcctcccaaagtgctgggattacaggtgtgagccaccgcgcccagcagatttgttttcttttctatgtatacccagtagtgggtttgctgtgttaaatagtagttgttttaaaattctttgagaaatctccaaactcctttccatactggctgaactaatttacattcccaccaaaagtatataaatgatcctttttcttcatagtctcgccagcatttactgttactggctttttaataatcgccattctcactgtatgagatggtatcccactgtagttttgatttgcatttctctgatgattcatgatgatgagcattttttcatatgtttgttggccacttgtatgtcttcttttgagacatgtgtgttcatgtcttttgcccatttttaatggggttgttttctgtgtgttcatttaagttgcatatggctcctgaatattagacctttgtcagatgcatagtttgtaaatattttctcccattctgtaggttgtctgttactctgttgatacttttttttttttttgagatgtactctcgctctgtcacctaggctggaattcagtggcatgatctcagctcactgcaacctccgcctcccgggttcaagtgattctccctcctcagcccccctagttgctgggattgcaggcacgtgccaccatgcccagctaatttttgtatttttagtagagatggggttttgtcttgttggtcaggctggtctcgaactcctaacctcaggtgatctgcctgcctcgtcctctcaaagtcctggtattataagtgtgagcccccacacccggcctgtggagagtttcttctgctgtgcagaaggtctttagttcaattagatgccacttgacaatttttgtttttattgcattgcttttgaggacttaatcataaattctttgccatggctgatgtccagaggggtgttttctaggttttcttctagaattcttatagttcatggtcttacctttaaacttttaatctaccttgagttaatttgtgtatatggtgaaaagtaggggtctagttttcgttgttctgcatatggctagccaaatatccgaagcatcagctgttgaatggggagttgtattattccattttcatactgctatgaagaaatacttgagactgggtaatttataaagaaaaagaggtttaatggactcacagttccacatggctggggaggcctcacaatcatggcctgaggtgaaagatgagcaaaggcacatcttacatggcgacaggcaagagagcgtgtgcaggggactgctctttataaaaccatcagctcttgtgagtcttattcactatcacaagaacagaactggaaaaaccagtccacgtgattcagttacttccaataattttttccaattctgtggaaaatgacattggtaatttgataggagtagtattaaatctgtagattgatttcagcagtatgcccattttagccatattaattcttccaatccatgagcatggaatgtttttccatttgttcatgttatctatgatttcttttagcagtgttttgtaattctcttagagatctttcacatccttgggtagaggtatttctaggtattgtgtgtgtgtgtgtgtgtgtgtgtgtgtgtgtgtgtctgttgtaaatgggattgtgttattgatttggtcctcagcctgaacattattggtatatagatatgctactgattttttttctttttgagacagagtcttgctctgtcacccaggctggagtgcagtggcgcgatctcagctcactgcaagctccacctcccaggttcacgccattctcctgcctcagcctccccagcagctgggactacaggcgcacactgccacgcctggttagttttttgtatttttagtagaggtggggtttcaccgtgttagccaggatggtctcgatctcctgaccttgtgatccgccctccttggcctcccaaagtgctgagattacaggcgtgagccaccgcacccagctacgccccgttaatttttgtattctttagtagagacggggtttcaccatgttggtcgtgctggtcttgaactcttgacatcgtgatccgcctgcctcggcctcccaaagtgctgggattacaggtgtgagccacggtgcccggtgctactgatttttatacattgattttgtatcctgaaattttgctgaagtcgtttattagttccaggggccttttggtggagtatttagggtttccaaggtatagaatcatatcgtccatgaagagttttcacttcttcatttcatatctggatgccttttctttctttctcttgcctgagtgctctgactaggacttccagtactatgttgaatgggagtggtgagcgtgagcatccttgccttgttccagttctcaaggggaatgcttccagctttggcccattcagtatgatgttggctgtgggtttgtcatagatggctcttaccattttgaggcatgttccaatgggaactttctaatgttttttaacatccaaaagagcaaacacctcttccatacttcttcaaaatgtattattttacccagataaaatttagaattaaaagatttcctccatccttccctcccgaaaaacctcagttgccgttttatcaattcgctttaaaattaaaaattaatctagaaacactgaatattttattaatattcagtatttccttatcaaaggagataacatttggtgtcaagtattttatggtaactgagttgtgatttgtgttcctcttcaaataaattattcctgtttcttatggctgtttagtattttgtatccattatgagttggataaccttgtaattctgtttgctaatttattgcatttgctatgtttttaacattcctccagacatacatttctatttcaatattgtagtttcatcttaggggttttaaatgacgttgaaaataatgattattgtgtctgccctcttccaaaagtcttgcctcattttaattttccatcttgttgcctaggccagacctttcagaacaatattcagctgtgcttagggaaggcaggtgtttgggtcctgatttgatttctggggaaggcctccaaagtgtcactcttagcaatggcattcacttttggtttcatatagaaattctcatcatcaagaacacagcttactattctaaaagggtttgaaaaaaatcagaattgctgtttaattttaccaaatgtctttccagcctccatagagactgccattttatttaattacgctattgatatggtagagtactgatgatcaaagatcatttacagtcttgggataaatcattttgttaggttttcctgggtgctctcatatatagtctgccgagactctgctggtaagaattctggaaggaagtgatcatttcttgtgagggtgggtgggagttgattagatggggcagaaggggactttctggggtgtggcagtttctatgtcttgatcaggggataattacacaggcctatagtcaaagttggtcagaacacttacaaagtgagcatttactgcatgtcacttatgtctcaatgagccaccagcacacagagcccaagagctatggaggaccagaggtttgtctccatctccatggagacccaagagggaaagcgctgcaggtctcttgctggctagtggtcagggtcagtactagactgcaggactcctgactctgaccagagcattccccactgtgtgttacaggaacaggcagaagctgaagggtgtcagaggaggaggctgctggttccagtgaatgacgctgactccgctgacagtaagtgttttgtgccttgagacgcagcaggaggacagggaatagggacggtgtcctaactgctgtccctatagctgagagggctcttctggaggtttcactgctggaagcagggggccccatgtcgatcctgtgctgatcgtccttggagcattgagaccctaaatctcttctctcttctcagtcagcaccttgctggatgcctcggcaacactggaagaaggacatgcaaaggaaacaattcaggaccaactggtgggctccgaaaagctcttttatgaagaagatgaggcaggctctgctacgtcctgcctgtgaaagaatctcttcaggaaaccagagcttccctcatttaccttttctcctacaaagggaagcagcctggaagaaacagtccagtacttgacccatgccccaacaaactctactatccaatatggggcagcttaccaatggtcctagaactttgttaacgcacttggagtaatttttatgaaatactgcgtgtgataagcaaacgggagaaatttatatcagattcttggctgcatagttatacgattgtgtattaagggtcgttttaggccacatgcggtggctcatgcctgtaatcccagcactttgataggctgaggcaggtggattgcttgagctcgggagtttgagaccagcctcatcaacacagtgaaactccatctcaatttaaaaagaaaaaaagtggttttaggatgtcattctttgcagttcttcatcatgagacaagtctttttttctgcttcttatattgcaagctccatctctactggtgtgtgcatttaatgacatctaactacagatgccgcacagccacaatgctttgccttatagttttttaactttagaacgggattatcttgttattacctgtattttcagtttcggatatttttgacttaatgatgagattatcaagacgtagccctatgctaagtcatgagcatatggacttacgagggttcgacttagagttttgagctttaagataggattattggggcttacccccaccttaattagagaaacatttatattgcttactactgtaggctgtacatctcttttccgatttttgtataatgatgtaaacatggaaaaactttaggaaatgcacttattaggctgtttacatgggttgcctggatacaaatcagcagtcaaaaatgactaaaaatataactagtgacggagggagaaatcctccctctgtgggaggcacttactgcattccagttctccctcctgcgccctgagactggaccagggtttgatggctggcagcttctcaaggggcagcttgtcttacttgttaattttagaggtatatagccatatttatttataaataaatatttatttatttatttataagtagatgtttacatatgcccaggattttgaagagcctggtatctttgggaagccatgtgtctggtttgtcgtgctgggacagtcatgggactgcatcttccgacttgtccacagcagatgaggacagtgagaattaagttagatccgagactgcgaagagcttctctttcaagcgccattacagttgaacgttagtgaatcttgagcctcatttgggctcagggcagagcaggtgtttatctgccccggcatctgccatggcatcaagagggaagagtggacggtgcttgggaatggtgtgaaatggttgccgactcaggcatggatgggcccctctcgcttctggtggtctgtgaactgagtccctgggatgccttttagggcagagattcctgagctgcgttttagggtacagattccctgtttgaggagcttggcccctctgtaagcatctgactcatctcagagatatcaattcttaaacactgtgacaacgggatctaaaatggctgacacatttgtccttgtgtcacgttccattattttatttaaaaacctcagtaatcgttttagcttctttccagcaaactcttctccacagtagcccagtcgtggtaggataaattacggatatagtcattctaggggtttcagtcttttccatctcaaggcattgtgtgttttgttccgggactggtttggctgggacaaagttagaactgcctgaagttcgcacattcagattgttgtgtccatggagttttaggaggggatggcctttccggtcttcgcacttccatcctctcccacttccatctggcgtcccacaccttgtcccctgcacttctggatgacacagggtgctgctgcctcctagtctttgcctttgctgggccttctgtgcaggagacttggtctcaaagctcagagagagccagtccggtcccagctcctttgtcccttcctcagaggccttccttgaagatgcatctagactaccagccttatcagtgtttaagcttattcctttaacataagcttcctgacaacatgaaattgttggggttttttggcgttggttgatttgtttaggttttgctttatacccgggccaaatagcacataacacctggttatatatgaaatactcatatgtttatgaccaaaataaatatgaaacctcatattaaaaaggtgtggtgttcgtttatttccatcctcctctcctgctgtgacacagctctgagtgacaggaggccagggcttcgttcctgctgggcctccttacttgtcccttctctgccttcaggcttggcccgcctggcggtgggggtgtggggggagtttcctgcctatgactccctggattttaaaggaccaggttcttggctact

SEQ ID NO: 644 - DNA, 37773 bp, Human
ggcttgttacctggtgtctggctcccaaaagaggaatcggaagctgaagatcttttaaaaactggtctgcaactggcaacagtgtcacttccactgtgttcttttcatcaaaagtgaaccataaagccaggctagattcaaggacagagaaaacacattttatctcttgatgtgagaaacaaaatgcacatggaagtaaatgggaaaaggtgaggagttggtggaagaattgatggcagccatttttagagactagctccacaatgtctacagcaagactttccatctcctgtaagccctgttcaaactctattaaagtgatcaaattcactttaggaggcaactaaatagctgaaatagtttgtatattagttcctgcacaaatctcacgttaaattgtaatttccagtgttggaggtggggcgtggtgggaggtgatctgaccatggggtcaggtttctcatgatggtttggcaccatccctttggtgttgtccacacgatagcgagtgagatctggtagtttaaaagtgtgttgcatccacccgtttctcacacctgctttcaccatgtgatgtgactgctccccttttgccttctgccatgattggaagcttcctaaggcttccccaggaaaagatgccgctctgctttctgtgtggcctgcagaaccatgagccaattaaaccacttttcttagaaattacctggtctcggatatttctttatagcaatgcaagcatggcttatacaataactttagattcagttttgaggtctgcatcaagatctctgaaacttcacaaggacagcttccacaccccaattcacttgaatatagttccattcaatggttattgaacacttaccaaaaacaacaccttattattagcctttttcattcattcaacctcatttctccaaaacttcccgggtctcctgcccttgttcttactactgggcctgttgccacatgacattgtaaacctgaagcatcacatgcctggagtgtctgtttcactgctccttgttaccactgttggaataggcttggaacaaaccctcacatcctcttggaatcctaggtagactcatgaccagtggtggatacatttttggggctccttcctgtctgcagttactaattcttcttgtatcctcctaccctcacctcaggtaaacacttattttgctttcataccaaagtaaatttagttttcatttgtatttcatgttattctctacatatgtgtagaagcagcctggagctttgatgtgctcagctgtgccagctttacctttattagaatactagactcttgacggaggatgttatctagacttcaccaagatggtttctagacaaaactcattacaactattgtggtctcagagtttttgaagtattaaatggtttcagttgctctatcaaaggaacaatggagttttcaattatatgttatattctgagactatctctcaataggaacataaaaactcaagtaactttagactttaaatgtattttcctttatgtattaataaattattgctttataaaattggtgttggagacataatttttctttttcaaaattagaaagttaatcacaaaataggctttagtgtttatctcaaaggtcacacttttagagattagttttacaagaagaaaaccaaaacccacagttgagaaattgagttgaaagttaatattctttacaggaaattcctgtaaaggaaaccagcttactcactctttcaactaaacccaaccacaaactttatctcatcaaggaggttggtcagagaagagtttgagatgcttcttcttcagagcacttcctactgaaagaggtagtttatctgattttcctctgtatgaccatccatttcacaatgtccatggtcatttacaaaataaggttttcctttttcctccagttataatcctttatttttgagctggtgtaacgtggctattgtgtcttctccaggtatctctctggataggaagaaatatagtagaaccctttgaaaatggatattttcacatattttcgttcagatacaaaagctggcagttactgaaataaggacttgaagttccttcctcttttttttatgtcttaagagcaggaaataaaggtaagagagcagtacttcttttttttcactagatttcctaaccagaaaacataagttgggagaatagcttaaataatttaaaaaatgagttgctaatacaattacttttcaagaaatattttagaataacaaaatgggttatttactaacaaaatttacatctccatatatacggagtcttcacttaaaaaaactgatggttataaaataaacccgtttaaagtgctttgagcattttacaggaagggctaagagcagagagattcaagatatttgccaaatttgaatgcccatttaaacttaactgtaacatctttgatggcaggtactacagcttcattttctgttatccctagacaatggggtctaaagccaccacggagcatctgagaatcataatgatattagttaaattaaatactgtcactattacacgagaccaaatctctgtctgcaggtgttctctgtgtaaagtagtttaagtctgcctttgatggtgacatttctctccctgggtctcagatccctgttgacactgctttctccagcactttcctctctctcccccgtttctcaccaaaaagttttgtgggtaaagtttagttcattatttctgccagagacagctgaaggtgtagccttgaccaactgaaagggaaatcttcatcctctgaaaaaacatatgtgattctcaaaaaacgcatctggaaaattgataaagaagcgattctgtagattctcccagcgctgttgggctctcaattccttctgtgaaggacaacatatggtgatggggaaatcagaagctttgagaccctctacacctggatatgaatcccccttctaatacttaccaggtatgtgattatcattgagaatgggcactgccattccaagcaatgtgagccttggttgtccatctgtaatatgagaaagacagcaccccgcttcactttacagaaagtaaatgagtgccacattattttattcccataagcagagtctgaagcttgctttggcttaagttgcccagtgctcaataaatgatgtactctgcattttggtggctccttccgattcggtgaagcattttagtgacggcagcatggaagacatcacttagacattagatggccttcaaaaggtagatattaacaagcaagccacacagtgtgggtgtgttgtcccacataaatgagacttccagaatggtcttgggctcatgttggtcagttgcctacaatgctggcaacagctactgtaactcagcactaacccacctccccaagctctatgcttatccctgagcagggtttcccaaaagtgtctcccagatgagcgtggtggctctgacacttgtttataatgtaggttccattgttcttctccttgagaatctgatttaataagtcctcaggaagcccaaaaatctgcatttgtaataagggtttcgggtgattcttataatcaagatgatttgagaaacactgtcccagagtgatagctgcagcctgcaatcagccccaggcagctggaggtctgaggccagttggtgggtgggtgcatcagtaggcagtatctgtcatctcaaggttggcggacattcctgagtgctggagactgctgggcatcgtggtaactaatttgctataggcttggacatttagacataaattgcgggatggtagagctgggaggatcttagcaaccatctgatcttatgatttacaagtcagggagcttttttaaaaattacaaatatcccgacttaaacatcagaaattctgattccctcattctaaggtggaggaactactgatacagtccagacattttattttgcaggtaagaaagctgaggtccaaaaagagcctaagtgacttaattggagccacacagtatgtgaatcaccataatagattgctatgtgtttgttctgatggctctggaagtgtttatcattttttcagaacacagaatttattactaattgttcatttggcactctcctaggatcaggatatatgatttctgaaatgggatatctgctcttcaggagctcccaatctagtgggaggacaaggtgtaaggaacaactgatctactgcagcatggttaaatcctgaacaagtcattactgagctcctgttatcagctaggcactattcctgcagagaggctgcaggactcagaaagacaaactcagttcctgctgggatggaacttatattctagttggggagaagttttaggagtaagatattttcagacaataatatgtgctaagacaaaagtcatttaaaatgagtagcaagagagatggttgatggcaagaagggagagggcgcttctttatccaggtggtcagggaacgactctctgaggaagaaatcagggaagacatgagagagccaaacgctacagcattttgtccatggtgctctggaatctgtgcttcatcacatgggtggtgggagccggtgacgttttgggcatggaaatgaaatgcccaggcttgctgcttaggaagatgtgtctggtggtggagttggaggactgttctttcggagactttgtggacaagggaaaggcaagtggggagaccacatctttaaaggccattgctgatcctgccttgttccttggttgcagtccttgtaagaagagctgtcagttgtcagcaatggggataatgcagtgaccttaacacctatccgtggcattctgcaaggcgcattgcacagaaccccctttctttcttccatgaacacgccttgctctcagcagacagccaggtcagcatcagcagccaggtggtagcatcctgtactttcctgtactttctggctccacctggacaaagtggtctgggcagactttccttttcacctgcatggttctacctgcctcttgtccaagattaatctccccatggtatcagggaccccacttcttctggcttcctgggagaaagcagtccatgcaccctctcctcactctcacttgtatttgtcctcactgacctgctgacgcattcccctcgcagtggaatcctacccaaggccctctcatctccagaaatgagcaaacacttcctcctgtcttcctgcatcatgcagactctaggaggcgtggttcttccccgcttcccacattccctctactcctctctctccaccctgaagctctccgttatctcaccccagctgcacatgctgagcttttggtggccaaaccaagactctttggtggacacttttcagtccttctcatgcccaactcctctgcagcttctgaaactgatgtctagtctctcctccaagctttctctgtctggattgccaaggtggtctctctgctctgctccttgcattccttttaggtttgtcattctttattttccattagccctggcctacttttaaaggttgaggttcctcagggaagttcatctgccctcccttatggggcaacagaaacaatccaggcttgttacagatgccccaggctccctccagctgctgaaactgagaccctgctctgagccatatgcctccccacccctctgccctgggaatgctccagctggatccccaagatatttcaagtaagtggtttgaaaggtcccatgactgccttatcaagagaggggactcaagtcctttggacacagcccagatctgattctctggaggggacctgctccccctttcatatttgagagttgatagtggtgccatccagtgacaattttccctcttgcatgtggggcagggagaggtaggtggcctctattctctaatagaatagactagtatatgcaaacattctcaaattttataaataggagctatatctctagctttcctaaccgtgaaaaatctgacagttttattcaacttgggtcattttttcaggaaaagttaaacataactcttttcaaattactcatggaaatacacatgctaggtgagcacatcaaagaaaaaagattaatgaggggaaaaatggcattaaaagaacacactgcatagagcctagggatattgggagcttgagatgatttgtaagaaatgacacaagtgaaaaggttgctacacaccattggaaatactcacgtaagttataggcaagtgaaggccggtttgggtaggacctgccctttcaaagcttcctgtgtgagatgcactttgttcactggttctgacttcttcatttcccatttcttgatttacagaaatgaaggggatactcagggcagagttctgaatctcaaaacactctactctggcaaaggaatgaagttattggagtgatgacaggaacacgggagaacaatgctctgtttgggctggatatttctttggcttgttgcaggagagcgaattaaaggatttaatatttcaggtaggggttttcacttttcatgttagcactgtgagtctgtggtcaagtgtaaagtgatggataacctgatatatcagcagtgtgatatattaatacaaacctttccatcctactattaaaaggggactgagaggagaattattagggtgaacagctttcagctgataccaagcattgtcgaggtaccctgttactgtagttgagtgttcagtgagatcagctgacgagggatgagccagagttctaccatcttttccaggaaaccagggctgctgctggtatgctggagtccactgggagggaattagaacaggcacttcctttcccctacaaaatagacagtgaagaagaaagacacacaaggaagctagatctcttgttaaatcaagtactagatgtaaatataagctagaattccattttctaatgtgtttccatgtgctttgtttattatgattttcaggttgttccacaaaaaaactcctttggacatattctacaaggagtgaagaggaatttgtcttattttgtgatttaccagagccacagaaatcacatttctgccacagaaatcgactctcaccaaaacaagtccctgagcacctgcccttcatgggtagtaacgacctatctgatgtccaatggtaccaacaaccttcgaatggagatccattagaggacattaggaaaagctatcctcacatcattcaggacaaatgtacccttcactttttgaccccaggggtgaataattctgggtcatatatttgtagacccaagatgattaagtatgatccaaatacatttctatctgaaaacatttccaaatcctctattatctagacaaaatatctatgttcacaggatcttgttaatttcctaggagcccctatgatgtagcctgttgtgtcaagatgattttagaagttaagccccagacaaatgcatcctgtgagtattccgcatcacataagcaagacctacttcttgggagcactggctctatttcttgccccagtctcagctgccaaagtgatgcacaaagtccagcggtaacctggtacaaggtaagagtgaattctctaaaattaatataagagcattgtttttatggtatcttcttcatgggcttttcatggaaaagcgtgtttgagaatctgaggtatacagcttctcaaaaactggccctgtgcctctgcaggagatctgactttctaaaataatcatgttccctgggaagccacagagcttgatattctaattattagaggcatccttttgatcaacaccagagaaacttctaaaattcaagtatattacacatgaggttagacataaacctactaacatctgctaatgtaggaagataggttcactcattttcactgtcttaggaaagcaacaggcattgcaaaggggaagggaggactcaacacataagtcttgaagggtttgtgaaagttacaggagcctgaaatacattcccaaaagacagctcttggaggacagttaggacgaatccaaggtgggcctgagtgacagatgtcttgcacaggtgagatggtggaaaggagtacagtgcaaatagaaaaagggaacaagagcaagtttcacaatgacttttagctatgaaccacatgtacgtgaactcccataacaaaagcacttcatgtttccatcgtgtttgatagtgtttccaagtgctagcagatgatgaaatgctgcctaaccatctcctccaaaagagccccctgtcagttgattcttgggtggtggaatccaggaatagaatctaaatcacttcctacaattgcaataactatttgaagttcaatactttgtcttcaaagttatgcagaattttgtattcaacctcataatatatgtgtttgttaatataaaaatatcattctaaattgctactgattaaaatcagaaagatgagttatctaatggtttaatgcaccccaaattttaagaatgagagtctcctggggatacagttaccatggtaagaggaaacatttccctacttgattcctgagactccaggctaataggaagacagatgttatcacatcctttacagaaataaatatacagggtggacgaacggcatggggtatggtctcaaatttgtgtttttatatgacactgaaagaatgctggtctcaataaaaccctaatttcagaaacattcatttcataacctttaaaatgaggttagtaagaagagccaatagttttgttcattattttcagttctctctcaagaacaaaacttcctttggttcaaagtatccgtcatccaggatggcagctgtcttgttgtcttggtgggctgttctcaggcctgtaaagcagtcttgtccccgttatttcagatgaaaatgtgtttggcttttcaatgatcatacacctgaagtgaaagctatgaatttttacttttcaggtgagcacaagttgcataatagtagccagctttctgcaaatattgcttttataaactaaaccctaaaactgtatgacattcacaaaaggaagctttgtttcacttccctggggctttgactgcaaacgtcaacatgtgtttaatggtgaacaggcagccaccttaagaataggtgaacaatggctgttatgaaaattgtacctctgatacagatttggacaggtcctggttttgtgaattacacatatgtgtgtgtgcactcacacatacacatgcatataaaggcacatagtaacctggaaatcacagaccttatggcagtagtacatcactaaaagtgatggcattaggcaggaaaaaacacctaatgcctttttccttcatgctaacccccaggttctcaggtggtgggtaagtcatacctacgacccatctctgaataggtgaagctggcactggctgagagaatgaaaacatggctttactgaattcaaataaaactgctgaccagggatacacccaccagatatacagagtatacaactgaaataaatccctgggcttggagtctctggagcattccacaatatttttaattggcgaattaagaacaggcttgcagattgtttaaattttttttcaacttctttattttaaaattatttttaattaacaaatcataattgtatacatttacaatagattaaatatatacaatacatttaatggtcaatagattttaaaaaaagatgccaagaactcacaatggggaaaggattacctctccaataagtggtgttaggaaaactggttatctacagggagaagaatgaaattgtatctcataccacatgcaaaaaaaagtattgatgtgatgttttgatatatgtatacaatgtggagtgattaactcaagctaattaacacatccatcaccttgcttactttttttgtggacagacatttgaaacttactctcttagttattttgaaatgtgcaatacaatattattggctatagttatcttgctgtgaaatatgcctgaaaacttaactcctcccatctatctgaaactttgtactctttgaccagtatctccccattcaccctcttctccccaccaatcaagcctccataatcatcattctattctctacttctatgagttcaactttttaaggttctatatatgagtgagctcttgcagcatttgtctttctgtgcccggcttatttcacttagcatagcttccaagtttattcgtgttctcccacatgattgaatttccttttgtaaaggctgaatagtatttcgttgcatacatgtaccacattttctttgtccattcctctgttgatggacactaaggttgattccatatcttggctattgtgaatagtgctgcagtaagcataggagcgtagttaaccctttgccatactgatttcaatctctttggatatgtacccaaaagtgggattgctgaatcatatggtagctctatttttagtttttctgatgagacttcatagagtttctcttaatggctgtactaatttacatttctaccaacaatgtacaacagattaatttttttgataaaagccactctaacaagtgtgaggtgatatgtcattgtggtttcaatttgtatttctatgatgattagtgatactcagcattttttcatatagttgttggccatttgcatcctttcttttgagaaatatcttttcaggtctcttgcctatttttaaaatgggctatttgttttcttgctaatgcagtgtttgagttccttatatattcttcacattaactccttatcagatatatagcttgtaaatattttccccatttggtgggttgtttcctttgctacacagaagctttttagttttatgctatatcatttgtctatttttgtttttgttgcctgtgctttcagggtcatattcaaaagaatatttgcccataacagtgctgtagagctttccctctatgttttcttttagaagttttacaactttaggtcttctatttcattctttaacccattttgaattgatgggttgtatgtgctatgagatacaatttcattcttctccctgtagatagccggttttcctaacaccatttattggagagataatcctttccccattgtgtgttcttggcatctttttttttttttttaatttattgaccataaatgtgtgggtttctttctgggctttctgtcatattccatttgttcatgtgtctgtttttatgccagtaccatgctgttttgatttaaatggcttaacaatatattttgaaatcacggagtatgaaccatctagctttgttctttttgctcaagattgttttggttatttggggtcttttgtggttccatatgaatttaagggtagttttttgtatttctgtaaaaaacaacgacattttgatagggtttgcattgaatgtgtagatcactttgagtagtaaggacattttctcaatattaattcttccaatccatggacacagaatactttcatatttatttgtgttttcttccattccttttgttagtttttttttttttataattttcagtatataggtcctttaccttcttggttaaatttatacccaactattttactatgttagttcctatggtaagtgggcttgtttacttaatttccttttctgcagacagttcattttcagtacagggaaacactgctaatttttatacgttgattttacatcctgcaattttactgaattcatttatcacttctaacagttttttagtggagtctttagagttttctataaatgagatcatgtcaccaacaaataaaggcaattttacttgtttttctactaaaatgctttttatttgtttctcttgcctaattgctctggctaggacttccagtgctatgatgaaacgaggtagtaagagtgcacattcttgttttgttaatctgttcttagaggaaaagatttcaacttttcacagttgagtatagctatgggtttgtcatatatggcctttattgtattgaggtacagtccctctatacttaattggttgagggtttttatcatgaagggtgttagattttgtcaaatgatatttctgcatcgattgagatcatcatacagtttttatctttcattttattaatgtagtctatcatatttattgattcatgtatattgaaacatccttgcatcccagggataaatcccacttgaccatggtgaatgattcttttaatgtatggttgaatttggtttgctaatattttgttgtggatttttgcatctgtatttttcagatactggcctacaattttcttgtactggccttttctggctttggtatcagagtgatgcttgattcataaaattagcttggaagttttattactgattcagtctccttattcattattggtctgtttagattttctgtttctttatgatccaatcttggtaggttgtatgtgtctaggaatatatctgtttcttttaggttattcattttattggcatataattgttcgtagtagtttcttataatcctttgtatttttgtggtattggttgtaatgtctactctttcatttctgattttatctatttgagtgttctcttttttcttagtctagctaagagtttgttaattttgtttttagttttttcagtaaaccaactcttagttttattcattttttcctattgtttttctaatctctgtttcatttatttctgcttttatctttgttacttcctttcttctgcaaactttgggcttcatttattaccctttttctaacatctttctgtgtatcattagattgcttatttgaaatctttcctgtgtttcaatgcagacattcattgctataaatttccctcaggactgctttcgctgcatcccacatgttttagtacactgtgttttaacttgtttgtctcaatttattttttaacttcctttttatttcttctttatcccattggttgtttaggagcactttgtttcatttctgcatatgtgcatattttccaagatattttctgtttttagatttctacctttatgcctttgtagcccaaaatacacttgatatgatttcaattttcttaaagttgttaagacttatcttgtagctgaacgtatccttcctggaaaatgttctatgtgtacttgagaaggatgtgtattctgctgctgttggatagaatgttctgtatatgtctgttaggtccatttggtcaaaagcgtaattcaaggccaatttttgaagtttattttctgtttaaatgagctgtccatagttgaaattaaggtattgagtttcttactattattgtattgcagtctatctctttcttcatttaataaatgcgttatatatttaagcgctctaatgttgggtgcctatgtatctacaattgttatatcctcttagtgaatggactctttatcattatacaatgatctttcttgtttctttttatagtttttttactgaaagtctattttgtctgatataagtagagctatccctgctctctcttggttttggtttgtatggaatatctttgtccgttttttcccttctagtctatatgtgtccttattagtaaatctcttgaaggcagcatatagctgaatttttaaatgtcttttgattggagacatattgtaaatggtttgattaatccatttacattcaaggtgattattggtagataagcacaggctgttgccattttgtaacttattttctgtgtgttttgtaggttttttgttacttatttctctgttagtatcttcctttgtgtcttgatggctttctttggtgctatgctttgaatcttttatattcatattttgtgccactactacacgtttttgttttgtggttactatgaggcttccataaaacacttcataacaggctagttaagctaataacaacttaactttatatacaacaagtacactttcatttcctccccgctaccttttatgggtttgatgtcaaattttacatttgttgtagtttctgtttcttaatgattaattacagctaggattgtttttattagttttgtctattaaccttcatagtaatgataaattgctttatataccacccttacattattaatgaattatgaatatgactatgtattaactattaccattgaattttttactttcatattttttgttattaattagcaggcattcatttcagtttaaataattccttttagcaattcttaaaagtagaccaagtggtgatgaactcccttagcttttgtttgtctgggaaagtttaatttccctctcatttctgaaggacagctttgcttggttggcagtttgtttgggtttttttccttcaacactgaatatatcatcccactctctcctggcctatatcgtttctgctgagaaatccactgatagcaatattgggactttcttgaacatgatatgtttctcatctcttgctactttcaatattctttctttgtctttgaatttttgacaatttgattatgatgtatcttggtaaaccccttttgggttgaatttgattggcaacttctgagtttcctatgcatgaatgtcatctttccctagatttaggaaatattcagctgatattcccttaaatatgctttctgacttcttttttcttccatcttccaaaattcctaatatgtgaatcttgaaggtgtcccataatttccataagccttttcattcttttttctttttgctcctctgactagataatttcaaatgtcatctctgatatcacggatgctttcttctgcttaatcaaatctgctgttgatattatagttcaggtattatattctttatctgtaggatttctttatttttcaaatacccacaattcagggagaaggatttctatttaaaacttttttttctatttctctattattaaacttttcattttgttttgaaaattgtttttaaaatttattttatttttatacatattttcttgtagtttcctaaactactttaagaggattattctgaagttttgtcagttatttcttagatctttacttcttcctatttcattatgatagctttcttagtttcttttgatggtgacatatttccttgatttttcataatcattgttccttgcattggtgcctatgcagttgaggaaacagccacctcttttggtctttgtaggtgatctttggtggtagcagaccttcactatgtagtctagcctgggattccaggtaggctagttggtagcaatcccagataagcagactttggtgttgagttctctaggtgggcttggctgttttctgtgcactgaggtcaagtggaattgcttgctgtgctttgcgttccagtgagaccactttctgaactctatggtcaggttgagtcgctggctgagctctgtgattgcctctgatcaggcaaaattgcagactgtcttcccaaatagcctgcaactttgcctgatcagaggcagtcacagagcaatacccttgtgtcttccattcacccacaacatgaaggaattgcttaattaactaaaagggcacccaaatgccctacatctggccgagaaatactgttgttagaatgtgtagttgggcaggacaacaggctaggccctgaggcaaagttagttatctgggattgctgctcagcaatttgggatgggcagggggagaaactaggctacaaagatgtgtgtgggcttgatcttacccctgggccagggatagccttaggcagggcattgaggcttgattgggttgccacgcaccttctggacctgggtggggccagctgctccttctgcagataactgctgacctgcctttgcctcctggcctggggaaggctgcaggaaggtgctggagcctggctgggtcaccatgcttggagattattaattaaaatatttaatgactgaaaaagtcagaattaaagtgagttatttattatttatgctactaactttttctatatatttttctaatttctaaaaatgtaatgaaaaaatagccttggcataaacaaacttcatcttaaataaataatagttacatgtaatgtaacggcattttatgatcttcagctaagcaaatccttgacacaagtcaaaattataatcaagggtagtaggaaagtctctcctgtactggcctagggcaccgagatatgagttttgacgacattgctgtgacctcctgttagtaggacttgcaccttgaataacatttccattggtggtttaagacaatctcactcatgccacattctcttgccacacttctgacatggctgctgggttgattttaagccctatgttgcatggaaggtttttgtttgtttgttttagagataggatcttattctgccacctaggttggagtacagtggtgtaatcacagctccctgcagtcttgaacttctgggcccaagtgatcctccagccttagcatctcaagtagttgggactacaggcacataccactgcacccagctaattttaaaaattttttgtagagaaggggtttcactatgttgctcaggctggtttcaaattcgtggtttcaaccaatcctcctgccttggccttccaaagtgctgggattacaggtgtgagccatcatgccaaccacaaagaagtttgtttgttttttgagatggaatctctctctttgtcgcctaggctagagcgcatctagctcagtgcactgagctagagacttggctcactgcaacctccacctcccaggttcaagctattctcatgcctcagcctcccaagtagctgggattacaggtgtgcgccaccacacccagctaatttttgtatttttagcagagatggggtttcaccatgttggccaggctggtctccaactcctgacctcaggtgatccacctgcctcggcctctcaaagtgctgggattacaggtgtgagccatcatgccgaccccaaagaagttttgtacctatacctgatacttctcatttcctagttcttgtaactggcacctgttggcatcctgtgggcctagtgctgtggataactggtaagcatggtgagactggctagattcaaagattaatgtgtttctaaatagagaataagttaatttaatgtgtttccaaataggaagaagataatttagattatatttctcaaaactgtttctagggttgaaacattggcccatttgattattctcactatgaacatttcagaactctgaagatctggacagctttctaacacctgttcaaaacaatcatctgtatgctgtctaaccagcactgaaacagaggaagaatttccttacttgttcagaacagaatattgccacagccccactattgttttagctttgggacagcctcattatatggttgatttattctgagttggcaggcaagtctttccacaaaaactgaaatcaagcaagttctctctatttttgtttgtagagtagaatttgtaacttatgttcatgattttatatttatttctgttaaataatttgttgtttttagttcattctacatgtcaagaggttggaattctgattttgaatgccgacatattagccatcacacgcaggtttgtgaggcatgtagatgagatcaacatggtatgttctccctcaagcccctgctaaaactacgggcgaggctaacaccagggacagagtgctctgctgttaactccagtttgatccttctagttacatatgatccattcatccacaacgcaagggtgttgcttaattaactaaaagggcactcgaatgccctatatctgatcattcagctcacaatgtacctttggtttaacagagagatcatgagaatatttttcaagtgactcacaatagtgaagatactctgtgtctgccatactcctgtgaacctccagtctattcagttgtgggcaacaatgagattgccttgatatgattgttgttagcaaatgcaagctggctgatattaaccatcacttccttttctaagggttcataaaccatctgttaaataattaattcaagactttcactagaaattgacatctagcccattatcaataatttccataatatactccattcccattaaaagataaatattagtaaaaaaaaaatctatcaatagaatgttgttagttgataactggggcaagagactgcaactacacttaacgggaaagagcaacatagacaacagaaacagaaaagcaaagggtatgttcagtgtatggtcacactgagtggctcactgtggtgggagctgagagttcttaagtggtttaattaggactagaatggaaataaaggttgtgtggttctcatgatggttatggggaccttgctgatgtgtttgaactttatgagtgtgagtcctgatccaggacaggacagaaagaagtggaaacagaaagaaggtggcagatgctagtgatattttcatgtaataaaatgaaagattaaaagctttgactgggagtgtgtgtaaaatagatgagtagcatatttggtgtttttctggctcaacatatatgagatagtagtagtaaattcaattaggagcaggaaagctgtgatgaatacagacctggacacaatgagtctatgataaggaacattaaaatggatatgaaaacctgaaatgcaccagggagaataggccagggaggagagtgaaagaaatgcaggtctttggagtcctcccagactgggtagtggaagtccagctaggagctccagtgtgttgtccaaatccaggaagtaccattcccatagaataacacagtgtgcgtgatgctcagtagctgtactgactggtagtataagaaatcgataatactgcagtataatattataatacctgcccctagtagtaagaataactgttcttctccctgcttcacatatacctttaaaagtcctttgcagtgtcttcattttttttttttttttgcatgcctccactcttttgaagacttacggacattattcattcagattcacagtggcggatgttcctgtttccatattctgctcatgactgcttcacatatgagcaaaaccaagagttccctgtgcagctgcattagcctctctttgtcctatgaggattaactgtaattgtattattagaatgggtttcccatcatccttggcataaattgcttctccctaatttcttttctttgatatttcctctaagttccatttcataaagtcttaatgatacatactaagcctcacttacctatttatgggtaaaaaagatacattattccccatcctcccccttggcttaggtgaggtcttagttacggctctgtgtcctcccaccattacgttctcatgcgatttatgacacgcctctcccctgaattctgatctttatatgttatcactgcgtcctctgaagttttatctttgaatttccccctatgttttaaaacttccttttgaaaagttcctgattcttgagatcatctggtatatatttagccttgtataccactacctctttgccttgttttgcttcctgcccacagctgcacttctctggccactctgcccccacccttagtctcctttccagcctgctggaaattccttcttggaccacaggaaacacacgagggatgtggcgtgggggaatcccagcttctactagtaggcaggcaaagtggaagggaaattcctcaatcagaaaataaaactcagaaccagaaaaaaatgaggttgattctcagtgctctcacttaccagctttgtcagagagagaaaaaaaagccactcacgttccagaacctctgtttatataagtttttatttataagtatgtatctgtttatatacgtaaatatatacaatatatgttatatatatgtgtgtgtatgtatatatatgtgtgtgtgtgtgtatatatatatatgtatgtatacacacacacattaaaaaattcatttcagtttcagcccttagaacactacaggtcttccagaatactctcagggctccaagtcatgcatgctctgggaagtcctttgttaaatagctgtttaggggctgatcaggtttggaggtttgactctctcatctctacacataatgcaattgtattggaaaatgcctcttgtttcaaatctacaagtacagtttttgaacacaatgtcttcatagcttgtgagatacccttatctcagattgaccttcttcctccctgttcaaatttgtaagatttttctttaggtatgtatttcataaagtttttctgtggcaaatttatctgcttaaaatatcttttggattagaatggaaaactcctctctgtggaaaggagcaaccgaatcgtagtggatgaagtttatgactatcaccagggcacatatgtatgtgattacactcagtcggatactgtgagttcgtggacagtcagagctgttgttcaagtgagaaccattggtaagtgagatttttatctcaagatttgagatctgagcagcaaattaaaattatcttcttttggcttagtaagtttttcctcttagggaaagaaaaggatagtcatatacttgtaatcatgtaaaacctttcatgtgggcaaacatcaaagttgccatcccccagggaaggctaagttctgaaacagtttcaaattctcacaagttgggttgtccatgaatatgtccctgatttgcttttgtaataaatttaaaaaatgtatgaaacatttcacacacagaaatattgtgacatccaggtacctatcaccagttttaactatgttaccattttcccacatgcttcaaatcataattttttttctttaaagtaacaaaatattgcaaagacaacttgaggtctatgaccccattctcttccaggcctttgctcccacagtatagtaacatcttgtcatttatatcatttccatttatgtttttatgctttttctacatatgtatgcatctattaacaaaatagaatattgttttgagttatgaaatatgtttgtgtcataaacacttggtattttattaaattattggtttgccaatttacagccccattagcagtaaatgccctttattcccaaataatacttggtgttatcagactttatgactggtgttaagtggagctttgtttttatttgtttcttttctgctccatagtatacttccctgactaatatgaggttgaacattttgctatatgttttttggttcattggctttcttccgcaacttgtctgtttttgtcctaacctttcccttgggtcgttcttaccagatctgcaagcatcagcttgaatcaactatgtgatagaattaatttaaatgtggtctaagaagtgaaaacataagacagccagtcactcatgctttatatcaaagagcaacagagtggttgacgtagctgttagttaagatattaatcttttcttattacaagatacaaaccacacagagcaccccaagaccaagtgaaactctcctgccccttgcaccctctagcacttcagaattattttatattaatttagattacatgttatatagataagatttcattttatattattagattgcttcttgaaagagaagttagaatgtaaataccccactcgcaccacttttcccctccaagtgatgtgtaattgttctttaactcagccatcactcagcccctcaaattctcaatggcataatctgcttttctgtcacccaagggacaccttgcaacatctgttgcatctatttcagtcaagccctctctgttgtcatccctgtcttcctcatttaatcattcattctcatatttattcatttccacacaaatatttactgaacatgtaatatgtgtcaggcttggagctaaggctacaagaatgagtgcccggatgctttatctggcctccaagaactttccattttgagaagaagacaaaggtgaagcaggctgtcataatacagtgcagcaagagaaaggagcactatgggcacatggaggcccaccagacccaacctggggaagcccgctccaagtgagagctgatggatgaggacacaccagctcagtaagggtggggagcttccattccagactgaggaagcagcagagctgatgtccaggagatgaagaagagcatctgggagtaggactgacatcacactcttctaatacgtgttaaaattatctaattacctaattatctaatacgtgttaaaatttatgaaggaacaatggggaggcattgaggattttaagtgggagaatgtcgtgactgaatttgtattcaagatagatcaccttgtttgctgggtcggaagtgggtttgtaagagcaggaatggaggcagggagaagagttaggaagttctgtggtcaagcaggcagttgctgatagggatctgaactagggagtggtagagggaatggagagaagtggatgactttggaaatgtttaagaggtacatttaaaggatttggtgttcgggagcaaggaagagggaaagcaggagccatggatacaagccagcctttgagctggtcaaggagggaatgtgctgacagagcacaacagtacagaggatgagagcaggcacagtcgtggagcagcaagcttgactcatggttaaaccatgcctctgcttgtgctgtaaatagacctagcagaggtgatgagaagtagctggacttgtaggtcaacagagcatgataatggtttttacataaaaggtaggagaaagagaagaatcaaggatgttttttgttttctgccctggataagttagtgaatggtggtaccatttaaggagactgaaaaagctgaagggaaagagcatttgaagaggagattaagtattaggcttaaaaggacttttagtcatccaagtcatgacgacaagtaggtatttggacaagccagtctggagaagttagggctggagatgtgaatgtgaagatgatcgatttttacataatatctgaagccaaagagctgaatgagatcacctaggaagtgggcatagagacagaaggggctagagccaaacccggaaatgcttgaagaggtggagaagaggaagacaatcctcaaagaggatgggaacatacatcagcaagtgaatatcagtggaagggtggtgagaagagaaacaaacgaagtgaaattgatgatgtaggaaagacataacctcaggcaccaagacctttcatagggaagaggcctagagagtaaacttactacccaggggtatcaggaggagtgaaagaacactaggagaggactaatagttaaaagagacacagaggaagggacaggcacagagaagtgaatatagcggttgaaagtaagcagtagagtacgggaacatggaaccaaaagaagagagggtttcaaagagagcatggccaacagtgtccaatgctgctaagaggtaaagtagacgaaaaatgtgattatgcccaatggatttaggtgcataggtggcactggtgaatttggttaagcagttttagtggacagatggcggcggaaatcaggttccataggaggtgaaaggatggagggaattagcacatagaactgcctttcaagaatttggctgggaaggaaggagaataagtgaggctgggatataaggcagggtgtgttttctcttttttaggatgatgagactgagcatgaataaatgttgatgagaagaagcccagagaaagagagagagagagagggagagagagacaagttaaaaatacaggactgagatggtgcaaaggggagaaggaggtctctgagaagtaaaagtaggtgatgtcaacagcaaagaccctggatttttctttatccagaaaaagacacaccttcaggaggaagtttgacattggaggcatatttgacagtggaggcatatttgtggcaagaagttgatggataaaattgttaattaaggactggactcttctttattttgaaataaaccatgagtttaaggatggaggggtggactcggatatgcttgacttgcacagtttcttgggtggattctcctttcagttcaattactcagccagatggcaccacaaagaaatcttgtgggaaaagacagggataggagctcaggtctgcaaggggcaggattagtgtgaaagagaatgcacacaagcagatatggatcaattaacaactaatgttttaccagcacccacaacctgatgtggcagtcattttagggggcaagctttttacatggaaaccggaattcctaacttacaggtaattagtaaaatgtgaagacagagctccaagacatttagatcaaagtgtggctgtgcacctaaatcttcatcaagcaggccttcagactttccaatgcaaatagtaatctttgttttcatctttcagtgggagacactaaactcaaaccagatattctggatcctgtcgaggacacactggaagtagaacttggtaagctgggcctcatcgcctttgaatgacatcgtgctgctgggagcaggtctaagtgtgatagaaggaaaacagcattgggatttccagtcaaacagaattgggtgtgaatcttaactcagccattgactagttttgtgactttgcacagttacttcatcctttaagcctcagtacttaaatccgcaaatagctatcataaaactgaccctaaaagattatattgcaggccgggcatggtggcttatgcctgtaatcccagcactttgggaggctgaggtgggtagatcacttgaggtcaggagtttgagaccagcctggccaacatggtgaaaccccatctctactaaaactacaaaaattagccgggtgtgggtgtgggtgcctgtaatcccagctactcaggatgacaaggcaggagaatcacctgaacctgggaggcggaggttacagtgagccgagatcgagccattgcactccatcctgggtgacagagcaagattccatctcaaagaaaaaaaaaaattatactgagaaataatgggacaatgtatgttaagtggctggagcatgaaacctgatcaatagattttattcttccttaacttccccaggaacaggtggtttcgtacatgttggttaggtctatcagttatgactacaaattcgccaacctgagtaacattaactcttatgaatatgacatttaatctggcatttaagagaactgtagtagaattctacaacccctgcccaaacaatttgtattccaaagtagtgtcttctttggggttgaggagaaattgacttccctgtgggtctccttttattttgtcaacttcaataatatctatgtctttctacacagacaaataagaattgctgtattaaaaataaaatgctgtttttcttttaataatataaatttttttattattattatactttctaaaatgctactaaaacatttattattttagaaagaaacataaaaatacatgttatgatataagatcactagatggcaggagtggtgtgttctgactctagaaatagcactaactatgtgctcaacgtcacaggaatggaaggaaggaggaaagaaggaggaaaaaattagattaattcatatagtcaagttacatatgtattagtgaattataaggtattaccagtggaaaaacgttaaggtgcaaagatgagtattcaaatggagctcctagtcatttcatggttaaatattagatttgaggcagagcatatgtgaatattcctcatggaaaaaaatgggtagaaaaaagttagtctcataatatgcatgcccatccatagtgaattgttcagaaaaattgcttaatatcgaaataatttttttatttaaaccacgtgctacaataactttatgatttttacttaataaacaaatattggatagtaaaattttctttatggacacaccttgtacttcaacagtagtgcagaagaccgggctgatctcagaaactcctcattttcttagttttcttagtgtctccctcaatccacataaggacccttagtgatataatcatgctcatcttcattttaagaacatatagtcatatggttgagatagaaggattgcccattagaaaaaatgtacctggttttatgcatttctgaatgagagctgtgtagacgtttcattatttctggcacacatattctacctgcaaacctgattgcatcaggagacagcttctggcgacgtcttcctcccagatgtaggacaaagtgttctcaccagcttccttcttgttttctctggcctcttcattttcaggaaagcctttaactattagctgcaaagcacgatttggctttgaaagggtctttaaccctgtcataaaatggtacatcaaagattctgacctagagtgggaagtctcagtacctgaggcgaaaaggtaagaaaaaaactcacggattctgttctctgcaattcagaagagatacttctacctttagaaatgcctaaagtatacagttgatggtgtagccaccagcaccgactagtggtgaaaataaaagcacaaaaatgcaaagtgcaaacggccgttgaatgaaatatttaagttgttttaaacctcaatttgtaggaacagtttgacgtggctgctctcaaagtcaagctattgagcagacagttgtactgacccagactgcttggagataagtaatatgtccaagaaatgggaggaaatgctgcttaccctcactctgcttttcaccggtgccacccgttcagagagtgtgggggtacagggatccagatgtgtggggtaatgaacagtctagaaaacctccaggggaaatggcatcataataataagtctgacaaaaaatatgtgaagtgaggaatacctgaagcaacttaaccccgaaaaagaggctcagaggagggctctctgtcttgaaatccttgggagctattacattgtttgagaaatttgacttggtttgttgctctctggagcacagaacccggatcagtggtttgaatttactggtgagatattttggccagtagaaaaccctagatatttggagctatccaatcacaaaaaaagttgatctccagtccccagaaggatcaaagggcctggatccagtgatgtccaatcagatgtgtctccaaaggatgcattccctgatttttcgaagatgtgacccagagtaagagtctatgcattaagtaccttcttctgatacttaacagatatcaataagaaaatgcaatatcattttgaaaagtatacatcattacaaaaaagtacagaacagattttggtcacaacaataaaatttagcaagaatttctaagatcaggaaggtcattggggcccatcttaagctgatattgcattagagttcacagtaggagagtgtagtcaagagggtatgttttgacatcacccacccttgggtttaaacccattttctatctgatgtcaacatgacccttagccccggtgagcctccatcacccattgataatctatggataatagcctgcactttgcaagctcactgggaggcgtggttacagcagaggtgttatgcctatcacaatgtgtgacaggtaggaagcactcagtgaataggagctggcatcgtggtctcagagcaacacagcctaaaacatcattcacatacacaagatttcttaacacaaagatggattgtagattggtaacttcagagaactcaaattgtgaataaatgccaagactcccaacttcctgggtggagcagcgtggcacaagcccaggaatcaagctgcccattccctgcagtgtggtctggggctactcacccaccttctttgccttgtccttgtcactggccaaggccattatgatcctattatactctagggttcctgggaggtgaggaatggaggacattagagtccatattttgtgcacagaagagggactgatacatagtaaaccttcagtaggagttggtcattttaaatatttttcttaaggtattgttattatctattctcaaggggaattcttaagagtaaggaaggtcagatgagtctcacaaataaataatgtcttagcgtgaatgcttagaagagtcaataattgaatcaagaatgagccctttttgaccatcttacattctcgtggtatcttatactattgatctcacagttctctaaaagccaaactgttggctgcttatacgtgttccaaatgctgcaaatgggtgtcaatgtatgttactgaatggagtggtattttttctcctttctcagtattaaatccactttaaaggatgaaatcattgagcgtaatatcatcttggaaaaagtcactcagcgtgatcttcgcaggaagtttgtttgctttgtccagaactccattggaaacacaacccagtccgtccaactgaaagaaaagagaggaggtaagcccagaaggttgcccaggaggcatgaaactgctttcacttgagaggggaggagttttcctaaagaatagtaataatgatgacagcgattacattttctaggtgacagacattgttttaagcactttcctggtgtcaacccatttaataccttgaccaaagccacacaactagtaaactgcatattactggtttagagctagttctcttaagtaatagtctgcgtttgggaggccatgttggaaaagcaactcattcatgcactcattcattcacgcattcattctacaatagctatggggtatgcccagaatggcaggcattgtgctaagacctagcctcctttccaatttttctttcctggctttcaaatccaaaggacatgatggattcatgttctgatgagtggagaatggaagagagaaggagtaatcttgttcattgttcaaaatggtgtgtgtatatcacggatatattaaaaaaaaaaaagctggagtagaaattctaggtaaggaaaagcgtttaaatttctttgaaaagatgcccagagatgaaattgatatcattcattcctttaattaatagataactatagttataagcaggtttgaatgtttctgaggcttcaacaagacaaagtgtgttctggcctgtagtaaacgctctgtgaagggggttttcccccatgggagtatgcaggagatccctcgtgtcaggtaagccagatgggactcctggtctcaggaaatttaggctgcagtaggaatgataatacaggaaaataatttacaatatgcaatgagagagatgtaaatggattgtgtggacgtttacgaggggaaaaaataaaaggaatatgataagtttcccaggccaccctgatcaggaactgcccattcccctggggtctctagtgtttattgtaagacaggtctcaaaatgtgattttttaaaattttattttaataggttttgggggtacaggtggtttttggttacatggataagttcttcaatctgaaaatctttagatttttgagattttggcatacccgtcacccgagcagtgtacactacacccgttgtgtcgtcttttatccctcactcccctcccacccttctccctcagtctctaaagtccgttgtattattcttatgcctttgcgtcctcatagcttagctcccatttataagtgaaaacacacaatgttttgtttttcattcctgagttacttcacttagaataatggtatccaccatcctggctaacaaggtgaagccccgtctccactaaaaatacaaaaaaaattagccgggcgtggtggcgggcgcctgtagtcccagttacttgggaggctgaggcaggagaatggcgtgaacccgggaggcggagcttgcagtgagctgcgcgccactgcactccagcctgggcgacatacagactccgtctccaaaaaaaaaaaaaaaaagtataatgaataatggtctccaactccatccaggttgctgcacatgccattattttgttcctttttatggctaagtagtattccatggtgtgatttgagaggtttccagattcacaaaaactgctgctagtggcaatgattttgataaaataatagagctggaaaaggtgctgggtgggccatagcgccggcctgaacatggtcttggtccaatcccgctgcctctatgtctcttcatactggccctgtctccacagtggtgctcctgtacatcctgcttggcaccatcgggaccctggtggccgtgctggcggcgagtgccctcctctacaggcactggattgaaatagtgctgctgtaccggacctaccagagcaaggatcagacgcttgggggtaagtttacctccacatgcagccctctgacttttcctctgggaattgacttggagcaggacaacagaaaataccatcactaccccttggctttgtttcctcagagttaccttagaaaagaacttcaaatgtcccctgccagccagggcagagcataaaggaggagctgaagaaagaaatgtccccactggataaagtcatgcccctgaggttttgaggccttcctccaggtctagtgaccttacactgaggaaggctggagaaacaattatttttttcattccagttgccaggaatcttgtaggcaatgctattgtgaaacatgttggacttaaaaataatccctctataaccaacctaaagcaatagggcaaatgagtgaatatctctgtgcctttgtttcctcatctataaaacaggattgtcatagcaccaattgcaaaggatgctgtgagggctcactgatgtattcttaagacacatttagtattcattcatttatgtatgtatgtatgtatgtatttatttatttatttattttgagatggagtcttgctctgtctcccaggctggagtgcggtggcaccatctcagcttacttcaatctccgcctcccaggttcaagcaattctcctacctcagcctcctgagtagctgggattacaggcatgcgctaccatgtccagctattgtttgtgtttttagtagagactgctgggtttcaccatgttggccaggctggtctcgaactcctgacctcaagtgatccgtccgcctcggcctcccaaagtgctgggattacagccgtgagccaccgtgcccagccacattaagtatttagaatggtgcccagtacacggtaaatagctcagcatgtgccagactatggctgtttcttgaggactagagtgtatgcctgccatgtgtgttagctactttaatggtcacagcaatcctaccagccaggtagagagacaggaagtcatgtgcctacaattgaactactggaaggcattagagcttgggatttgggcacaggttgtctggcttaagaggtttcattagctgttacctcagttagcctcatctgtaaaatgaggcttttaagacggtgggaatgcccccaaaagtgagaagtcctgtaaaatgcaagtgctattactattaatgaagtgcctgtcaatatttgaggcaagataatcatgttcattgatgtttgcttctgtggaatagaagtcttgcttctgtttttttctagtcctggaaatctccaaggttagaaggtttgcagttttagtaaatgactctgttgcttggaaaaagcagaatccccttttgcaggatttcacggataattatttaccttactgagaggcccctccaaattccagtgcgttcccaaactaggaattcagtgaggagttgtcagatccctgggggaagaaagggtgaataaagaccggcatgggaggctgggtgtggtggctcacacctgtaatcccagcactttgggaggccaaagtgggaggaatgcttgagctcaggagttcaagaccagcctgggcaacatggtgaaacctgcctctacaagaaattttttaatgttagctgggcgtggtggtacccacctgtagttccagctacttaggaggctgaggtgggagaatcacctgagccccggaggtcaaggctgcagtgagccatgattacatcactgcactccagcctggatggcagagcgataccctatctcaaaaaaaaaaaaaaaaaaaaaaaagtgaccgggagcagtggctcacatgtgtaatcccagcactttgggaggtccaggtgggcggatcacttgaagtctggatttgagatcagcctggccaacacggtgcaaccccatccttactaaaaatacaaaatgtagccaggcttggtggcaggcacctgtaatcccagctactcaggaggctgaggcaggagaatcacttgaacctgggaggtggaggttgcagtgagccgagatcatgccactgcactccagcctgggtgacagagcaagactccttttcaaaaaaaaggaagaaagaaatgcatcagtcacatctttctttaaacttactatagagaatacatactagaaatccttaagagaaatgtttttaagatttattttaataacttttttgaatgaagcaaattatgtaatcaaggtcataaaatgctatttaccttaagattctggagctggcttagaagagtcagtcaatggggaaacatttacttgtgtcctttctttttctattttgcaaagacaatgtttttagtgatcagatctggaggcagaatccagttttcaagcacggggatgcagtgccctctgttggccaacctaacattttttagcaaaatgactgctttgaagttaatgctaagtaaccaaaattttagagatgtagaatgttagaattctggaggacctcagagatcatctaatactccactctctaattttatgactaaataaatgtagtttccaggttatagaaaaattttagtttgctgggatttcacatgatatggaaggaatagaggcaactgtggtgtgttacacatttaaacagcacagcacctacctgccagccatgccccacaagtctcatccttcctacatgagcaatgaggtgcttcataggttagtttcccaacctcagctcttttatatcctcctctgttgactctgggagcttcccttttggtacctggtacttccatccaccgaggcatcattttaggttcaccttgaacatggtgtactactaaatagcatcagcaatcagggctactgtttaccgttttgtaacaatactttgacagggattgtggaaattgctggaatacaaatctgatgtatcccattccgaagcctgtgagttaagtgttgggattttctacttcttccagtgagttccttagtctcagtaatcatatgcatttatgaagtatgcatatgaaaatatcctataacaagttatatacatatagttttccatctagaatagaggggaatggacatttatcttgcacctcctatgagccaggcaccaagaagttcatatacattatctcatgaaacccttaaaacagcctgcccaggagttatgattgtctttattttacatatggggattcacatatcagcatatgggccatcaactctccgagcaagtactttttctccttggatacgatgtgctgggtgttagcagtactttgcttactggatatcatcatgttggatggggcagactcctgcttgatgtgtgactaatgagacagaaacactgcaggtgcaaagaaggctcagagaaactcctgagttcatgtgacttaatcaaagaatgcctcagccatttgacctaaaatcagtaaaaatgcaagactgcttcataaattagaattcgatttggggtgaaaaatcaataccgctcagtggtatgattttgaaatgaatttttaaaatcaatttagtcaggatcccaaatattatttcttattcatttaccatatgattcaagcatatgtatgtgtaccataacagtaaaaaaaagagtaaatgacttatgtttttataaattttcctattcttcagataaaaaggattttgatgctttcgtatcctatgcaaaatggagctcttttccaagtgaggccacttcatctctgagtgaagaacacttggccctgagcctatttcctgatgttttagaaaacaaatatggatatagcctgtgtttgcttgaaagagatgtggctccaggaggaggtaagtccaacatgtcaagaaaaactgcagtgcaaaaagggcagttcaatgcaatccccaagtcttttttgtcattctttgttttggaatatagatctgggagattacatgaggttagaacatcttgggcaacaacacagaaactatatgttccagagatgtgttccattatcaaacaaatccatctgcagaagaagacaatcacatggggccctaggcagtccttctaggacaaagatacctctcctggcttcgcagctgaaggctgcgaagtgaactactcgctcaccccaatttagtggcccctctgatttctgggactctgccttccacaaagctcactcagcactgggtcaagcaggcttctcaggcctgggccacgccctggacaccctgagaagtccagatctcagcctgtcctgctggcctcctcctcctcagatacccccaccaaggagcctgggatgttccatggctcccattatcccagcttacctagttccagtcagctttattcctagaggaattgccaatttggggagactggacacaaagcagggaatgtaaaggtgagggtcactagacactggagcgtatctccaactggcaatagagctgatacagtgtaagtggtagagtaaacatgtctcccttcctccttatgtaagagaatccattgcaaggacctctctgactcaaggtttaacaatatccattgcaaataatcaaatgttttatttccagtgtatgcagaagacattgtgagcattattaagagaagcagaagaggaatatttatcttgagccccaactatgtcaatggacccagtatctttgaactacaagcagcagtgaatcttgccttggatgatcaaacactgaaactcattttaattaagttctgttacttccaagagccagagtctctacctcatctcgtgaaaaaagctctcagggttttgcccacagttacttggagaggcttaaaatcagttcctcccaattctaggttctgggccaaaatgcgctaccacatgcctgtgaaaaactctcagggattcacgtggaaccagctcagaattacctctaggatttttcagtggaaaggactcagtagaacagaaaccactgggaggagctcccagcctaaggaatggtgaaatgagccctggagccccctccagtccagtccctgggatagagatgttgctggacagaactcacagctctgtgtgtgtgtgttcaggctgataggaaattcaaagagtctcctgccagcaccaagcaagcttgatggacaatggaatgggattgagactgtggtttagagcctttgatttcctggactggacagacggcgagtgaattctctagaccttgggtactttcagtacacaacacccctaagatttcccagtggtccgagcagaatcagaaaatacagctacttctgccttatggctagggaactgtcatgtctaccatgtattgtacatatgactttatgtatacttgcaatcaaataaatattattttattagaaatgagtgatttttttcttttttttctttttttgagacagagtctcattctgccgcccaggctggaatgcatgttcttggctcactgcaacctccgccccctgggttcaagcaattctccggcctcagcctcccttctaactgggattacagcatgcactaccatgcccagctaatttttgtatttttagtagagacggggtttcaccatgttgaccaggctggtctcgaactcctgacctcaggagatcggcccacctcggcctcccaaagtgctggaattataggcgtgagccaccatggctggccttagaaacaagtgattgaaactctgcccgaagaatttctgtaaagaagacaattcttactccatggtcagccaacaactctggagcacagaaagtgagcataaaaggtaaagactaacgggacccagaatagacagggctagggttggtttctactgtgtcctcatgcgaagtgcccacactgggtggatgaactagaagaagaatccctttttttgggggcggggggagatgcagtctgtgccaggatatgggcttggaaagaagagtagagttaatttcagctcctccttgtgatgtcggccagagatctttgtgttaggtataaaagtgtaaatccttaccctgggcccctggaagtacagaccaactggaccaaaatgatcaggccaatgaagagacaaggaatgcacttgcagtgacatacaaagcagagagacactggccagagtcagcagtgcagctaagagtctggggaataaggatatacactggttaaacagcagcaagaatggaatgtgaacagagctgtagcctgaaccttctgctgaggctggcgatcctatgggcttccgatctgggcgtctccctttaagttctcctaagtaataaggtgatgggctgcagggccatgaaactgtttctgatagacgaggccaatttcctcctcataagtgtgtttcctttaccagagtttaacctgcagttaaaatagtgttccactcacgtataaacatcaagctcttatactctgtcttttctgaaggaataaaatgatttatcatctgagcaataaataaaagcaatgtctggactcattcacatgcagtgtgtcacacccaccagtctggatgtgatccaagttcagagtggctaaaagtcattgtcgtcttggggcctgcgtgaaacactcttctgctctttattcacagaggcacccacatcataaaaaccactgtggctttggcaccaagcaacatccttgttggaaatttcagtgataaagttaacaatgagttaaagggtataaattattcttggaggaagtttcttgtgggaaggatcattgcagggtctcagtgaagaggagcccatattgtcactgtgccattgtgctttggtgatggccaggatccctggccttcctgcccgccactctctgagatttaagactcagacttcttttggccactttgttcagtttatcctaagatagataatgctagaaccaagctattcagatgtccagcgttttgaccttagcttcgtggaaaatcaaatagagcttcaggttagcacatacacaaaaggagaaatagccagctgtaatatttacagaatacactctttccaggctgctaggtacactgaacataacaaggtagcattcgggacagggggctatttatatttcttatatgtcaattaaccacaacaaagcagacaaccaaaacaaattttctatgtataggagactgattgcaatagaacaattggactcagtggaatataattagaaaagagtattatttccctgtcacatcttctgaggtgtccatatgttctagttcctggttgcacctattgtccaagtataattattatagtactctctttcactctgaaaaagtgtcctaccttggatgatggtcactctacctctaacactcatcatagagaactccttactgaccc

SEQ ID NO: 645 - DNA, 56374 bp, Human
aaatgtatataaaataaaatcacaggatagcttttacatcagagcagcaaaactggcaaaatttaaaagcctgacattaccaaatattggtaagaacatgaagcaatgaaattcttttcctctaaaggacatagctatggaaaaaaattagggcttttctaatacaattgaggatgtacctacccaatgattctgcaattccgttcactaaatggcctctgaaatactcgcacaaaaggacattaccagaatctttgcagcagcaccgtttataagagcaaaatataaatttggaaaaacttaaatgttcgaaggagatgaatacatttaagtttttttttttcaaggtaattgagaacctgcagtaaatattatggtttcctgttatttttaattgctaagtttacaatacccggaatcagttctgccttcaaagccaagtgttcattttccacgtatcaggaaacacatttggcatagagaccatcccaggaagttaaatttcagattctcagaattagtagcaaagtgcaatgtcagaagtgtccagtgagaggcactgcaggggactgggatggcctgtcttaacttcatacattttggggcaacaatacccattaaacttggcatatatactagtcctcaggctaagaaataagataggacacaaatgcatctattcataaagtgaaaatgaaaaaagatagcataaagatttagaaatacctttcaacactgctcatagaaataattctgaatgcaaatcatatgacttttataaaaatagtaacacttttgttttgttttggatgaggacataaacgctgaagaatatacatatacagaggaacctcgtttactgctgatagtaggggaaataaataataatctctatttatagcttaagaaagaggtcctcaaagagtgggagccctatgggtccctgagagacccttcaaaaagatctgtgaaatcaaaactatgttcatcgtaatattaagaccttatattccttttttattctcattctctcattagtgtatggtggaccttttcagaagctatatgacatattatatcatgacactgattgcagaagcaagtatgagaatccagtcatcttctagtaagccagacatcaaagagatctgcatctatgtagaacaatgccgcttttctcaataagcctgttttagaaagtagagttatttttcataaattgtatgatatttgcgttaacatgtaatgggtttattgtcacttaaataagaaagtaaacgtttaaaaattctccctttaacttctaatgtagtaatattgacaggcataacctacatagacaaaagcactttggaatcctcaatactttttaagagtgtagaaatctacaaaccactgaccttcagcctatcacaggaagctttgctattagcacaattattgcatctctgctcctatggttgcttttgtctcactgtctctgatctttcaaagaccgttgggaagagcttgaccagtaatctattgaatggagattacattttgaaccttttcctacaactcagtgccctgtgggatgactctggggtgtctcctgatggctagggcaacaggtccctgttgacatcaccttatcgggaagttttagacaggaacagtcttcaggctctgaagtacttgaacaccatgggattcctgccttacagaagttaatgagcacgactcaggcagattcataattctccttagaagccatttgggatggcttccactttggggtcattccacataggccaatgcagagcatgcagtaactgctcaaataggatttggaaaggaatgaataattcatttagacgttcaacttggaatagacttaagcagacactcctggtgatgaaggacttagatgccagaaaatcaggctcaaagactttcaagccacttcctagtgtgatgtcacattccttcctacgctccactggggaaggcaggtctgccccgcccacggtggcggggaaatacctaggcatggaagtggcatgacagggctcgtgtccctgtcatattttccactctccacgaggtcctgcgcgcttcaatcctgcaggcaggtagacaccgggccgggagtctggctgagccaggcatgggtggggccctgacagtaggagaggtgtgcaggaaaagacgtggcaacaatgtgtgccaccgcaggccagggatcaggccccccaggccggcccccgaccggctaggtgaccatgggggagccgactccgtctctgggtcgaggagtggagctcgcggctattttcagctccagcggctccctgccttcctttctcctttcccgctggcccttgccaggtaggcctgccctggctgctccccagtgagcgggtgtttggggtttctgtttagaccgccaggctcgggtggatcccgaggacacaggcgcgcaggggaggctccgtgcgccgcgagcggggttggggtcccacgtctggaacccaggccgcaggctgcgctggggggcgccctggccctcacgggggctctggacaccagcctgcttcgctgtcaggtggcagaagcagctaccacgcggtccccaccgccgccgccgcctactcctcgcccatcctcctctgcggcggggcgagctccctgccctggatcctggtcgggcgcccagacgaaggagacaggggaagggcagtctttggggaaacgtggggccaaagtcggagggctccccaggaaaaagggaaggtcagcggcctgggcggttgtctttgagattccgaggtcgcccacgccggcgcctcgggcccgccctactgcgtcctcccctcccaccctcttctcccttccttgcagcccggtttggggatgtggtccttgctgctctgcgggttgtccatcgcccttccactgtctgtcacagcaggtacgttccgtgtgtcctccgttcccagaggctgcccgagtccacaggctcctggcctgtcattgggagcccccggggatcgcgtcagcccgagcgcggctccttcccctccccagaccgccaggcggagttccgcggaagaggaaacagagaaccagctccacgtgctcggatgctcagccctgaatgtcgcctttgagcttggaggtgacttcggggaggggaaggagttaggcaaattccaagtgaagacttgagtaacaatgctcaaatggaattactacaggctattttataagataaagcgttattttatgacacaaggtgaaagcaaggaaaccgtcaatagaacaaatttcttctaagaaatttggtatggccgggcgcagtggctcatgcctgtaatcccagtactttgggaggccaaggcgggcggatcacgaggtcaggagatctagaccatcctggctaacacggtgaaaccccgtctctactaaaaatacattaaaaaaattagctgggcatggtggcgggcgcctgtagtcccagctactcaagaggctgaggcaggagaatggcgtgaactcgggaggcggagcttgcagtgagccgagattgagcctctgcactccagcctgggcgacagagagagactccgtctcaaaaaaaaaaaaaaaaggaaatttggtagaaatgaactttaaaagtgaaccaaattttttttcttaaacaatcgttttgggatgaaataccttttactcaagacagagtaaaataactgggtggcagagcagaaacagaaaagacaagaagggttgatttactctgtaggtgagtacagagtaaagaactctgtggatgaaaagaactaagggtcgtagaatagaagggaaagagggaaatcactcccgatggggaggtttgtgaggagggaacggagtaaattctgttttatggatacatttaaagaacttggaattatactttataatcagcaggctatttttaggaaacttccagactcaagaaactcccaaataaaatttcaaattggctggaaaattgaagaggcatttaaaaaaactaacagtaaataaaactgaagttttctttcatggataattgttttgttttgtttttctttccctagatggatgcaaggacatttttatgaaaaatgagatactttcagcaagccagccttttgcttttaattgtacattccctcccataacatctggggaagtcagtgtaacatggtataaaaattctagcaaaatcccagtgtccaaaatcatacagtctagaattcaccaggacgagacttggattttgtttctccccatggaatggggggactcaggagtctaccaatgtgttataaagtaagttcctaatttaaaatagaactaactcgtgtgtgtatgtataaattattttaggaaaattcttaacgaacatagaaaactcttgagaagaattatgttgttgtatgtttttataattgctacaagacaatttccagtgaacacatttttaaacagaacagatttgtaaatcatttttggaacctgatatgcatctttccctatggaaatggcacctcagaccagacccactcacaaagtgtgtttgtcccagtattattgctgccatctttctttcctgttttctttttcttttcttttttatttttcttttttattttttgagatggagtctcgctccgtcaccaggctggagtgcagtggcggcgatctcggctcactgcaacctccgcctcccaggttcaagtgattctcctgcctcagcttccgaagtagctgggattataggcgcttggctatatccgaagtagctgggattataggcgcaagccaccatgcttggctaattttttgtatttttagtagagatggggtttcaccgtgttagctaggatgatctcgagctactgaactcgtgatccgcccgtcttggcctcccaaagtgctgggattacaggcctgagccacctagcccggccgctgccatctttcttgaaatgccaaaagtttttgtgggaaatggcacatccagataggaatgagcctcctatgagcgcttttcacgaggaatctgcttaaggcagggagtaagcatggagtatgttccagacctcactggagaacctgtgctaagaaatatgaataacacaggcctgctggtgactgtggtcagctggaaaacacatgcccctcaaaggtagctgtctattcaggtcaagcccatcttctcacttttcaagggaatatggaaatcggaatttgtgtgtgcaactttttataatttgtaaagctttgtggggcctgaataaaacacatctgtagaacaaatttagcctgagggcccaatttcgtgactttcccacactggcttgcatgaccttaacaaattacttgatctctctgagccttggtttttttctgtaaaatggaagtaatgctggcctgataggcttgaggtgcaaattaactgagatcaggtgtgaagtaggtactccattctctcgctcttgttttgattccgcgatatttgccagcccctttctgtgtcccagcatggcccctgtcccactctgattgctgctagattcctcatttctaaacaccagacagactaaatgcacaaaattgagtggttcacaagtggaagtggtcgttagctctgcctggctcctttccacagatttagttgctaataaaccgctcagggcacgtggaggtctgctgtcctattttagcctaggctgtgaattattaactagtagcctaggctgtgaattattaactagacttgaagatcatacatcacataaatgaatctggatgtcgaagctagacttaaactatttaaatctgggagctgtgaaatgaggaaaagtaatctttaatagaaattgacgaagatattatctgccatgaaagaaaatgaacatgaattctccaagacttttattactaacatccagataggatacgtgtttaggaaactgtatatttttactttttgctttgaaataattttaaatttaaataaattttgcaggaatagtatcaagaacttccttctaccctttatctagattcctcgtttttaagaatatatttttacatttatcttataattttctctttcacaatatatatgatataaattacaaacaatatttttctcctaaaccattttttaaaccatttcagttgaaaaaactgaatactgccttagcccttaatcatcataccctcttagcccttaatatttcaatgtatatttcctatcaacagtgtatgtttcctatttcctttcaatgtatatttatttatttcttacataatcatagtatagttatcaaattcaggaaacttaaacatcatataataccttaatctataatctatattctaatcttatcaatgatctcattgaagaccttttataatgtttttctttcttttccagtacagttaccaatctgggatcatgcattgcatttggttgccatgaatatttaatttcttttaatctggaacagttcctcagtctttgtttttcatgatactgacatttttaagaactgtaagcaattattttgtattacctccttcattggggtttgtcaggtatttcttcatgagtaggttcagccattttggctggaatgctaggtgaggctttgtgtcctcttcagaatattactcagaggcacatggcgtccacttgcccctagttggtgatgtccattttgatcactcagttaaggtgttgtccagttcctccactgtatgaataccatttgtccttttgtgatgaatcatttgtggatgcttagtgctttgttagaggcagagggtttgcacagtgctgtgaaaatgatttgaaaacatttgaaaatgagtggaattatttgattttgtgatttgttttaaagagtttatgaggtctcaatctgtcttacaggggtagagacagctgtcatagaatacatgtaaacctaactgtttttgaaaaacattggtgtgacacttccataggtggtttaccaaatttatcagatgagtacaagcaaatattacatcttggaaaagatgatagtctcacatgtcatctgcacttcccgaagagttgtgttttgggtccaataaagtggtataaggtaaaaaagaattttcttattgatatttttcctccttttctttaaaacccactgttttttataggttaagttgtattttttaaggcagaattggtaaagaaagttgtgtgcctaagatagattagttagctagcagtcattgataacgttaccttcctaattactgtttttaaacatttttggttattatagctttgtaatattttattatttggatccaccaccttcctccagttattcttatttttcaggcttttctttatttttctaacattaattatatttgtttaaatgcatactatgtgcacatggttcaataatcacaaattctaagaggtcaccccctggaaaacctctttcctgctaccgttccatatttgttctgggctcatcacaccttcctcaactgtggctaccatgattagtgccctgtgattattcttgtatgatgctatactagcaaataaaaatatatagtctagctctttctagcccttccttttttacgctcatctttctgcactttgtgttttcatcttcaaaagttctcttttcttgatgatcctggcatatgttgacatagaaggtaactcttggcatggaggagcacaggctagtcatttgagattggaattagtttttcctgcttgttaacgcctgccagcacacccctctgggtcatgagttttctttatgggaagattttcatctattgattcaatttctttaatggtgaaagaattacgcaaatttcttactttctcttgtgtgagtttggtaagattttgtgtcttaggaagtttctcatttcattaaaggtctcatatattctggaaaattgtttagcagctcttctcttttaatgtctgcagacatcaaaaccttcaaagtaaggttcaccttcagtcattattcattctctcttacacacatacacacacacgtgcacacacacacacacttacttgattagtttcatcagagacttgtcagttctagtactcttttcaaaagctaacttttgactttgttgatcctttctgttatatgtttcatgttcatttaggttgtttagtttccctcttttacaagaaatgtggaagtgagtgtccttatacctgtattttaaggcacgtttgccagtgaatgcattcctttaagattactagccctagaattgctcatttgtagggcatgcagatgaacaaagtattcaactttgttgatgttacacaaattgcttcacagaattttgtatcagtttatacttttgccaggagtattttattttactttattttatgacagagtctcactctgttgtccaggctggagtgcagtggtgtgatcatggctcactgcagcctaattcctgggctcaagtggaagcccaggtaattttttaaattttttgtgtgacagaatcttgctatgatgcccagactggtctcgaactcctggcctcaagtggtcctcaggccttggcctcccaaagtggtgggattacaggcatgaaccaccatgcatggctcaccaggagtattctagatttcctacaaccttgtgttgaactttgtattataagccgttgatttttaaaatcaatttggtgggtataaaatgtacctttttattttattttgcttttccttaattattagtgagattgaccacatttttcagtttattggccatttctggatcctcttctgaactgcccactcatatcttttggtatatttcttattttacttttcatgccattttcttgtgacttataggagattttatatatttatatatcctgggtatgattgtttgcaatgcattaaaaaaaccccttttcattgaagtataacgtatacatataaaatgcagaaatcataattggacaagcttgttggattatcagaaagtgaacataccttttaattaccctttcccatgaaagttaagaaagaaaacattactagcacctccgaaggcccacctcttccatcttgcaaaaactatgcctccctagtcccccaaataaccacttccctgatttatgctatcatagattggatttaccagtttttgaattttatttaatttgaataaaatcatatgtagtgtttatgtctagcttccttggctcaatagcaaaacagtgggaatcatctatgctgtttcatgtggctatatttcatccattttctttgctgtgtactatttcattattattattgttagactcttgagtcatttccaacttctgggtcttagaatcaaagctggtatgaacactttcctcacttatgaatgcaattttgtgggacatattacatgagagtgaaatagttgggtcataagggtacgtagaaaatgccaaaccattttccaaagtggtgccaattaacagttccagcagcagtgtataagagttatttatgcccctatacctgacaacacatggtactattagtctttttaatttttgctatttggataaatgagtaattgtgtctcatttcagctttaattaacacttccctgattactgataatgttgatcttctttaaattttcttattggcacttggatgtctgtgtgtgtgtgtgtaatttttttctttgagtgcttgcttgtgaaaattttttttgagactagctcttgctctgttgccccggctggagtgtggtagtgcaatcatagttcactgtaaccttgaacccctgggctcgagtgacccttctgcctcagcctcctgagtggctgcgggttaccttgtccaggaggtatcatttttttttttctgtgaaaagccaaataataaatattttaggcattgtaggccggatggtctctgtttcacccactcaactctgttttggaagcacaaaaacagttgtagacaatgtagaaatgaaggagtgtggttgtgttgcaataacattttatttacaaaaacaggtggttagccacatttggcccgttgtgtggtttgctagcctcttgtctatttctcattgatttgtagtagttctttatagatctggatatcagtaattgttacaatgtgtccttctaagcaatggctaacctttctactctggtaatgaggtctcagacttcctagttttaatgcagtctgatgtattgattttcctttgtgattagtactttctgtgacttgtttaagaatctttttcctacccctaagtaaaaagaccttttttcctatattttcttcttgaagtttcattgtttttctttttccactgatttttaagtgtgtagtgttggtagggtcaaatgtaatttttttctctgtggacttatagtttacctgttcttttcacgttgctttgcatgcaacgtaaatcatattggtctttgtgtgtagatctgtttcagaaccctctgtagcattcccttattctatttctttctttctctttctttctttctttctttctttctttctttctttctttctttctttctttctttctttctttctttctctctctctctctctctctttctctttctttctttctttctttctttctttcttctttcttccttccttccttctttctttctttttttttttcttttttcagatggagtctcagtctctctcctaggctagagggcagtggtgcggtcttgactcattgcaacctctgcctcctgggttcaagccattctcctgcctcagcctccagagtagttgggattacaggtgcacaccactatgactggctaatttttggtatttttactagagacaggatttcaccgtgttggccaggctgtctcaaactactgacctcagatgatccacttgtctcagtctcccaaagtgctgggattacaggtgtgagccagcgcatcgggcccttatgcttgttaattattatggcattagataagtcttaagttttgtataagtcctctgcttttcctttttctgaaatgttgccttggctattctaacttctgtttctgcagcacttggagatggactcagggctatgactagcaatcctaagtgagcatcggatttgatcctctggatcttttaaaaattctgatgttcagcctcaccttctgctaactgaagcaggtcacccatgggtggcgcttagatgcctttattttaaaaacaacccctgggcttgcaaatgtaggcaaaagctgagggtcagcagtgtaagcaggaggggtcacctgatactataccacctgctcagatttggtgatccaggtatggctgtttttgccactaccatgtgctcagacctggaatcactctttgggcctcagtgttgtcatctgtaaaaccagagggttggaatcaattctgcaatatctggagtctgtgatcttcttggtgctgtgccaagggatgtcatatgtcttcaaagaagttacaatttatcagaggaagcagacaagtaaactaagaattttattacagcatgaggtgaacataaagaaagcaaaactagagcagaccctgggaatgtccatggctatgcttcctggaaaaggtgactttgaactgtgcttgaagagtgaacacagttagcctggtgggtacggcaaggaaggtcagtaattagagggaagcagcaggtgcaaaggcgttgggtgagaaagagaatggtgtttgggggccttggttagagtttagggcacatgtagaaagatggtgctagaaaataaacaccatttatgccaacctaaagcatttcaacagtgaatcctaccatcaggagaatggcatgagcaaattcacatttgagaaaagtccttctgtggggctatagtgaatacattggaaggccttgagaatggtggcatgctgatcatttggactatcctagaaatcaagttaagaagtgcggttcatttcagaaagttataaagtagaactgaaaaattagggaaaaggaggaactcatgtctgagggcccctaatttttctaattgtaaggagatgttatggggaaaatttgaaagagtaatgtaagtaaatagatggagatgtaatgaatttgtagtggtaccaagacccctgtttatgtgattatctcctatagtgctctgctctctggttgaaggcttgcaggagagggatgaagggatccatcagaatgggtctttgcaggtgaagatgctggaaggacggagggctgcagagttgaggtactggaagggaagtgattcaagtgatggacacgtgaatccaggatggacaggaaaggaaatgatacctgaaagagcttggaaattagacaaaagtagagaggtcaggtgggctaattccagttaagatagaaaagtgagttgaatggatagaaagttcaggtggaaaagtgtaatgcccatggtgagtctttttatcctgtagaggccataaaactaaaaagacacaggaacaaaatgaccataccaccttacattttgctgagtcacctactgctaaggctctggatggaattccatgtctccagctggctttgctgaaaggtaaaggtgaggatggaggatcttcctgctctttctgctggaaagcagagccctggagacacggaaatttctccagcagcattgaagtgtccagtctccagttctgtgggagctgagtattccactttatttgttggggtggctcttcctgatgtggcattacttgacacactggagttgcataagcggcaactcctggtctctgaattgcaggtggtgtatttcagagttgattccccactttccagattgtggtagaggtagcggctctcagggcaagctacttctgcagtgtggttctggcctcgatgccacttcctgagtactttcacagatttagcaaagcacctagtatcttgtcttgaatccttttctgcataaaatatagaatgatttttgtttgctaaatccagacagagatatatggcttcatggctctgtttcaaagattaaatgatctaatctatccacgaagcatttagttcagcatgagtacataataggtacgtaataaataaatattagagattattatgttacaataaaggaatgaatgagctggaatagggaatcagtcagaaagtaataaatttaattttaagaattttgagacagaggttctggataatggcaaatccctacgaaaatcctggcttacgtctgggagaattgaaaactgaaagtccccaggaagtctttgaaattgaagagcttacagaggacaaggtttgggtattaagacatctgtctacacctggaaaagtggtaatgtccccaattttgtttttgtttcaatcccaaattactcctcagcacagtggttttgggtccctatcactgtgctcaatctgaacttgctgaagttacttcgcgctcttcagttgctaaattgacattcattttcaacctgattgtggcattcaacattgctgggcactcccatcagctaggaactcctttcccatttccttctaagacttattctttgtctctgtttatcttttttatttttatttttttctggtgcttcctttgtaatcatcactgagttcttttcctctatatttgggtcttaggatttgaggttccccatggtttcagctgcggtcatcttctgtgctcgcttttgcttacattcaagtggatgatttatagaaccatccgtttggctctatattctccatatggctcccagttctcttccacttggacctttcttccaatctccagatttctttgtccaaccgtctaatgtacagtctccttagaccctcccatccccaccactcaccccatgcaccatggttagatctattttttaatcttaccctaaataggatcattttcttcatttctttgcattccttcttcttcttagtaacacctttgcttacctaagactgtagaagtcctgctccctctgcatattccaaatttgtcactaaattctgtggactggaactgcttaaaataattgttttttgttttttacttgctatccctacttccctgccttagtttaggttccatttggtctcagtttatggaaataaaatctaaatggtctttagcattgcactattttaatcctttaaactacacagcaactaaaggatctttctcaaaagaaaatctgattgtcttattctcttgctcagaaagcttctgatgctcgtctcctcttcatggttttctgtgacaggtctcctgactgcctcaccagttttatctccatcactattctgtacccactgcatcttagtaagaattctcaaggctattttgtgtttctgaaatattgtacatgctgggtcaggagttttcttcacgttgcctggaatacataaggcattcaaaagtggacgctattgttcttaacattttaattttaaatcttgttagtgagacattaccctaaagattttaaatttaaatccaagctcattgagagtttaaactttgaaataatgttccagtggatcagaatagaggtagtctaagttatagcaaagcgacagaatggccctcagctgcaaggctgaactttaagatgattaaaatatgtatatcttgaaagaaagaatgaacccatcagaaagaggactgctcagccatggaagcacagcaagggaggcccagagactgtgcctagccagagactatccagggcagcctgtccagggaagaggtttatgaaatgtgaggactagacattgtactttgtttgggctgagttcagtggcttatgcctgtaatcctagcactttgggaggctaaggtgggcagactccttgagctcaggtgttcgagaccagcctgggcttcatggtgaaaccccacctgtactaaaaaaacaaaaaattggggtgtggtggcacgtacctgtagtcccagctactcgggaggctggagtgggaggatcccccaagctcaggaagtgggcgacagagctaagaccctgttccagaaaaaaaaaaaaaaaaaaaaaagtgcttgtctgtatcctaaagaaggagacatcacaatatcagagtctgatccctttatacatctaactctgattagtaattcccattttgtttgataagcagttgtcagattatgagttggtttcccatatcaggtatttatagggaaataatgtaagccttataggaagtagcatttcacattataaataaaccaatgcttgtttggcattaattatttactgcatcctgctgggcggctctattcatgctgttccaggggtggagaatgaagtgtgactctgaaccatgcctaagtgaggagagagcctaacacttgggcaggtaaatatttatttaattaggagtttgcatgttgattttatcttttagattgtgcacttcctgaggagagggattgcatcttagtcctgcatggccaggcctgtcacagtgcaggcaaactgcaggaattcaaatgtttgaatgaacaaatggactcaattagctaagcagtcactctgtggactgcagcttcttggaggacagggagcaggtttgggagaattcagaaggtggcccaagggatggaagaactggtgattagcatgagaatgtgagcctaggacaggacagagaaacagtgaggcttgccctctgggtggttgctgggagagaaagcattcctgagactcactggtcttctggttggttgggtgtgaggttgttgccttgtccatggaggaggcatgggaagcgggagaagtgatgtgacatctgcccaccataaacctggccagcttcctttgatcactgttcagaccttcaaattggatgttggtgaagaattattttggacttctataaagtccaatgcttgataagtgcagaaagtgtaattgggcccgcaaggcagtgggagcagttgttattcacctgggtttccagtcttggcagagggtcttgggccattaagcgggagtccactggcagacatgggcccctgaaggtggaggacattcctgcctgttcatgtcctcctgcaaaaaactgacccaggctcagttttcctccatgaagtcttccttccaactcacgtaggccactctcctctcaagtcctactagacttattgtttgtatcattcacttcagcctgtaaaatatcctttgtcaaatctgtgtatatctatatacacacacatgcacatatatatgtacacacacacacatatatacacattatatacagactaggcagggaattctgctgcctatctatccatctatcatcaatctatcatctacctatttttctatttacctagctagctagctatctgttgtcttccagttagactgtaaattacctaaatactagggatcacacaggtttctaagtattcattgaattgaattttgtttttatttgtattaggactgtaacgagattaaaggggagcggttcactgttttggaaaccaggcttttggtgagcaatgtctcggcagaggacagagggaactacgcgtgtcaagccatactgacacactcagggaagcagtacgaggttttaaatggcatcactgtgagcattagtaagtatgctcatgtatgcctgtcgccttgtattctcttggctttgtgtgaactggcttctggctttgggttttgggctttgagcaggagtgattctaggtcttggtttccctgaaggctagtaggctctcagacctgccactgttagaatcagaaggtgggaagagtgaggcagaagggcatgagcagcttagtttcctcttctgaacaacagaacactcaaaactcttggttgatttgtgaaaattaaatgagatcatgcacatagactagctgctggggtacctgatgaaacacaagtatctagacaatagtagatgtgatgaacatgactgtcattcacctcagccttcattgtcgtgaatattcctgcgggccttccagctgaggcctcccctgcctcaagtgccgcagagctcagagttctggatatggtcctgggatatcctgctgctcatggacctgtgttctcagcccagagcagccagctctcttgaacatatgcctggaggtttgaaagtagaatcttaggggaagaagaaaccctaaaagtaaattagctcaagccactaatttaatttaatttttttaattttcaatttttgtgggtacataataggtatatatatttatatatagtatgtgcatatattacataataataggtgtattatatatataataatgggtatatgatatattaaacacataataagtgtatatattacataatatgtgtatatttataatccatgagcatagaatattttttcattttttggtgtcctcttcaatttctttcatcagtgttttatagttttcattatagagatctttcacttctttggttaattcctaggtatttaatttcgtttaattcctatgtattttaatatttttgaaatgatgatatggttttatgtgtggctattgtaaatgggattacttgtaaaatatcttttcacattgttcactgctggcatatagaaatgctactgatttttgtatgctgattttgtatccagcaacttcactgaatttattagttctaatagttttcttgtggagtctttaggttttcccaaatataagatcatatcatttgccaacaatgataatttgaattcttcttttctaatttggatgccgtttatatctttctcttgtctgatttctctagctaggacttccagtacaatgttgaataacagtgttgacagtgggcatcctcctcgtgttccagaacttagaggaaaggctttcggtttttccccattcagtatgatactagctgtgggtctgtcacatatggcttttattacattgagacatgttctttctacttccagttttttgagggtttttatcatgacctgctgaattttatcaaatgctttttccgcatcaattgcaatgaccatatggtttttagcctttattctgttgatatgatgtattacattgattgatttgcaaatgttaaaccatccttgcatcctagggatgaatcccatttggtcatgatgaatgatctttctaatgtattgttgaattctgtttgctagtactttgttgaggatttttgcatcaatattcatcagagatacttgcctatagttttctctctcttttttttttttgatgtgtctttgtctggttttggtatcagggtaataactggcctcataaaatgaatttggtagtatcttctcatcctctatttttttgaatagtttgagcaggattggtattagttcttctttaaatgtttgttagaattcagtggtgaagccatccagtcctagacttttctttaataaagagacttctttctctttaataaagatactttattaaaatttctatattgttacttgttattggtctgtttaggttttggatttcttcctggttcaatcttggtaggttgtatttgtctaggaatttgcccatttcttctagagggatttcctattcattggcatacagttgctcatagtagccattaataatcttttggatttctgcaatatcagttgtaatgtctccttattcatttctggttttatttatttgtatctcctctcttttttgcttagtctggctaaaggtttgtcaattttgtttccctttttaaagaaccaactttttgtttcattgatcttctgtgtttttttcatttcaatttcatttatttcttctactaattttgggcctggtttgctcttgcttttctagttctttaagatacatcattagattgtttgtttgaagtttttcctcttttttgatgtaggcacttatagctataaacttttctctgagtactgcttttgctgtatcccatatgttttagtatgttgtgtttccattatttgtttcaagaaatttttcagtttccttcttaatttcttcattgacccactggtcattcagaagcatactgtttaatttccatgtatttgtatagtttccaaaattcctctcgttattgatttctagttttattccattgtggtcagagaagatgcttgatattattccaattttttcagtgtcttaagacttgttttgtgacctaacagatggtctgtccttgagaatgatccatgtgctaaggaaaagaatatgtattctacagccattggatgaaacgttctgtaaatggatctattagatccatttggtctatagtgcagataaagtcagatgtttctttgttgattttctgcctggaagatctgtccaatgctgaaagtgggatattgaagtctccagctattattgtattggagcctatctttctctttagctccaataatatttgtttttatatctgagtgcttcagtgttgggtgttatatcctcttgctgaattgacctttttatcattacatagtgacttgctttgtctttttttatagtttttgtcttgaaatctattttctctaagcatagctactcctgctcttttttttgtttttgattgtcatggaatatcttttttcatacctttattttcagtctatgtgtgtctttataggtgaagtgtggaaacaatcaatgggtcttgttttttcattcattcagccattctacatctctttattggagagtttagtccatttacatttaatgttattattgataggtagaacttactcctgtcattttgttatttgttttctgcttgttttggtcttctcttcctcctttctttccttcctgtcttcttttagtgaaggtgattttgtctggtgatatgacttgatttcttgctttttatttttttgtgactctattgcattttttctggtttgaggtttccatgaggcttgaaaatactattttataacccattattttaaccggataacaacttaatattgtttgcataaacaaacaagcaaaaagaaaactaataaaaattttacaccttaactttattcccctgctttttaactttttgttgcttctatttatatcttgtactcactacaccttgaaaagttgttgtagttattatttttgattggttcatcattcagtctttctaggataagaacagtttcacaccacagttacagtgttaaaatattctgtgtttttctgtgtacttattataaccagtgagttttgtgcctttgggtgattactcattgctcattaatgtccttttctttctgattgaagtactccctttaacatttcttgtaggacaggtcagtagatgaaatccttcagctttcgtttgtctgggaaagtctatttcttcttcatgtttgaaggttatttttgtggatatgctattctagggtaaacgtttttaaaatgtgtcatgccactcctggcctataaggtttccactgaaaagtctgctgctagatgtattagagctccattgtatgttatttgttccttttctcttgctgcttttagaatcctttctttatccttgacctttgggagtatgattattaaatgtcttgacgtagtctcctttggattaaatctgctgggtgttctataaccttcttgtatttggggactgatatctttctctaggtttgggaagttctctgttatccttttgaataaactttctactcttttctgtttctctacctcctctgtaaagccaataacttttagatttgcccttttgaggctatcttctagattctgtatgcaatgcttcattgttttttattcttttttcttttgtctcctttgactgtgtattttcagatagcctgtcttccagcctgctaattctttcttctgcttgatacattcctctattaaaggactctgatgcattcttcaatatgccaattgcattttttcatttccagaatttctgcttgatttaaaaaatcttatttcaatctccttgttaaatttatctgatagaattctgaattccttttctatgttatcttgaatttctttgcgtttcctcaacacagctattttgaattctctgactgaaacatcacatatctctgttccttcaggattggcccctggtgccttatttaattcatttgaggaggtcatgttttcctggatggtgttgatgctagtagatgttcttcagtgtctgggcatttaaaagttaggtatttattgtagtcttcactctctggacttatttgtacttgtccttcttgggaaggccttccaaaggatttgagtgtttcgatcaaagctgtatctgctttagggggcaccctaagcccagtaatgctgtggttcttgcagacctgtagaggtaccaccttgatgatcttggacaatatctgggagaattctctagatatcaggcagagacttgttctcttcccttactttctcccaaacaaacagagtctgtctgtctgttctgagccacctaaagctgatggtggagtgacacaggcaccactttggccatgaccactaggactgctgggtcagacctgaagccagcacagcgctgggtcttgcccaaggcctgctttacccactccctggctactgcttatgtttgctttaggccctggtgctctacaatcagccggtggcaaagccagccaggcctgtgtccctcccatcatggctgattgccactggcaaggtctctcaggccctgggtggatccagaggtgccatctaggagtgagggattagagtaaacaaaccttagaagtctaccaagtgtttttttgtactgcagctgagctggcagtcaaaccacaagacgtagtccttcccactcttccctcccctttccaaaggcagaggagcctcagcatccatagccagtgccacagccggccacaaggagtactgccagactaccgcagattttcccttaaggtccaagagctcttaagtcagcttgtggcaaatgctgccttcctgggactcactcttcagggcactgggctcccttctggcccagggcatgtgcagaagtgccatccaagattcaagtcccagaatcagggacctcaagagcctgcttcatgacctaccctcccctgtggctatgctagtacctgaagtgcaagacaaacttttccttctgcttttctcaagcaaaaggagttttgccctataatcactgcagctaataatgtgctcagtctcacctaaagccagcaagtttcagatgctcacccaaggcattcaatgtaatacctggataattgctactgattattcatggcacaaggactcttaagttagcaggtgatgaatgctgcaaggactgaatcctttccgtcaaggcagcgggtccccttctggcccatggtatgtctgtaaatgttatctgggaggcctggaacaggggcttcatgactctgatcattgttctctcttgctgtggctgagctggcatccaagatgcaagtgaagtcctctccgctcttccctctcctctccttaagcagaaggaaagcgtctcttttatagctgcaaggtgtgcagtctggggtgataaagaggggtgatgcccacactcccttggctgccctagatgggaatactgaggtatattgcatgtcccactccagtccaccgtctctgggcagcactaggactcacctaagagttgcagtccctgtggcccagactgcctctcaagtttacttagagacccagagcactttagcttgtggtggtaagatttacaggaactcaagttctgatcactgggattaacaattccctctgtctagggctggtttaaatgttccctccatgagcccgtggcagctgagtttggtccagttttcctttctgttctaacaagtcagcattgagttcagtgcctcacaattgtggtgtcctttctcctccagcaaccagagacactctcagtaccatgccgccactgtcaggggttggcgagagtggcattggtgattgaggactgctttttctatctcattggtgtccttttctgtgatacagatttaaaaccagatactatgagtgatttttggttcttatgaaggtgtttcttctgtgtagatggttgttaacttggtgtccttgtagaggagacaattggcggattcttctattctgccatcttgttccacattctctccccaagctatacattttacagagttccaggaggggagcaacttattcaaggtcacaaacctggttattgtcagaaacagagccagagctctggcattcaatgcccaggccagcattggtttttccaaacacactggacaaggagttcctgctgtggtggcttttgctctttctttagtagaaagttgttttctatatttactcatctagatgagaagaactaaaggctggatacttctttgatgtagaccttcctatttgtcactagtttccatcacacttcagagtactaggggagactgagctatttctgggtggtgtggatccctatggggatctggtcagcatgggtggctccctgctgcctatgcaggacagggccctttactctgtacagtccagtgactccctgaattccagctgttcttctagagagcccgttctagtcctcctatgttctttgcagcaactgctcatttgatttaaatattttggggtggttttcaattttaattgttcatgctaaaagcacagtcattaagaaaattaattgtacaaggtttttttgattttcctgctcttgggttttctgctgaccattatctctctgaaagaaagcacctgcctcatcttgttcacagttgaatccctggccctgagcccagtgcctggcctagactaggcacagatctatttattaagcgaatgattgactactataatgcattaatgttacattggtaactgaggggaaattttgtaaggtgaaattgctcaggtaaaatgaagaatcccttaagaagtaactgggttcagtagtcactacttcatgttcaataaacatttatttatgatctgttatatgccagtattatggaaggtcctgataattcaaaagtgaaaagcattgtttcttctactatgaaactgtcagacatggtgatggtgaatctaggggttaaatggatcattttaacattatgtgctaagggtagagccacagacagtgtttgcggagcaggaaaagaataagaagggtccgtgggtggcacgcaaatggtctgggaaggcttccaagaggaaaggagttctcagctgaattttgaagaatgaataggattcacaaaagtaaaggagggtgaggaggggtctctaggcagagagaacagagggaacagtataggacaaagcatggaagtgttaagcattatgtttatgttggatctaaaatgactttcattagatcctatgtgagtatggggtggggagggtgggagctgaggtcatggagttaagcagggcaaggtccaggggactgtttatgcataggctttaccatgcagccactgaagggccctgggacggtgcaaatgcagagtcattgggctgcatttgtgatgggagacatcagtattgagatgatttgaagccagagttgaagagggcctggcagcttggagaccacttaggaggctgataaaatatccaaaagagtgctgatagtctcaacttgggaagaggccatgggggagctctccttcaagcaatcatttaagaactctttgctgagtactgaacaaagctaggttctgtgccaggcagagagaacatggtggtgaagaaaacagccacccccactgctctgatgaagcttgaaggctgaaaggaaggcagagaataatcagataattcactaataagatgtgtaattatagggaagatgaaagcgtgaaggaaaggaaaaatctgagctcaaacagaccagggcctcgtgagaaagcagtggctcagggaaagctttctgataatagtgatgctgatggtcaggaagcattatgtggatgatggagttggggagatttttttccagactgaggaagtagcaaatgtgaagaccctggcacaagagggaacttggagtatctgaagagtagaaagcagggctagagtgatcctgaatgagagaaattatggcaggtgatgaggttgggtaagtagtcgggggccaagatcaagtaggaaccagcaattcagagtaagtagtatgaattttattctaagaacaatgacaagcagccagacagatcaaaagcaggagagtagcatgagttgattttcatttctgaaacagcagactggccgctgtgcacagaatgatccattccagggtggatcagaagtgcaggtacagaagcgcaggtaaggcatgaaggcacaggtaacatgatgtcattgaagatggagagatatggatgggttcaaggcaccttaagaggtaaaacccacagatttagtgttggactgaatatggggagaaatatggcaaggtcaaaaaagttaaccaggctttttgacatgcactattgactggatggtgatgctattcagtgaaggaaaatggctctggaggaaaaccagatttaggagtgagatcatgagtttggtcattgctacgttgagtatgaggtgcctttggatggtggaggtccagagtaggtcatggcctgtatgggcatggagcttagaggaaggactggagacatgaccttcaaagtcattggccttgaaatgatatttgaagtagtgggtgtgaatgagattgcttaggaaaataatggaaaatagaaggcttagaagtgaagaaaaagacagactgagaaatgaggaggcaaaagtagttgaatttggtgattgacaagttgaagaaggtgaaagaaaagctgttgcctagaatggcttctggattttacatgtgtgtgatctagtgggtgatgatacattaacaagctggggataacttttgtttgggacatgctgcatttaaatagtttgtggaatgcacatttattattgccatcataaaagatatgtatttttgcatttttcttagctcctctcttacaacttttccatatcccactccaaatatataggaggaatactggaactaagtaggtgatcgctaaattttggcagacaaatgggagaggaaagaagtagagaaagactgaggggcagggagtccagggagtcaatacagggagataatgctaaagtttggtggtaggatgaaagagttagaataatagtagaagaggacgggatataaaataatatggaaatgcagagttggaggaggaagaggaaaactgaagatatgatgaaccctcacagatccctcatccaactttgacaattatcaacttctggatagacttttttcatctttacctctacccattcccaccagttcccaagattattttaaagtaattcaaaaacatgatatgtatttttccatctacataacattcttataaggacaaaactatagaaataggaaacagattaatggttgccatggaacaggaactgcatgagggagttttttgaaggtaaaacaagagggttactatttctctcaagctagcacctaagccaggcctttgtctatagccactgcctgcaaagtgtttttggattattaagtattgagattttattataaaagcttattagtttatattataaagaatatagtttatggtttataccaaaatatggccaaaatgaactctcttgatagctcagcttctagcttattttttttttcttttttggcaattcagttacttctggttgaaaatgtgtatttatggagtgagattttgaccagagcttattgatggtctgctctgttgggcttcatgctattacatcaaagtacttgggaatgtatcatacgtgattctaatgcaatttcctgtgggtatgatttcttagcagaaagagctggatatggaggaagtgtccctaaaatcatttatccaaaaaatcattcaattgaagtacagcttggtgagtaaaattattgaagccattgaaatcaccaggggaagagctcattatgtttgcatattctggtgaatattttgaatgttaaggatgaagataaatcctatacacacccagtttccagctttggatatacgtgagctcatggggagaggaatcaaaataaaacaccagagagccgaagcgtggaaaagttgtggtagcagagaagtctggcaatgaggactatgggcccaaaatgattattataaatctgtttatgcaaaggcaatgaaaatgcaaataattcttcagacaatacataatataatataaaactactattaaataatgttgaccaggagttctggattatattacctcacaatgcaagatatattacaggagtgaaaaaaattatgatgttatattccttaatctatatggaaaaggatcaataagcattgcctcaatttgtgatctaagtagataaaaaggcatcaaattactttttaaattaaaaaataatcactagtggccaggcacggtggctcacgcctgtaatcccagcactttaggaggctgaggcaggcagatcatgaggtcaggagatcaagaccatcctggctaacacggtgaaaacctgtctttactaaaaaatacaaaaaattagccgggcatggtggcaggcgcctgtagtcccagctacttgggaggccgaggcaggagaatggcgtgaacccgggaggcagagcttgcagtgagccgagatcgcgccactgcactccagcggcgacagagcgagactccgtctcaaaacaaaacaaaacaaaacaaaacaaaaaaaatcactagtaaaataaatatgttgtattacatctgaaaaaaaagcaaattagacaaaaatctcaagatctcacaaaatagaaagttttatgtgtcttagtgtatcaaactatataatgctaaaagtctcagaaatacaatacaacaaaacaacacaattgtttcagttgtagggggagattttaacatactcttgctttgagaaatttactaggaaagtaagagtctacatggttcgaggaatatagtaaaagtaatgtgtctaatacatagatcactctcagaaacatctatgaaaaaccagagtccaaaagaggaaattgtacagatcatggggtataataacgatacagtaaatgtaaaaatttatatctaaaccaaaacaataaaataatcgcacttaataagtatgtgaagtgacggatttgttaattagcttgatttaattattctacaatataaacatatatcaaaacatcacatcgtacccataaatatatgtaattattatttgtctattaaaactaaagaaaaatttaaaaacttaaacaacaacaaaaaatctcttaattatttgcatttttgattagagagccaaagccatagttaaagaatatttagaaaataatgatagtgagaatacgtcatatcaaatttcatggcatatgaccaactctaaacaagtttatatctttaaataacattattattagtaagtgtggaaataattaaaatatacaactaaccatttgactctataaaaggaccaactaaacaacaagaatagaagtagaaaataatgaatttattaaaggaaaataaactaatagaatctgtcccagagttggttaagaacagaagagttgaggtgggggttggggagaaagttaaacttccagcaaatctaatccccaaagtgcagagacacccaaatataaaaaaattagaaatatgggaaagcttatataaaacaacaaatggtaagagataaaatctgtttaaatgcctctaggcccatatgattttaggataattcttttaaactttcaaggaaataataatacctataataaaggataattgtctacacattactcattatgtgaatagtcttaaaagacaaatttggctgttttatctctcttaattgactttctttctctactcctgtctttggaaattctagccaatgtatttagacaattaaaaggcaagagaaggagttttggaagtcttggagggaggaagataaacataacttttaaaacatgatctactggtttctacttagaaattttgagaaaattaagtaaaaaactataatcactagcattttcttattaatgttattttaatacaaaataaacattcaaagctaatagcatttttacatgcctgaaatagcatatattatgtaatcagggaaaacagcattcacaattgcaatacaagaaataaaacagtaaggaacaactgaacaagaaattaggaggacttgcctacatgattaaaaatgcagcattttatcattttatagatggaacataaaagaatatgtgttttagtgaaatttcaaaagatgttcctaaatagaaacactcagtattaaaaatgttatttctcttagattaatatacaagtttaatataataccaattaaattaccaaatatcctaaaacttgtcaaaacatgtctaaaatttctgtcaaaaatgctggaaacagttagccaagaaaaaattgaatagaagaaaaaagagccatttccttgtaagtattaaaatatattataaagatagagattattagtatgtcaacaaaattgctgactaggggctcctagcactaattcccgtacaaaagggccaaaatataaaataaatagctacattttgactagcgtgtctgaaggagggcgctggagtgcagcatggaaatgatggaatccctgtggagcacagaaacccaggatggcagcatagagaggggaggaaatcaccctttctctgtcactctgtttcccccaccaagattgacttggagccaagagaaacttctctttgcagggaaaaggtaagcagaaggcctctgccaccttcattattaccacagacacctgcagttcttgctacagaagaaagctgcagtcctcacaggtcctgagcccagtttggggagcagcctggagttctcatggctatattgctccagtgcaggaaactacattgtgcatacccttatcccctatgacccacgctgctacatcatgccactgtcttggaattatagctactgctagagtgagtcctgttctgggggccagtagccactgcatctctccatccccaatgctttcccgtcatttcaccatgttcatacaggtggctacaactccaaaatcctggttacttagagtatgggccctatgaaattactgtgatcctggttcccaaatgcacatggtgccctgcttcctgtatggacaggcagtcctgcacaactggggaagctttccctagccagcagacctactctgctcaccctcatacccatgagggtgtacatactcaccctcatcctgagaaccagcccagtagccctgcacctggcaagacgacaccccttttccattggacctactgtgtgtgcacacacacccttggcctgagaaccaacatggtagcccagcaccctgcaaagccatgccactgccagtacaaactcctgcagcctaggccactgagacactcaaagatactgcagatgtggattgtagctgaagaaactgcatgaagactacacttctgtctctgtctagaaccaaagccaacataccttatccaactgacatgctaggatgcatctacagaaaaagtctttctctaataaagctacttcataaaattagaagaggtgactgttgcaccagaagtgcagctatcaacataaggacacaagaaacatgaaaaaacaggaaacatgaaaaaacaggaaacatgatacctcaaaggagcacaataattctccagtaacaaacctcaaagaaaataagatttgctaaatgcctgaaaaggaaggaatccaaaataatgatcttaaggaaacccagctagatacaagagaatacaagcaaataatttaatgaaatcagaaaaacaatttatgatctgaataagaaattcaacagatagatattataaaaaagaaccaaagagaagtctgagcttaataattcaatgaatgaaataaatgcaattgagaattcaacaacagaattcaacaatctagtgatcattatataatgaccttctttgtctcttcttataatttttaacttgaagtctattttatctgatgtaagtgtagctactcctgcttgcttttgttttccatttgcatggaatatctttttttcatctcttcacttttcgtgtatatgtatccttactggacctactgtgagtcagtgagtaagtgagtctcttttaggcagcatatagttggttcttgtttttttcttttaatccattttgccactgtatgtctttgaattagagaatttaatccatttacattcaagattattattgattggtaagaacatgactcctgacattttgttatttgtattctggttgttttgcagatcctttgcttctttctttctctcttgtttacttttgtggtttggtggttctctgtagtcctaagctttgattcctttctctttttattgtgtatctgctgcagtttctatcattgtggctaccatgaggctaaaataaagacttttatggttataataggctattttaatctgattacaatttaactttggtcacataaaaatacccttgacttttattgtccccctaacagtttatacttttgttgccttaattcacatcattatacattgcgtgttctttaataaccaattgtgtctgtagttatttttgaccattttgacctttaaacttattactagagtcttgaaagatttacatagcgccatttcagaattgagatattctgaatttgattttgaatttatctctactggttagttttcacatgtttttatgatggtaattatcaccctttcactttcagttgcagcatttccttagggatttcttgtaaggctggtctagcagcaatgaattcccttagtttttgcttgtctggaagggactttatttttcttacatttctgaaagatagttttgctgggtatagtattcttggatagcagtttttatttttgttcagcactgaatataatatcctttgttcatgaattggaagaattaatattgttcaaatgtccatcctactgaaagcaacttacagattcaatgcaatccctactaaaataccaatgacattattttgacagaaagagaagaaacagtcctaaaatttgtataggaccataaaacaccctgaatagccaaagcaatcttgagaaaaagaccaaaaggcccaaaaccaaaaacaaagctggaggtatcacactacctgacttcaaaatatactaaaaagctatagtaatcaaaacagcatgatgttagcatgaaaacaggcacatagatcaatggagcagaatagagagtccagaaataagtccacaaatcaacagccaactgatatttgacaaaagtgccaggaacacacattaaacaagtaacagtctcttcaataaatggtgataggaaaattggatatccacatgcagaagaatgaaactagacccctatcttttaacatattcaaaactcaacttgaaatggattaaagacttaaatataagcctgaaactatgaaactactagaagaaaacatagaggaattgctcatgacattggactgggcaagatgttttggataagatctcaaaagcacagacaacaaaagttaaaatagacaaatggaattacatcaaaccaaaaagcttctgaacagtaaaagaaacaatcaacagagtgaaaacataatctacagaatgggagaaaatatttgtaaactgtgcatctgacaaggggttaatatccagaatatagaaggaactcaaacagctgaataacaaacaaacaaacaaaaaacaaaaaacagaacaacaaataatttgattaaaaaatggacagaagacattgcttctgggattcagacaatatcctgttttcttgatgaggtgaaagtgttacagatatttgcttatgataattcattaacttgatatttctattctatactgtttggtacatgtgtgttatatttcacaatcattttttaaaaaaatatcatttagaataaagaacactccttgaatgttagaatttactaagctcatgggacaaagtccactgagactataaattgatgaaatttgtgaatgtgtgtagaggcaagataagggaaagagagggaaagggtgggggttacatttggtgaagcagaaatatcactggatttggtgttagaaatctagagttcatatttcatttcttcctctaattaatttgggcaagtcactcaatctatctgaacttcagtttttgcatccttaacatgaggataatagcccctccccttttcctgccttgtaagattgttttgaagattcaaagactgaaggataaaatgcataaaatactttgtgaactgtcaagttctttgctagtgttactaggagtagaaatagcatttgtgtacctgatgatgtttggtaatgcatgtgtgtccctttacaatggttgtcctggaaggccacttgccccttgtggtctctctccagggaaagaaaaaagtagattaacatttgcctagggggctatttctggtaatcaaaaggtattcgaggctcgagagtacgatgcacttgtaatccagatgttaacaaatttgaaagtttgtagaattttcattgaatattgatgatattggttttttttaggtaccactctgattgtggactgcaatgtaacagacaccaaggataatacaaatctacgatgctggagagtcaataacactttggtggatgattactatgatgaatccaaacgaatcagagaaggggtggagtaggtgttttgcttttttgacttctctaaacgctagcaaggatttctccatctaagtgaatctggtatcactactgccttctcctcttgtttttgcctctcaatgattcatgttatcaatcccacctatcacatagttagggagatatggtaaaagaccaggtatccctgagagcagtaagatccatttctcttagctactactcaaaattagtcccatttccattcagttatatcatgagccatcggccttcaaagcttaatgccccgggcatacaaagcaaacactggaaatgacacaaatgtgtatattgcaacagtagaagaaagaaatagtagtatagttctttgctatactaaacaagcgccaatggggactcttagggaagacagtgcataatcattagctaattgaatgggtataaactcaagttatggtggtataaatggagtggtgtaaataaaactaatgaagtcagagggcaggagagcttgtgttgggcctcgcagtatggataagttaggatacttggagaggaataggggaaaggcctttggggctgagaatggtgtctgtagctaacagaaccatacttccttgtcaccatgcagaagaaaatgcaaatttgggaatatacaatctacaaacctcactgggccagtcagcaaagtatttttaggataacatgatggcccaaagtgttctcaaagaaaacactttatctccagaaaacagattataaaatatgttgggtaaatctgactcatgtattaatgacttactcttttcttttatagaacccatgtctcttttcgggaacataatttgtacacagtaaacatcaccttcttggaagtgaaaatggaagattatggccttcctttcatgtgccacgctggagtgtccacagcatacattatattacagctcccaggtaatactccagtgggttacacactgttcagagtgttcaaaacgatggccaggaaacacatctgaaggagcagtgactctaaatgctcagtgtgaggcatgagggtgatattaaagggacaaactcagtatgaaatctagggaaaatctcatgcaacagctcataatgttgttggagtgaggctgtgattttattgcagtatattttgaaagtgccatattttcaatacatccagattttatacatcaaaacagaaagaaaacaaaagcttttctttattaagcgtgattgccaaatgttttgcttttgattttcaacttttagatttagtataaataatttgatataaagccaaaatgcctatgtatatttttaccatggaactttgtaaaattatctgtagaggctgaattctgatatttaagcaggagggcttccaactcaatgtgtgtatacgaattgcactctgagtaccgtacagaactaattgattatgcattggaagtaataaagtcagtgaaaagatagtggagggtgaagccagaatcaggagaacaactttaaattcgtaacctatcaggggaggtgtgtgaaataccttgcaaaatgctgtgtggtttaccaagacagttgttcttgattctattaatatcattagtgtatgtgtgtgtgtgtgtgtgtgtgtttgcacacgcacgtgtgtggctagctacatgcaagagagaggacttgaatttgctgatgtcctttaatgatcagttaaacctatgcttgcatacatcaagctaaagccccaccaaatatttttctagaacctaacagaaaacacagtggttgctgtatggagttagcaatcgtgcctttgcccctgccaagctcctggcctcctaagtgcccgttacctcccttagaattgcagtgaatagggatctgtgcatggcagcttgcagctctgggtgtgcacattctctgcttcacttctgtgtcctgaaggccagtgtcgttctggcctcagctgccttaactgtgagtgagcacagcaccctctactcaccctgagcacatggggaatccttcttgggttgcaacatgtggaaggacccttgggttcatctgtcactactgcccattttttctcttctcactggcttttctttgtcataaagcatccttctccatcactttcccccagtcagtcttgtgtttgccatctctctctctctggtacctctaagaggttcatcatctgtgctgcttttctttctgtgtcctcatccctcaaatctctttcccctttatggcatcaactgtcattcctgagcaggtgcaaacaggttccatatattgagctgtatactgtcttcccccatgacagctctgcgtttccagctgtgtaagggactgcagatacactggctgatgtcagaaagcatgtttaaactctccaacctcctggttctgttttttcttacctttgttagtgggactcctgtatcttccacgttgttcaggctcaaaatctggggtcattttatgccttcccttatcctccctcatgccaacacccaatgagttgccaagctctgtggattcctcccctcctgcccattcccactaacgagctggatggtagggtgactcctgccctacactttaaggtcaggttttcaggctcagatcctatcttgtccacttaggagctgggtgaggacagcactgtcactcaacctctctgtgcccatgtctcctcatctgggaaatgaggaggatagcgacttccttccacgactgttgtaagaatcagctggaattttcttttatacttttttattgtggaatataatgcatatatgtgttataacatatgcacatatatggtaaaggaacacagaatttctacatcacataacaagtcattgtatagcaaacactcatgaaactaccacctggattaagaaaaatgcattgcctgaaaaactcctggatgttcttccctgatcctcccctcctgataatcatccccccaacttttaggaaagtcgtttctttgattttctatctatgctgatagtcctaataatacaatttatttttgcctgtttttgagttttatattaagagaagtatatagtatgctttattttcttaggtgtgggggcttatcagtgtatcactgatatagcatgtagcttagttcattaatttacgttgccgtatcctagtccattgaataactaggtcacaatttatccactgggctataaatatgtggtttgcattgttttgagtttggaactcttaacaaagaatactgctatggaaattcctgcttgtgtgtctgtgtacccatgtagaggcatccctccaggatatatcatgaagagtagagttgccaggtaagagtctgtcattaacatttctatataatgccatactgttctacaatgtgattcaccgatatttactgataggcgatgaaatggaaactcccggcttgacattcagggcctcctgatctacttgttcccactcatttcccagttgtcaccttcatctaccccacagaacagagagccagatcagagacaaaggtgggtcttttgtgagctcatattgtgatgaagtaggtgagtttgagacaagtgcagaaatgtgcggtaggtcagtgaggacaggttgaaaacctgttttcacccaagcagagcctgctggcgtttcctcccttctgactttccattggcttacagcagaaatgcagcctcgcttaggccagagacagagactcagggtccaccccagagaaaagagaagctgttgtaagaagccttggagagtccaggagacctgaagtggttacaacttaaatctgtcccaacctagaagtttgagttctttactgaataatatagactgaagctgaccaatagcgatttccatcccaatactgacttgttgaactttttgaaagcactgtgttccgaaggattctgaggccaagtccaagctcagaggagctaatgctgtgaccagttagttaacacctgtcaagcttgtggagggatggagtcctttatcccctttgttttaagctcatgcttcttaaatcccttagttcctggcaatgctcattttatctcaaatgtagagtattttggttctgttgacttagttttgtttgtcctgagttcctaggaacttcacccttttaaatccaaacctcttgttggtttacttggggacagagctaaggttatagcttctccatttgacttccttatgtttgttaaagacacctccagatttgaatcttatttggtttttctgaagcagggtctctagaaggttgtttaaattgggtgtgctcttccgtgaattcgcgtattacttatgctcactcaccatctcagttgaaggctggtagtagtcaaatgactcagatggtgaataccaccattaacctttaacaggacatctagtacatcaacagtgggctccccatttatttctatttcaaaaccctgagtccctctgaatgtattcattgatgtcctgtttccaatttcattctcttttagctcgtttacagagcagagggcatcagtactctcgaaggcaatgagtgaagagcccgagaattttagagcatcactcctgtctatgtgccagaggctttctgagcctcattagtattgtgggcatggtcttcttatcaggacagttaacaaaaccaagatctccaaaacagacactaaatattcccagacacgagtcgtcccaaagggagaggtggcaatgttacccctagaaagaattataacaaagggcaaagaagagtagaggatgaggaagcaggaaggatctgtcttatgattgaagtgagaggttctcacaagtgcccaggattggattgggcaccggtgtgtggtgcagtgcgtctatactggctgcattgggacttactcaatgaattaatttttttggcaccaaatgtgttcttagttattgtgccatgtatttaaagatgtgcaatagtaaatgagaaatcttgggcctcaagatgtttacaacacggcgtggcctagggcaggtggcaataagctctttaatgagtattttatagccactgtggaaaacattatagtggttcctcaaaaaactaaaaatataacaaccatatgatccagcaatcctactgctggttatatacccaaaagaaaggacattagcatattaaagagatatgtgaactcccatgtatattgcagcactgtttacaatagccaagatgtagaatcaacctaagtgtccatcaatggatgaatggataaagaaattctgtcatagatgtacaatggaatattattcatccataaaagagaatgaaattctgtcatttgcagcaaagtggatggaactggaggccattatgttaagtgaaataagccaggcacagaaagacacatattgcatatttttactcatttgtgagaactaaaaaaattgatctcatgaaggtagagagaagaatggtggttaccagaggctgggaagggtagtggtgaagcggggataaagagaggttggttaatgggtaaaagaaaaaaatacagtttgatagtaggaatgagatctagtgtttggtagcacaacaaaatgactatagataggaataatttattgtataattcagtataactagaggaatgaatttggaatattcccagcacaaagaaatgatgaatgtttgaggtgatggttatcccaattgccctgatttgatcattacacattgtatgcctgtgtcaaaatattacacataccctataaatatgtgcaactattatgtacctataaaatttttttaaaattaaagtgctctagaggctcagaaaaaaaaaccctcttcctcccctcctctgcccaccccaccatccagtgaggactggaggatgaggaaagggctgaagaaggaagtggtgtgtgaggtgggttttaagaatggggaggacttttcttcctgtctctctcttccccttttctaattctttccttcctagagggtcttctttggtggtatgggtttgggctgcggtgaggcagaagccaagctgttccttttcttggatgtgtaggaacatgttttcagggacttgaggttccagaggagctggttctgctccttggccatctcctgcccaccacttaggctcataattactctgcaatgtactcatgaaacaggctagggtgtaaacattctttctgagactgtgcctctcgcacaggcacccagcctggaaatcaatggcacagaaaggatgaggtgagagtttggctcttggcctgtcttgtggagccagccatgctggcttccagaggggacaactgttggctctttaaggatgatgggagtccagctgttcaactttgaatggctgggaaagcagttacaatatgattgtaatcaagaaagggcagcagaaccagctggagaaggtgccccatgaacatactcaggcgccacctctggacagtctcatgttgactcagcagaacctggacgtgtgtgttttgaaagcagttctcgtccagttgggtccatgctgcgtctaccaccggaaactagggctctgcagacttttactcttataagttcccaggagctgacttgtttcctaacaatcatggtgcagatcagattattctgctcccataccacttttttgactttaaagaaatgtttaagcagtgccctcattgacatccaaaacctttccatttggcattcataatgtgatctgtattagtaaagtatataatggactctttgtttcattattataattataattattattatttttttgctgtcatttgtagctccggattttcgagcttacttgataggagggcttatcgccttggtggctgtggctgtgtctgttgtgtacatatacaacatttttaagatcgacattgttctttggtatcgaagtgccttccattctacagagaccatagtaggtaagtgtgtgtaatcactgaaaaatgcctcaaaattggtatcctcttatacatatacaacgatttcaaatatactttgtcatattttactacgttgttggcaaatttagggaaaggaatctccttggaactgcctgtgctttagagaaatgatttgtccctaatcaccagcatcatttggtcagataaggcttgcaggctcgtagtgattgaggaaatatttgctaagctgcaggaggagatcatcttctaagtcctgctgcaaccatgttacaaaagtttccacgtccatcctccgtccactgcgggaaagtttctccgaaaccaaagtgctctccatccatgatgtgtgctcagcacagtgggtactttctcagaatctgggtcatggagagggatgagctgcctgcggttggagctctctctaggccctgtacttggtgcctgaagggatttaagtcttcaactctcagatatggagagagatcaaaccaagtttgaatgtgacttctccacttactccctatgtaaacttagaaagatgtttaactttcttctatttctcagctatagaaaggaatagaggaaggaaggaaggagacagggagggaggaaagaaagagagagagagggaggaaggaaaggagagagggagggaaaacggagggaagaagggagtttcgtagaaaagaaactaaagaaagcaggggagagagatggaggagaagggaggaagggaagaaagaaggaagggaagaaaaaagaaagaaacaaagaaagggacagtgattaaatcctgctttttgacagtgggaataactgagttgaagtacagggaagcattcagcggggcctgggccacagggcggcctctattgcttgtctggaggtcaaaacaaatccccaacaccacagctgtgggttttagtctgtgggcctatgtcctgccagtgctgtttggcatagaaatgcctcagtgtgatcctgactctctgagagcctggcatttcccaccatggtgcttgtgactatgctacttttgttttgttttgttttgttttgtcttagaacagatacaatctattaaggccttgcaaaagtaataaatctgctctaaagtcccctaattagatgaaaaaagaagcctggtgcagctgatctgtgtggagatgcacgactttataccttttaagtccagaggcctgagtgacaagagcaggaaagggagggaaactggttgtctgagaacgttttatggggccagctaaaacataaaagaggtcactggcatcaagtgcttgctttgcacataaaatacacagtacggttgttacccacatgtttgataaaacgtggctattcactaacttggattttttccaaattaaatttctgaattcagaattagcaaccctgagcaatgtagaaagcgataaactcctttttaatgacaaaagtcatctgaaccttaagtgtccagtgcaacctgaagtgctgctagtactgtggatagtccgactgggcatggggagggggtctctggttttggctctggcatctgcagaggccgccccgtctaagcacacccatgactgctctctcctgcttgcgtctttgagaagaagacagttcagtcccccaccactgattgttttctgacacagagttgagtggttcagttgctttctactttttgactaacagaagcctgcgtcactttacgtattcttcctggaagctcaggccccatggtgtgtctctctcactgtctctctctctcactgactctgtcagtgactctctcactgagtcattgcgactcccaggagcgtgactatagctgtgacttatgggtgttgtgcagtgtgtggggaagctgctagtgaggtcgagtttagcaggaagagaaaacaggaatagtgactcacacggagtagtgggggctgggcagatgagagagttaggcagccccgccctctgctgagactgggacgcagcccagattctgcaacagtgggcagaggatttggcgatggaggctaacaggcagccaggggtcctttttttctttatttttattttgcttaattcagaaaagtatgtgtgcattttgtgatgaaattctctacagctctgtctacgagaactgccctgtaatatctctgtgtgttggctttaacagtgagctactgatgagattctgagattagtcccagatcttgtttatgtccttgttccccttgaggatattttctgagttaaatcaggaaataccgattaatggatgaaaatgagaaagagagaaataatgtccttcgtaggataagtcatttaccctgactaggttagctaagctgtatcactcaattaataattaggtgtgcatgactcaccattttagaaggagccattgacagccctagctgaagtcagcaagttctgtatcttctctagcaagccactggagctttacaaattctcctggcaggggtgcatgtgtgtacgaggatggaagggtctgtgcacggatctcctagagagatttgaaaatgcctcgccttactccagataggtctttggagaatgtgcatgtaggatagaatggctaaaacgaagacaagccaaacagttagagtgatcaaagggaaaccaaggggacaatgggaaaacaagtcggggtagagttaatgacacctttaacaattattaaaggtgaatttgcttttcaagctaaagcaaaggcaatgacaagatccactgtgtgccattcacaacaacctttcagattttcatgagagaacatggctttttctgagactaatttccaaaggcagattttttttcccccacagggagtcctcatttcaaaagggcatggtgtagggaagcttgactgcaacaactttcccatggtaaatgtcatagcgtgttttgtgtggcttttcttctagtgttttctatgcatattgggggtaaacccaccaaacctcctgcagttcagtaaaagcatttgcgtggaggccagattgaatctgaattttccactgttctggtttcatcaggcctaaaatttagcaatatcatattgagagaaagtagggaattgaataatctttagacagtatttcatagatatgaatttatgtgaatgagcttttatatattattgccaagatcaagaaggacataacaattttaagggagtggaaatagactctgcttctttgctagggtgtggcaaagttctggaagaacatgtgggactggaaatattgctggggctacttttggaaaattcagactgacacagctgcacaggactaatcagggattagttttgtgaaatttcctgctcccatttctcattttagtcacagcaaaaggagcggtggacctgggtttacatcaaggctatgcactcaccagctgggagactttggagagatcgcacagtcttgctggtctcagcttccttactcataatttggggatagaaccatgtcccacacggttgatcatgagaagcaaagccgggaaatgttgaggtgccgttgcctggcaaggctcttcaaaaccagtggactacaacttgatctcttgctattaatgtattggtcagtaaattatgaattagtcatttgaaagtgatgaaaagtcactacgttttgagaacatcagcaagttctatttctactcaaaagcttagtcagacagaaagaaaaaaaagatgaccaaaaaattgggcacatttgtacattttgaatttttcaaaggtgtgagactttcttcctactcaaatgtcttctgatcctgaagttggagagcaacaagtacctatatcctcagacaccttgtttagaaacagggaacagggaacattcgcaaaagagagaatacacttagcacacaaggtttgtttgtttgttttaaaaatcagaaacagtaggaaaaaagagaaacagattgagagaagagagataactagtggcagggtctgggacaagtggcaataagcctgcatgtctgctgtagtttagaatagaccaggaaacactgtatttaccagagaggttattctctgtggtgaaccgagcatcaactcacccagcccttcatcagaaaccaaaggattaatatgatcacatttttaagtgggaaaattgaattccttctccaaaagttcagaaacataagaaacttatgaaatgtttcttttcccattttctatctacggaaaaaaaatcctctggctttggaaagtcaaatgtgtgctatgaaatttcacacagaaaagtatccacttatttgagcggtggccctgatcagtgacctttatgattccacaaggagtttcagctatgttgggtttttgccaattcaagacacaaattagttatcccttttgtgcctgccctgtgatcccactttaaaaagctgagtctgatctcagattcatccccaacatagatataagctctttgagcctccgtaaaatcaagcttcatttggatattcggtgagcactgatgaaggcctcctctgcgcccggtcctgctccagtggctgagggcagggcagggagccaacgaagtctccactcttacacagcttcctttcatgatggggtggggaggcagacaaggagtgtgcacgtgtgtgtgtgcatgcgtgtatatgactacatgtgcaagcatgggtgtgcatgcatgtgcatgcgtgtgtgtttgtgttaccattctctgtaagagatggccaagaatggtgagcagggacccgaaggtcagcagtggttggtgtgagaattgatggactgagaaatggtgttatgtaaactgtcaagatctgtgcacattttcattactattatttggacgaaagctagaagaatacaaggttttcctttcccttattaatcttaaaatcacctctttctgcaagtctgctcatccaacaaactctcatataaaggaaatagaaaaggacaccacccctctctagtacctactaggctgtctgagtttctaaacagcccaaagctcgaaatcgcgttttccaatgagacgcccacacttacctcttcttccactcaagccctctggccctgctgaagtccttattcattcacaggattcctgagtagggaattattcctccttccatgcccttctgaagctgcacccctgcaagactgtttaccatccactcttagaccctcacttttttcccctcaactctcccaccctttaaaatccaggagctccagcctggccaacataacgaaaccccgtctctgctaaaagtacaaaaattagccgggcctggtggcgggcgcctataatcccagctactcaggagactgaggcaggagaatcgcttgaacctgtgaggtggaggttgcagtgagccaagatggcgccactgcactccagcttgagagacatgagtgagactccatctaaaaataaaataaaaaaataaaataaaataaaatccaggagcggtcccatgttcattgtgagtttttttttttcaagaactccagaccatggggattttttattcttgctgtcttttctgttcgtttgactctcgtcgcctcgtagagtcttgtgtttaacttctgtgcatgtggatggtctgcccagtgaggtcttgttcatctcttcattggccaatgcaggggctgcttttgaggttgctcaataaatactgatgacgacgacatgcgccattgggtttgacttctctcaacggcactgcagattactagagtctgctcaattgctttttctcttgtttcacagatgtgagtctgtgggtttgtagtgatggaattcactggtgggcctgaatcaagagggagtcatccagttttgcctggtgcagttaggacagtgcttcgtcatacaggacacgctgagggtaacatgggtaaatggctagagtttcctgctttttgtttgtttattttagagatcctttttttgtttgttttagagatgtggtcttattctgtcatccaggctggagtgcagtggcgtgatcatagctcactgcatccttgaactctttttttttttttccgagacagagttttgctcttgttgcccaggctggagtgcaatggtgtgatctcggctcactgaaaccttcgcctcccaggttcaagcgattctcctgcctcagcctcctgagtagctgggattgcaggtgcccaccaccatgtctggctaattttttgtatttttagtagtgacagggtttcaccatgttggccaggctggtcttgaactcctgacctcaggtgatccacctgctttggcctcccaaagtgctgggattacaggcatgagccacatgcctggccacatccttgaactcctaagctcccatttcagcctcctgagtagctgggatttcaggcctgagctatcatgcctggctaactttttgaaaattattttctttggagagtcttgttatgttgccgaggctagtcttgaattcctggcctcaagctatcctcctgcttcagcttgtttattacagccatgcaccactgcgctggacgagtcttctgcctttaattctcatttctggccacatcacagggagtggtggacttagactcaaaagacgtggggtaggggtagggttagggattgcagatgtgatgcagcctacccagcctcagcttcactcttgagcattggggataagaccacctccctcaggggtccatttgtgagaggagatgatgtcccttggcagcccctggcaccaagtcagccaactgggcactcagaagtcatggaacccaggccaaaggacaccatggtagccgctcaggcttccggtttattaacatgagagaatttggtagcaacaattccacaagcttgtccaattccttttcagatgggaagctgtatgacgcctatgtcttataccccaagccccacaaggaaagccagaggcatgccgtggatgccctggtgttgaatatcctgcccgaggtgttggagagacaatgtggatataagttgtttatattcggcagagatgaattccctggacaaggtgggttttaagtgaggtgtaaaaataacaaataaaagaaggaaagcgacccctctgttcctccactttactaatggcggtgactctgcctgccttccccatggaaccacagagagtctatgaccagcgccccctgcccgtcagcccccagcccccagccaaggaggttaggcccaagctctttgcctgctctaggctcctccctgccccgcagtgcctgagattcctgcttgcagcagcacgcgtctcactttgagtgaggatatggttaagccattcacagaaacaggtggccagtgatgtagtggtggctaaaggactgaaaggtggcgagtggtcatttgagcctcacatccctgagatgaactgctgggtgttttccatgggtttgaacaatgtaaatcaggtcgtgcttaaagctgattttataaacctcgaccctacttgccccctcccctccctaaatataatggaagttttagtgtacttttcccacttgataggaaggtggctttggacagttcagttaacttctctcaacctcagttgtctcatctgtaaaatggggatggggtgcttccctgactcagatgagagaactgaatgagaaaacctgagaaggggtccccggcatggagctcagcacactttagacactcacacaacagtgctttcctgtccctttgttctccttcttggaaggctatacagcaaaatggctgaaatctgaaataaacattcttttctagtcaccagtaaatgccaattcactcacttattcaacaaatatttactgaaaacctctatgtgatggacagtattctaggcactagaaatatgaaaatcagccaagcagaagggcctgtcctcagggaggttccagtctattcttatttcccatgagaggcaactgtagactgaatagcatctgcagagctgggtatttagagaaacctccctttcccaagcaatcatcagggcatgttatttggtttctaaattactcacataaatcctggtcatttaaataactataaagaacaaaaggaaaacacagattcaagattaatgcaacatttcagctaactacattttcctatccttttaaaatctatttttaaaaacgtgttcatctgctaatatacaccagaccttcagctagtctggggatacagagttaggaaccatcagatacttgttggccagggaaagtgacatacaaagaaaccacatgcaaaacatgattcatgactatagaggaccaaggctccagggaaagccacaaaggcttcacagaagaggtgacaaatattaaaaaaaagaaaaaaacccaaaacttgtattaatccattcctgactaagtcatgtttattttaaagtccatttttggccaggcaaggtggctcacacctgtaaccccagcaccttgagaggccgaggtgggcagatcacttgaggtcaggagttcaacaccagcttgtggtaaaaccccgtttctactaaaaatgcaaaaattagctggacgtggtggtacgtgtctgtaatcccaggtacttaggaggctgaggcaggagaatcgcttgaacctgggaggtggaggttgcagtgagctgagattgcatccctgcactccaacctgggcaacacagtgagacttcatttcaaaaaaaaaaagtcaattttctcctggcctgtttcaaacattctcactagcattaagacccgggctgttttaattgtgagttcttctgagccttctttctttatttccagccgtggccaatgtcatcgatgaaaacgttaagctgtgcaggaggctgattgtcattgtggtccccgaatcgctgggctttggcctgttgaagaacctgtcagaagaacaaatcgcggtctacagtgccctgatccaggacgggatgaaggttattctcattgagctggagaaaatcgaggactacacagtcatgccagagtcaattcagtacatcaaacagaagcatggtgccatccggtggcatggggacttcacggagcagtcacagtgtatgaagaccaagttttggaagacagtgagataccacatgccgcccagaaggtgtcggccgtttcctccggtccagctgctgcagcacacaccttgctaccgcaccgcaggtgagcgggtgggaggacacgaggtttgtcacgcactgatggagggtctatcattgcgtggtggctcacagctggaggaggacacgtttcatcggggccgtctgctctgaagctggcagttgcgtactagtgagaggatctgttgtgtttgttgtcatttgtttgcttcgatcagagctgcttcttcagggaaacacacggcttctgcagaaggccctctttagcctatgggcttattgacacatgcccactcactgaggcctggatggatacagcacttgggccccttgagaacaggacatggagggttttagaaatggcagtggacatgcccggaagtttgcccatgatgtggcacccatagagtctgagatgggagcctgtgctgtcgggggaccacaggagggcagtctagcaccaggagagggttggcaaggatagcagtatttgtccacgcctgtccagtgtcttcagggccccatgctcaggggtcatttgctgtgtctgcgtctctctcactctgtcagtgcagacaaagagctgcaaacacagccttagcactttgcttccagaagcaagttaaaagtcacctagaccagtggggacccacgggagtggccatgactgcctcttggtcacccttccatgtttgagaggctttatctgtcaaactaaagcaagcaggaattccttttctctctcttttagacacatgtcaaccagaattctgagcagcctgtgagagacgcaattagcacacagatgatagaattatagtccaagcaaggcaaagtcagtttccaatgagccaatgtgcccttgtcacaggccaatttataacttaatgattaaaggtttttaatactaaaaattagctgtaaaccctcatcacttttttccaagaccctggcctgagggaattaggcatagctcaaccttctgaagctgtgggttgttgacactgagacttagtaagcagtcagtgggggctggaagggagtcagccctgagagccagccggcaggggtgagagagggagccagagggtgtcaggaggcctgtggccttaggatggcatggggagcagggtgggttaggaggtgctgtgccctcgttcacaggcgatgggtggtacccagtgtgggatggactttcaggtgctaaggaacccactcctgtctttgaagagtttatgttccaaggtgacctcacattacacatttgtttagcatcctatggaggcctcgacttgacattggtccactctttatttaacatttgctttttaaaatttttatttcagtaaactatatgaacataaaattcaccattttaacaatttttaagtggcattaagtacattcacactgttgtgcggccatcaccaccatccattccagaattgtttcatcctctcaagctgaaattctgtgcccattaagctatgcctccctattgccttcccattgccttcccattgcctccccattgctctgaggtaggacataaaatacattttaagaataacagcattaaaaaatggctactataattcattactactattacatttttgatacttttcaataaaaagaaagtagtgacacatgttggaaagagggaagctttttgacttataaaactccagttaaagaatttaccaacagtgctggtctccgggaagtcagaggtttccagaaaataccttttcgtctgacgggtcagctttctattttgctgacagcctcgactgatgtcctgtgagtgtggtcattcatttataaataattaattgctagagaatccattttctaaaattcacaggcacacccttcagagaggacacgtccccgtacctctcccactctccccacactgtggctgcctctggctgcctccatcctgcagagggaaatggctgggaaggaagggggaagggtgctgagatgccctcaaatctgaatggggtgggtgtattccccaaatcctcaccaaaccacgagccagtgaccactcaccctttgcggtccagatcttactgccccggggttagtcaagtggccagaggtggtgcccactgccctcagggggtttcctggcgtggcctggtctcacatgcactccgcagaaggaaggacgaagcgtcctcagccagcccgcagccaccctgcccactccagcactgcaggcagccttcagagaccagcccagagaagagaacggcagcgagtgaggggacagagtgcggaacagatcagtaatgcccattttcctcttgggtgcaataggagaaacagcctgttttaattaaactagcgaatcctccatgaggaataacgactctcatgttggagagagaaatcgagatgcaaagaaactttttaaagttctactaattcctaatgaaataatagggatgcaatgcagcaagaatacaaataattgaagtagcctggcatcaccgctgacatgtaggcaggttggcaggtaacagctccgctcatggtctcaagtccaaatttgtataagaaaggaggtttaagagttcaacggctaagggacaaaaaggtagtttatgggaacgctgaaggccaccctcaattctctcccgtttctccagctgggcttggcgcaaatatgaggtcaatggggtcctatccctagcccttgggggtgggctccagaattctactccaagcaaagtgaagtcagtttccaaggagccagtgtgccttcatcacaggccaatttataatttaatgattcacaaagttttttaatactatgaattagctgtaaaccctcatcactcctttccaagaccctggcttgagggaattagagacccccctgggaatccccagggactgacctggaggtagggctgcgagcggagattggaccagagaggtgaaatacaggtgctgagtcgctgggttacctttacattcaccttcccataatgactgagtcagccacaaaacccactacctttggtatctcccctcaaataccctgagtcggctcatgagagaggccctgggaaagacccagtcacattaaataaagggaccgggaaggtgtggtctttccccggaggaccaagcaagatgaagatatacatgtgaaaagtgcttggcaaaccgtgggatgccatgaggagctggcctgccaaaatatggaatgtgctcagggagcctcagtccccagggccccccacacccatcagcaccccatagtgacgcagaccacttcctgccacgtcatggttggttgacctttcctcggcacttggtcctgttttttatttataaacttccctctaacacatgcttgtttggtattgatctggggctgtgtaaagtggaaaattccttcctggtttccttgaagaacagaggctgttccagatgaggtctggagtgagctacagagggtgatgctggctttaggagtggtggctgctgggtctgaatgttagaggccacacatctccagtagtagtattattctgggagatgggaactctgtgtgtggatgtcccctcccatacacccaggaacttctgagaaatgctgctgttcactaatacaattccaccctcatctcccaggctgtccctggagaggagctctccacttgagaaggacctcagagccctggctcttgtcatccaaattcacctttcctctggggctcttataggaaaggtgagagttgacactgctcacctgtgatcctctggcataaccaccttgcaaagataacccaagagaaatggaagcctcagggatataccaccagatgaactgacggcaaggtggaggttttcgcattcccatggcaggtttccttatcagcccccatctcccaccacatcagaaaaggagtaaatagatctttcctgatttcaggcccagaactaggctcaagaagaaagaagtgtactctcacgactggctaagacttgctggactgacacctatggctggaagatgacttgttttgctccatgtctcctcattcctacacctattttctgctgcaggatgaggctagggttagcattctagacacccagttgagctcaggcttagagaagaggaggatgggataagaactggggccatccccatgtcatggtgggtgagagctggggccatccccgtggtcatggagggtgagagctgggggttatccccatggtcatggagggtgagggctggtcgggggaggcatccccaagtcatggtgggtgagagctcggagcatccccatgtcatggtgggtgagatctgggggtatccctgtgtcatggtgggtgagggcgggtggtcatccacatggtcatagtgggtgagagctgggggtatccctacatcatggtgggtgagagctgggagcatccccatgtcatggtgggcgagatctggggggtatccccacgtcatggtggatgagagctgggggaatcaccatgtcatggtgggtgagatcttgggggatcacctgtcatggtgggtgagagctggggggatcacctgtcatggtgggtgagagttgggattcatccccatgtcatggtgggctgagcccacatggaagcctgtgcttggacagcgtatgcccttttctctgtttttccacaatgaacaattaaactgtaaatgttaaaaatatcagtaatttgtgaaataaattttattctcatttgagcaacataaatcacaattttgtttgtttaccatgcctgtcaaaatcacaaacattttcttatcagtttaaataatgaaaactgatttctgctaaaatcatctgacaattagcttgtcaacattcaaatatttttcaccttaaatccactaccttcgtggtgtggtccactgaaaagttgggcaaaacccaacctgtgattgaggctatagagaaacatgagggtcatgcacaatagctttttttccccacacttagtagatggactgtttctcagtctgacagccaccaaagctttatgtcctgatgaatattttcgtcctctcatcctctctgatggcctcatttctccaaatttcttcttctcctcctttttttttttttttttttttttttttgagacagagtttcgcttttgtcaccgaggctgggattacaagcatgagccaccgagcccggtcaaggctttcatatttttaaaactttgaagtacagtgagaaacataatttagtaagcaactcagtatgcacacacggaatggaaaaagctctgttctatgttatttgttctattttgttcaagtctagctcaatttttcaaaatgctggtcacagctcgccaacttgttttaataaccaacttatgcctttccactgcaatctggagagctcagcctctcaggctgctggtccccctgtcaatcacgatactttggctactttgctttcttcaatcaacaaggctttatcaagaacttatggctcttttaattatctgacttcctggtcaatcagctttgtttgtggttttaaatgaccacaggatagtagaagtgaacataatttcctgcctgtgtaaaaggatgacatcaagaggaaaagaaagcagctcactgggtgaaggaccttgagaaagagatgaacatttcctctcttgagacacaggacaaacaaggtcacgcctgagctcggcaaacaaggacttcggtgcctgcctacggcgccattgcgccctctagtggctgctgaggaaccgctgtccagcccgaagctcacagagccccgttcaggctgccgcaacctacctaggcggccagaatggagacttacaggtgggcgggcatcccggggtgcacacattaccttctcggggctctccaacttaaggccaaggatatctttcttctttttcggctgctgagaaggtggagatagtgccattttcgaatgtgttcctaactcttgggcttctgagactgtcgcagtctgtccaagggtggtgagtggggatcagcaggccctgtttactatgtgctcgcaagaggggactgcggtcatagggatttcagagaggtggccct

SEQ ID NO: 646 - DNA, 40123 bp, Human
attttcttctttcagtcttcattttgtaaatctcctacattgagtgtaaattgctttggaaatcagaaaaactttaaaaagaaagaaacttaagagttacggaaaagcaaaaatattgatgttaaacataacaattaaaaacccttaaaattcttacatgtgagacatttaatatttatattcttctatgcctattttattaatacttgctagagtatctgttacatttatcagaatatctctttttctggaaatgaattcattatttaatataaccttaatctgttaaattcacacataaaacttaagtacattaaaaattttacatacacacatccacatttgcagaatggtgtgcaaataccagctaatttttgtatactgagatcttaatatgtttcatattgaaactcagagttaacttgtcagtttgctgagccatctcctgataactttgtctcttggtagatattgaatattttttttaaagtggtgctttttataaggttacatcagtcttaatcagagtgacataaaggaaataacattttttattctatccaagataaaagaataggcagagttaataataaaatgtgtgtggaggtagtgggggaggtttcaaaccatagacccagtctaatttgattatgcacagttggtactttccattcatacttgtttctttggcctttacattattgattattatctcttggaaattccaccaaatatttggtgatttttccataaggatgtatgtgaatggtttggcagcttagccattaagctttatcctggattcaggcattgacaactctgtttttaggatggaagatgagtagttgttggtgagaggggcattattctgagctgagaagctgccatgcactcaggaagtctccataagccttagatggtttaatcactcaataattccagaaacaggccttcttatcatctccattttggtaatgaccaaataggctctaagacttgctcaagttttgcacagcttgtcaggactcaaactggagtggcagcccaggtttgtgtgtttctgaaaccagactctgccatcaggctgtgctccctgcactcaggatggtaaacaagggatatggtgttgtttatgcagtatttagactctgaatggtctccactgtgggggatccttcctccactgggctcaaagttgtaatcagaactccgaatgctaggttgcagtaggatcaaagttcaatgcagatcttagttccactgggacacagtcaatgtaaaggaggggtctggagtgtaggagactgtcacttcatctctccatttccctaaagtaaactcatatgggcagccacagacacacgcgaacacatgcatacacacctatgcctcagtgacacatgttagtgagtgctggccatgtgctaggcatcgtgctggattttagtgatacagtgaagagcaaaatagacttagtgcctagaattatgaaagaattatgaaacctacgttctgaaggaggaagatggagttttaaaaattcaaccctaaatgaagatctcattacaattcaggaatgttttgatgtgaaaacacacacacacactctgttacatgggcagaactgccatacatagctcagcatgtcacagattgtttattcatagaatggtaatatttgtagcagtactattgttctgaactttggccttggaagcaggatttagtagaccaggcctgaaattcttcagactctgttgtatcagagaaataaattattagggatttcttccagaagaaaaacttcattgccttgaaattttattaattttatatggctgaaagttctgagaattggttactatattaaggattataaaaatcttctaggttgtttttttaaaaatctgtgtgccagaagatttttaaaccttcataagataggcacacttttgtttgaaagctttggctgaatctgttttattctgttttccagagaagccatttgaagcagaatccaaaccatgaattgtagagaattacccttgaccctttgggtgcttatatctgtaagcactgcaggtaagtgattatacatactctcaaacatatttcatgagtaattgaggaagaatgtcaaagtttttttttttatgtggtggctactgaagatgctgaatttattcagaaaagaaaagattctgcagtctgagttcatgtagtgagagcagagtgaaaaacttgcatcttgaaataaattacatttgtctgaggtgaaaatttatttcatgttatttgaaactgaggaggtggcagccatctttattattgggttttaggaagtttgaaacacactttctccttcctgagagggaggcaaagattcatctcattatttaggtaataatgagaaaagtaaacgacaaatatattagacagcttaaaaaaattagagtgagacagaatatacaaaaaagagactggctagaccaaggagctcaagtaggcttcatagtagatgtcaaatgccaattttaatttattagcagtgattgcctagagttttttttttttatttgagaaggattctgagacttcattctttagcgttccatgattgaatagcaaggcattccttaggctttgggggagaaagtgggagcacaaatattaatttgccttgatctattatctaggagagggaaacacatgggctcatttccctactttgataattactgctgaagagatagctgaattaagcttttggtactttcaaataacacaggtccaatctcagggtatatttacttacgtgaatccatttattattgagatccctgcaatggaaccctacccagatgataaaagaatgaggtagatcttcatttttttatatgtaatgatctgtcaaacaagtgagtggaaaagcaaggtacaggaaaatgtgtcatgagttccatgtcctgtggacatacactaatagccttactcctcattataatgagagcatgtttcaggcacagaaacagccatgcagccagttgtgcaaagttgccaagctcccagctgcctgccctgaagagcacttttcatgaatgtttcactctagggagacatgacaatgttctacatgtaggattcactgaacctagttgagtttaaatgacaaaatgctatgattgtccaaactcaagacagtttcaaacacagactttattccaaagggcattggttgttggcactgctgggttcttatactgtgtttatggaacaataggagtgcctattttggcacttggaactccacaaaccttgaattccacttatttatcccatcaaggaccatttccaacaagcattatggtaatcaacaaagcctctaatggtaaaccatgattagatatccaaagcttctagctgcctgaggaggggggtggtgtggactttcaattatcaacctcccacctctggagagtgtgtaattcacattaagtttcttcaaatggtaatacttccagagagcacatgtccatccaaacacagtcatatgtgtttatagaagctttttaagacaagcgaaaacctgaaaacctagaaataagccaatatccaacagacatttgtttaataaaccaaatccccaacatgcatccttttataaaatggataaattgcgaaatggtaacacgattagatactacattacaatgagaaaagaacacatcactgctacagcatgaatgcatttataacaatcatgtcaaaataacccagacataaaggagcacatattgtatagcctatgcattttattatattaactctaaaacaggaaaataaatgaactgttaatgactcaccagggttttgcatgtcaattgaagctgacacccacatatacacatgtatcacaccttctatgttgaagtattagtataaaatagagattgtattgcaaccagaaaacatgaagttggtgctccttaactcttgtgttttgtggtagattcgacatccatgttttcaaagaatgtgtattagtccattctcatgctgctaataaaggcatacttgagactgggtaatttataaaggaaagagactttattgattcacagttctgtatggctggggaggcctcaggaagcttacaatcatagtggaaggggaagaaaacatatccttcttcacatggtggcatcaaggagaaggctgagcaaaaaggggaaaagccccttataaaaacatcagatcttatgagaactcactcactatcaggagcacagcatgagggtaatcacccccatgattaaattaccttccaccaggtccctcctatgacacatggggcttatgggaactacaattcaagatgatttgggttggggtatagccaaatcatatcattccacccctggcctctcccaaatctcatgctctcacatttcaaaacacaatcatgcccttctaacagtcccccaaagtcttcactcattccagcattaactctaaaatccaagtccaaagtctcatctgagacaaggaaggtcccttcctatgagtcagtaaattcaagagcaatttagttacttcctagatacaatgggagtacaggcattgagtaaatacaccccttccaaatgggagaaattgactaaaacaaaggggctactggccccatgcaagttctaaatttaatagggcagtcattaaaccttaaagttccaaaatagtctccttcaactccatgtctcatatccaggtcacgctgctgcaagaggtaggatcccatggccttgggcagctatgctcctgtggctttgcagggtacatctttcttcctggtttctttcatgggctggtgttgagtttctgggctttttcaagtgcatggtgcaagctgtcagtgaatctatcatcctggggcctggaggatggtggctttcttctcttaactccactagctgtactccagtggggactctgtatgggagccccaacaccacatttcccttccacactaccctagcaaagattctacatgagggttccacccctgcagcaaacttttgcctggacatccagcatttccatacatcctctgaaacctaggcgtaggttcctaaacctcaattcttgacttttgtgcacctgcagcctcaacaccatgtggaaggtgccaaggtttggggcttgcaccctctgaagccacagcctgacctggtatcttggcctgttttagcaatggctggaggggtaggatgcagggcaccaaatccctaggctgcacacagaaagggaccctgggcccatcccaggaaatcattttttcctcttaggcctctgggcctgtgatgggagggtctctcatgaagatctctgacataccctagaggcatttttccccttgtcttggcaattaacatttgagtcctcatttcttatgcaaatttctgcaaccagctttaattccatgccccccattcccacgaacatggatttttctctcctaccacattctcaagctgtgaattttccaaactcttatgctctgtcacctcttgaatgatttgctctttagaaatttcttcttccagataatcgtctctcaagttcaaagttccatagatctctaggacaagggcaaaatgcaactaatctctttgctaaacataacaagattcacttttgctccagctccccaaaagttcctcatctccatctgagaccacctcagcctggactttattgtccataacattatcagcattttggttaaagccatttaacaagtctttaggaagttccaaacttttccatattttcttatcttcttcaaactgttccaactgttccaaactgccctccaaactgttccaacctctgcctgtatgcagttccaaagtcacttccacattttgtgtatctttacagtagcaccccacttctggtaccaatttactttattagtccattctcacactgctaataaaggcatacctgagaccaggtaatatataaaggagaaagatttaatggactcagttctgcagggctggggaggcctcaggaaacttacaaaagggggaaaagccccttacaaaaccatcagatctcatgagaactcactcactatcatgagaacagcatgagggtgactgcccccatgattaaattcaagatgaggtttggatggggacacagccaaaccatatcagaatacttctatcacatcacttcctctttatgttgtggttaacaattttgagttaaaaccagactgctgctttgagaaacaaaccctgactatagagaaggcattctgtccatgtcctaagggaaatgtttcgttcagtttaaatactctcattctcaaaatgtggtaaaagtgcacccgagagtcactggagggtagattatgagaaagacccattaatgctgaacttgaagtaccacaagtgccgaaagaggggaacgagcacctatcctgggtagatgatggtcagatatatttccaaagccagagaatctgggtcaattgagaaagagggaaagtgacagatatgcaaatttggattgatattatattaatgaattcttgattatccacatggtgacctacagtaataataaatgtacacacactgtaagttacataggcacacttttaaccatccccacacttaccagggaatgttagataggcagggtgaatgcaaggtgagtgagatttctgatggtgcagaggaagaacgccaaggttgctagatttcttgttttcttttctactgagactcctcagcagggtatattttgaggtaggtatggcagcaccgtgacttctgtggctttccctatgaagaagttgtaatgtgtaatattttcttctaagaggtgacacaattatcagtcttctagctatggttggttaagttctgataccttcctgttggggagaaactgtcagaagttgtgttttcatctatgttctgaaagtgccttatcctttctagtgttggaaagattgacgcaaaaataaagaacccacaggaaattgacaccgagatttctcaggactttcttgctaaccttgcttcttcacctaatgcattaggagaccaaaaaaagttaccttgtcattttggtttttgtttttatttattttactttactaatcttctgaagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaagtgagtaaccctttcttttcaaaatgtatttcacagccctcttgtcctttgttcagcaactcaaatatgcagtaatctgaaaggtcagataatcaccacatccttttctttcctactcttcctatgacatgaaatacattctatgttatggaacaaaataagtttatctctctctgcttattttcttagtgaccttaatgaaaggagattactttgataggatttccttttaggggatccttaccaatgacaagtgacgattgcatgaaagtcagttttaaaattcagctgctcctgttgtctacatgcccccagtcaaatgaaatcagcagctcggacttcacgataatattaatgtgttgcgaatggggcagtgtcagcttcctgggtggcatccctggtggggagcagggatggggttgatgcagaaacaccctagtccagtctgcaggggctcactgggagccaggtggcagtgctagtggaggaagtgtgtgtctggcagccaatcgcaacccacagctggcggcagtgagagagggcaacacggaagggctttgcattttactcatgaggtggccctagattgtgccagaatactcgaaattgggttgcataacttccatgaaatgagcacagccaactgaaagcatcacccacacttaccgaacatgtttctttttagatgtacctacctacatatgtaggtagttttatagagacttgagactgacctgtaagaaatagctcagggccagctgaaggtgatggtgtgtagatttcatatgtagcagatttcttttagaagcacttctagagtgagtcctgatcattatcaaccatgctgttgagagcagagtgagctaccactgtgaaaccttggtagcacttctgtggttttgcaccaaatcaggtcatttttgtttgtttttatacataggaactcccaggcatcagaaaaaaattaaataactcttttgataaaaatcagtacatctttagatgaccttttaagagtgataattacagaaatgggtcacaactgggatttttcataacaagctaaggaagaatgaatactcacaaatggggtaaaggaaaaagaacaacaaacaccgccccccccaccacaaacttccaactcctgattgaatgaaggcacaatttaaaggaataaagtattctggacaggcctgagagagcacgttgagaggaacagccaggcatctatgatcatcacttggagataacagaagcaaatggcattggccatctttctgatacgggtagtagagaatacagcctggcttaggaagcaacaatggaagcaagagattgaggcaggatgtcagagagaggtgtggagagacagggtagcagataggagatgctaagaaaaatgaggtgtcccagagtggatattggagactgatcactatgagagtaaagtgttgaggagagaagcagctttgacaatggccttgaaaataaatgggattctacatggaagcaggttgttttagacacccaggagcatagaagatacagacatattcaaatatagcataattagtaagcagtatttactgcagatgtgtgtgtatacacatatgtgttctaacttaggtgtgtaaccctttgtagtttgatgtgggatctatcagtgaacagactttacacctgaaaatttcccgttagaacagtaattctttaatttttaggagtacattgctaataatcaaatgccactgaggactgataatttaatcctgcagtgaaaatcactttatcccaccaaattttaagaacgaaatcaactaagaaggaaggggatacaaaagggatagttttcaatgatagagatgaagaaatgaaggtagagggaaatgtacacacagaaatctaataaaccaatcctaggctgacaggcagcaagttcagcttggtgagcagcctcagaagtgggggctggtgtttatcccctggtgtctgtggacaaaaatgagtggttttcataaccaggatgggctgggcctgcagcaggaaagtgtggtcacagctttgggtcagttggcctcagtgttaaccccagccttggagctcctggatggcaggtgcagtgtgttgttgattgtttcagtgttcccagagcagtgtcctgcacatggagtgtcatcagtcctctagcatttgttgagtgttaggaattgaggattacagaggtagagaacaatgtagtctgaaaaaatggggatattcatgtaccctattccttttaagcaacaagtcatagagatccagaaatctctatctctccaattcattgaggtcaaagttggggagacattacgaaaacacacttgagaagaaggtgctgccaatgggatcctgaatccatttcaagagccaggtagctctatcatgtcccatggccatggacccactgcctataactgtgacaacagcctgccacattctccagtcacggccaatcttttataaattcatgcccaaggtgaaggggccagattcattggattgtgaaagtgtagaattgtgcagagcacttctggcctctggggccaaatagatgtgcatttgtatcctggccccatcttgtagcaagtgtgtggcctgagtgagttgtttaacctgtctgagatttagcattctcatctgagcctaaggaaaatagtcatctcccttgcatgtacatagtctaatacctggaactcagtaagtgttagtcttttcttccttctatcctattgtagacctaaaggggaactggaagagcctaaggtgggcacaaatgtgtcaggcatagaggataacttaaaaacacgcatctgctgtatttagcaaataaatctatacatcacaggtgcagtggaagcaaacatgaaatttgaaacattttctctttaaaatcttcatttaaaaaatactgtattgttttccaattccagatcaccttttttttgttgttgttgttgttgtttttttgagatggaatttcgctcttgttacccaggctggagtgcaatggcgcgatctccactcactgcaacctccgcctcctgcctcagcttcccgagtagctgggattaccgtacccagctaatttttgtagttttagtagagacggagtttcaccacattggccaggctggtctcaaactcctgacctcaggtgatccacctgccttggcctcccaaagtgctgggattacaggtgtgagccactgcacctggcctagtgatagtcctgatcactaatttctgatcaggagtaacaacaactataaaatctattcacactcacttttggtcagtaaggcatttaaagagctaattcaattacactgagggcagcaactccagactttggtttattcaacagtaaaagaaggggattggaagaagttgccttgagaaacaaaacctaatatatatatacacacatttagaaaacaacatcaggagtttatagaccttttgaaaccaaagccaccctcccatcctgggccaagactctctgaacttatccatcagtgaagatcactgacattgtaaagatttgcttttctgacatccataatatattgtctgcagtaggatatgtgcgtgtgtgcgtgtgcatgtgtgtgtctctgtgtgtagactgcttaggttttcatttattaccccctgctcccatgacagtttttaaagttcttgctcttctgaatcaagcggaggcagagcagggtttgcacatcaatgaatcaatctctttaataaaaataaaggaaaatattgtaactggttactaaagggaagatgggtgatatttgcaaagtttctgtagcattataaaatacctttacacttttattccatagaaattatactcagaaatggaaattaaatgtcatcagaagaaataaacacagctgtttcactgaaagacaagtaactagtaaaattgtggaagttaaaaaattttttcagataacctgtgaaaacagttactatcaaacactggtcaacagcacatcattgtataaggtaatgcttttataatattttaactttaagacttgatggaaaagataaaattcccaaatgaggggctgagagctaccattctggtctcataacaaataagctgcctgatcccacatggctcacttgccctgtttgagccaagtatcctcactggcttgttgtcaagagctgatacatagtattaaaatatgttccacagtagtttccctggatttggtgttcaataaatgatcacagtttcttctcccacactcttccttcattttccttctctttcgataagttagtttttaggaatgctagtttaaggatttccattttctcctgtcacatgtacttaacatgtaaaactcaattgtatatgtttttctgaatatattagttcattttataaaattggaaatggtaatgcttttataatattttaactttaaaactgaaaaatgaagaaagcaaaaatcactcataaatccatcacagacttttttttttctgtgaagcatctgctttttaaaagtggtatattttatttttttatgttttttcctctaagaattacgttgtgactatcccttcacatctttaaatgatcttctaaacatgggctttcagtttttatgtgcctggtttcatctaactaacccccttgtttcgtctaactaatcccattgttattggacatttgtgaattgcctatttttcactattatttaaaggctaaaatgaataccatttccacaaatccttgggtgtttatatgatttgtccttcaaccaaatccctaaatgtagaattactggatcagaggctgtgagcatgtttttatgtctttttcctcacactatcaaacttgtctccagggagctctgccaattttaccccacacttgaaaaaagaatcccaattttttgtcacctccacaacacagggaaataatggtcccagaatgtttaaaatttgatatgaaaaatttctaaaactcctagtggttttttcacttttcttagtaataaattaaacttttgtatatatttattgcatcttactgcaatcaggcaattttgtgggttgcctgtttatttttttctgttttcttcagttggtataccttttacctgttgaattttaaaagctcttatacaccatggaatactatacagccataaaaaagcatgagttcatgtcttttgtagggacatggatgaagctggaaaccatcattctcagaaaactaacacaggaatagaaaaccaaacactgcatgttctcactcataagtgggaggtgaacaatgagaacacatggacacagggaggggaacatcacacaccggggcctgttgtgtggggtgggagggtaggggatgtatagcattaggagaaatacctaatgtagatgacaaattgatgggttcagcaaaccaccatggcacgtgtatacctatgtaacaaacctgcacattctccacatataccccagaacttaaagtataataaaaaaaaaagctcttttagaccacgctataggaattatatatacacatacatagcgtgtgtgagtgtagtgtgtgtatgcataaaaaacatacgcactcccatccacacacatacgcaacacaaattgtgtagttcaggggtccccaatccccatgccactccccctcactaacattaccacctcctgtgagatccgcagctgcattagactctcacaggagtaagaaccctattgtgaactgtgcatgcgaggaatctatgttgcatgctccttatgagaatctaatgcctgatgatctgtcactgtctcccatcacccccagataggaccacctatttgcaggaaaacaagctcagggctccactgattctacattatggtgagttgtataattatctcattatatattacagtgtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtactttatatggaataacaaatctgaataatatgactctgtcgtggaaactttaaagacctataagagagtggtctgaacagaacttgggaaatctgaagcgagtgatgataatatccttgaaatttttgtttgtgccttattcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaagaaattccgttcgggtgcagtggctcacacctgtaatcccagcactttgtgaggctgaggtgggcggattattaggtcaggtgatcgagaccatgctggctaatatgatgaaaccccgtctctactaaaaatacaaaaaattagctgggtgtggtggcacatgcctgtagtcccaactgctcgggaggctgaggaaggagaatcacttgaacccgggaggcagaggttgcagcgagccgagactgggccactgcactccagcctaggggagagagcgatactccgtctcaaaaaaaaaaaaatgaaattccaaagtgcagctatttaaattatgagcattggtgcaccaaggatatttagctaaacaattgaccacagggctaagtattctaagcctgttgactgatcatgacttcacccgagagcaaggaggctaattcagtagataattgattggaaaggaaaatgaagagtctctgatcttttctatagcttgaaaaaattagtttggctttataaaattttgacttatacataaataatttactgacgtgaggtacacatgtgggtgcttcacgggcacattctatgcacaatgggtctagccccagtggctgccagctctgagggagaagtctgtgggcagtaggttctccttgcttggtgtttgcagaaacagtgtccaatggtcaaggatggccattcagcccccagacatcccatgtggtccctgcatggctctgggacctacctctgggtgtcagatgtgctggattgaagaaagtggctttattacaattagtattaattcctgtgacatgtatggaaatgtgtgtgtgagagagagagatgtttgagtgtacctatggatttgaatattgctgatgcatttctaatcagctcgctggcttctgatggagggtgtcaaaggtgtgggtggtctgctagctactcattctctgagtaattctccacccatcccactatccaccccttggatgcatagtccagaatacacaaaattggactgaacatgtatgaaatagagttgtgactcaagcaagggtttttgaagtagtgttctctctctctctctgtctctcgctgtttctctctctctgcatgtgtgtaaaagagagagatgaaagaatattgatgaaagcagctacagtgctcatattgccccatgctctacttcccagcatatattaataatgataatcatgccaacagcaatgggatcgcatttaattgtttcagtaaaagtagtaccaagtaactgggacatatgtccaggaattgctactttccattcttttttcctttttctctaaagatctttaactcaaaaatttggatcactgtaatatcaatttggcttttacttaaagtattttaacttgttttattaaaaacagaactgtaaaaagctactactggagaacaataaaaacccaacgataaagaagaacgccgagtttgaagatcaggggtattactcctgcgtgcatttccttcatcataatggaaaactatttaatatcaccaaaaccttcaatataacaatagtggaaggtaagggaaatcttagaattgggaagaaacagacgtattttagtaaaatggaattttttcattcttcaaaactgtgtaggaattgagagtccacttagttggggttgtgaccacaccactagttcaaatatgatggtcaaaatcttcattccggtgctcctctacttggctaaataaacctttctttttggcaggaaatgaaaatctgtatgaataaacctcacatgagtcagctctctcttatatatgaaatttgagtaaattgtggaatcttttgttgttgaatttacattttcactttacaagtatttagtgaagatatctatactcaataaactgtacttagcacaaggaggcagggaagcaaggaagtatgagatgaagtgagcactgtactattctcaagggatttgattctaatcaggagaggcaataagctacataaaggtgtatgaaacagcatcatctgtgaggctgcaagagtgcagggggaggttggaggaaggacagatgcaggaggctccatttgacctgggtcttggagggggagcctcatgaaacagtgacctgctgggggaagggatctccactgggagagtgtaaggaacactgatgtgctggtgggaggggagggatgctggacccaggctgtgtgtgatggaggaacagaatcctgggacattaaaggtatttaattaaacctcacccagtgaagatattcatcataaggcacagccaatgattgatcatccagtcccttcttgggaactatcaaggaaatgaccaaatcacacagcagtgtagtccagattttaatatctgattgttgaagtcttttttttccattgagtccaaatatcccttctcgtagcttccaaccactgattttgatttgccttcaagaatttcacagattaaatctggctccttcttaaaatgacagctcctttcgtgatttgaagacaggttgcttatccagtctggatttttttccccatcatcctgagaaactggaaactgtaacacttgtgtgggtggcttgttcaacaaaatctgtgggctcacatttgctacagcctttgctttagcaacatctttcttcttcactacaaccatatagctatatacacccacatgttgccacagtaacaaattatcccaagtttagtgtcttcggtaaaatcaaggttttgccagaattgctttacttctggaggctgtaggggaaaatgcgtttcttttatttttttatttattttatatttttgagatggagtcttgctctgttgcctaggctgcagtgcagtggcgcagccttggggctcactgcaagctccgcctcctgggttcacaccattctcctgcctcagcctcccgagtagctgggactacaggcacccgccaccactcccggctaatttttatattttttttagtagagacggggtttcaccgtgttagccaggatggtctcgatctcctgacctcgtgatccccctgccttggtctcccaaagtactgggattacaggcataagccactgcaccaggctggaaaatgtgtttctttgcctttgctttctccagcttctagagaccacttgcatttcttggcttgtgccacttcatttcagagccaaacacatttgcttccctcacctcatctcctttttgactctgacctttctgtctccctctgatgaggaccttgagacagcattgtgcccacctagataatccagggtgatccccctatctcaagatccttaatttaatcacacctagaggttccttttgccatgtaacatatcgtattcacaggaactcaggagtaggatgtgggaaacttcagggtctattattctgcctgccacagcccagaacctgggaaacccataactgaattttaaactcaaaaacttaaattctgtgtataatcatctaccctaaactctccaactttactttcctacatctatttttaatctcatataaatctctgttactttgatactttcagaacctacaccctctttcccaccatctttgctttctgcccatcagcagctctttccttccttctttgatgaagctgtaggaatatccattattaaaagggtgcttgttatgggccagggatagtgccaagtactggagttgaatcatgtcatataatcctcacaacagctctatgagactgtggccttgggtgagttaatttccttagttcctctctgcctcagattcctcatcatgaaatgggacagtaatggttcatccctcgtagggttggctgacaatgactgagtgagtgtgtgtacagctctaggatggctctagggacagtaagagttctgctgtaatgaccatctcccactgctaggttcccaaacctcacctgcagcacaagctattcttctcccataattgtccatcttatttttcttgtcttcttggagaatgtcaactgagtctctcaggactccactcaaatgtcgctcctccttcatgcccccatggcctcttgtttgtatttctgattgctgtcagaattgcaatacatgtgtgtctctgtcaataacttgaaaggtttctggaaaggtttgcactgacttctgttcctcatctttgcatcttggatacctacaattggcacttggcacataaaggtgctcattacatgcctgttgtgtgcatcactgagacagaaacaactcctttgatgccacatacaacaagaagtctagacacttcaccatcctggctatttttctttggatttggcaaagtttgccacgagtctacagaaattagagcttggagttggggaagacagccaggaggtgttctgacctgtgttgaggacagagaggttctgagctcgtgccttctccatgttgtgtctttattacagtccccttgccttcacagatggagatctctcagctgctacatagtgactgctgtagtggtggaaaggtgtgatacctctcctccccatcctaagggtcatggcaatgttcccataacaaaagacagattaacaaggggcaagcaagttttatgtgacatgggagccttcagaaatgaagaccctggggccgggtgtggtggctcatgctggtaatcctagcactttgggaggccgaggcggatggatcacctgaggccaggagttcgggacaggcctggccaacatggcaaaaccccatctctactaaaaacagaaaaattagctgggcttggtggtgggcacctgtaatcccagctacttgggagactgaggcagggagaattgcttgaacccaggagatggaggttgcagtgagccgaggttgtgccattgcactccagcccaggtgacagagcaagactcggtctcaaaaaaaaaaaaaaaaaaaaaaggaaagaaatgaataccctaagactcagggaaacccgtttttttctttttaaatgcttaggttctagaagcatggacagccatgtagaaatgtgattggacaaaagggtatgacctaatgctaatggactgagtggggaaacccagcaagacctgtccagattcttcttggcctctctgttatatttccttttcctgggtagagggcagagggtcttaagacttactgtcagaccaaagaaggccaaagaatttatagccaactcctagacagaaaggcaggagaaggttagagtcatgcttctaggttctatggcttactttggggaaaaggattctagtttttatgatctgcctttgggaagagggagtctggtttctgtgacttgctttggggagaatggaggcatgaagcaggagggtcagagagatcttgctttttgaggctgctttgaggccttccaatgtcgttgagtttaaagtactcagcctgccaaaacaccatactttgggactgtttttggagcccaggagttccattgccttcagcttgtgctcgtgaatcacagtcacctgaattcctactgggcatctgccactttcctggtcttatgctctggctgatcgggtggcgtctcctcctactgctgacaacctctatgccattttgactctgatagcctcctaggtaggctggccatgtcaagggcatgcactaagatgttgtcttccttccatgacctacatgggactgcacccttcactttacaccagttgtgcaaactcagggctgatctggatttccaatgatataatttgagtgttagtagacagcatcctttgctgaagatgtacttcacactgccccttctcaagtctcccatgtaagtttctgggggaaaaaatggatccagagaaaggtagtcagtagcagttttccccctcacaccgaaattgcctcctgccctttgtctttgaattcaagccggtgttgcttcttactgtcagacctgagagttagttctttccctggatacatctcagctcctcctgcctgtttgccaacattccaggcttgcccagagactccaaatcccaggataacccagacctgactctgaactccggagtccactgtgctggtttcattctcctgttcttgctcacatatctgcccactgcattctcaactgctcactctggcactgcactttctgagagggctcagggaggtgtgggagctgcaggagcactcctgagtctcactgtactccactcaaccaggcattctgcttgctgagcacctgcaagtcccagaagggatgttctggacattgcttgggaatgcctccaaagcagtggggctactagcagggaacagtcctggtcatgaggaaagttaccaatgaggatatcagggctaacaataacttgactatgcaccagttcaaatctatgaccgcagctgctcttagggtttgcagttgccagctgccttaagcaagagcctgttgggtgatgacttacttcccaagcatcaccagatggggactgagggggcagaatttatgtgcagtacttccagtcggggtcagaagccactcaggagcagaagtagaacttggcctacaggcatgaacttaacagcagggccagggccaaggtgaggttcctggggcacaatattgaagggacactgctctcagcatcctgcaagggaacggtgggcacatagagtgagggatttgcttttctcaacctgtcttggccctgcaacctgtaaatccatcactggccagctgaggaggacagatggagagaatcgagacagggcagaaaggctcttcccagtgattttgcatggtttgactcttgcacgtttgatcatctgagagtcaggctgcagtggatgggcatcttcctctgccttttagttgaattgagcagaagctgcagatctgagtgagagaaaaccagatacaaggtgctttcaacatctgtgacctttagttaatgcaaataggactcaagtgaacgtaaaccagtaactattggaatctttgttacatgaaatgagcatattatcatagatgcttgtcataaagaagctcaaggcaacactaatacatttgtcttttcttttgtcacttctagatcgcagtaatatagttccggttcttcttggaccaaagcttaaccatgttgcagtggaattaggtatatttcaatatacatatattctgcatttataagtaggggacataatagagccttccaagcgtaaatatgattcattattgaatgacactggatacacatttcatatttactgaataacattacaaaactaagaaaagagtgccattttttgaatgttgccacttttaacctgacttaaaagtggcaacattttaaagttcaagagacagtggaactgcctgtggtctgtagactaaggtttttgttgtgctgtgtgtggcttgtctttaactctctctatggtcatttctaaatatgaaaatttaggccgggcatggtggctcacgcctgtaatcccagcactttgggaggccgaggcaggtgaatcacttgaggtcaggagtttgagaccaacctgaccagcacggtgaaaccccatctctactaaaaatacaaaaattagccaggcatggtggcatgcacctgtagtcccagctactcaggagactgaggcaggagaatctcttgaacccaggaggcaaggttgtaatgagctgaaatcacaccactgcactccagcctgggcaacggagcaagactctatctcaaaaataataataataataacaataataaatttaaaaattccgtgagagcactctggagagatgagtcaaactaattttgtggtgtgaatgtttgattaattgattcactttgaatcaattgactgaattgattgtatatttggagtttgtctagataagtcttatgaatcaacatgtccaattgagtaatttctttcaaaagagaaaggaaagaaagaaaggaagaaattcacatatgctacatatgctaagccaggtatcatgctaggtcattgaaatatattgttgaattaaatcctccaagcaacactgaggcatgtattctcattttatgaattaaataattgaagtgcaaaaaggctaagtaacttgtctaaagttaaatcactaaaaagtggcaagtctctgtttggggactttgcttccaaagtccccaccttataaccacagttggggtcacagtggtttatatgaccacatgggcccagtgcagctgggtcctatgccatttgtacatgaggtttacctgctttatatttttatttatttctgtctttgtctttcttatttttttcttctactcagtggggcttaacttgtatcttttgttctagtttgttgacctgaagagttagataattaattttaattatcctctggtagtatatacattcaaactccaagtttccctgtaaacactactttagctgtttctcatattttcattctattcagtttaaaccattacttaaaatttcccttatgatttctttttccaacaaaaaaaattggtatttcttaatttccaaatatttggtgaactttctagttcttgtctcttattcatgtccagtttagattcattatagtccaagattatacacagtgtcatttcaaccttttggaatttgtagtgacttacttaaggcccacagtatggtatatcttgctgaatgttccaagtgcatttgaaacaaaggtatattctataggtttttgttttattattctttaaatgtctatttggttaagttcattaatggtgttgttcaaaaaatttatatcctgactaatcttttatctgcttgttccatgtgttgctgaaagagatgtgaatatctccagctattatggtcaatgtgtctctatctcctttagttctgtcaatttttgtcttacatagtttggagctatcttatatgcatacacggatttatgctcgttgaattaacacttttatcattatgaaatatctctctttatctatcataacacttcctctctcaatgtgtagctctgtcatatgaaataatcacacaagttttcttttgcttggaattggcatatttgtctttttttaaacatccctttactactaacatttttttttgttctatacataagtgtctctcataaactgcatgtatttgggtcttttttgaaatatggtcagtatggtgtttagtccatctgtatatttaaaattactgttacagttgctatatcatatatgcatgatatacaaatattcaatttattctttttaaaataaattacactttgttgaaaatgaccatatttccatccacttgtttatcttttcctctattttctttcaaacagttacagtttttaatctgctaaattcagcatctgtaggtctgcttctattagctgtcttttctattgattatggtgcacattttctgtgtctttgtatgtctcttaactttttattgttgttgatctttatgtatcaaacaattaaagtgaatacagtttgtgttattttttcttacaagtaggtagcctgagagttgagtatctcagttgactcagaattgagttggggtggctgggatgtaggtatgttcactccaatctgtcttcatctctgatagctggtgagggagggggtgctgcagtcatgtgtttgatgcaggcctcttctctaatgagacttgctctcctgattaccatgagactgcaagtgatatcatacagcctttacatccttttacgctgtccgagcgcttagcagtaattctgcaagcctgtgcagctgccgagagcttcactggattttcttgtttctatgagactctttctgttaattacaaaccaaagcaaattctgccatggaatgaaatggccacctatcttagctcaccctagaaaggatccttcttaagtacgcttgtagttcaaaaatttctctttattttctctgtactttgatgtctttaatgtttgcttaatttaatttttttgtgatttatccatttggtttatctagaagtctcagtgagagtattgtcctgatgctacgaaaagaaagtacactgatcactctaagttttaatagttgattaaaaaataaatgtttaaaaagaagccaaatcatgttttgatgatgacttgtaattgctacctatttcttctgctttatatattttgttttatttaaagcaaggcatatttattctctttctgggatggagcaccacgttttgctttaggttaacatacattgattatattgttttgaaacttttaagaaacctgagtttcaaaaatcagaactttagttgccaacttttaccaggaaaaaacgtaaggctcaactgctctgctttgctgaatgaagaggatgtaatttattggatgttcggggaagaaaatggatcggatcctaatatacatgaagagaaagaaatgagaattatgtatgtatgtgtaatatatatgtcatgatatataccatataacaatcatatatattatatataacatcatattaaaaacactgggtggctgatgtgtattttgggctagtttaaattataattataatggacatattttataattatagtggccataccctaggtggacgcattatgcagaaatgtattgccaagatctaagctggaaaagaaggtccatgagaaggccattgagggtatttagcatcaccttataaagtagcacttggtcagtcaggatccgatggggatggggattttacttagcttcttagaaaagggcagttgcctaggccaagcttttttttattttgaaaaatttgttaagttgtttatttttctaatgggccaaaaaggctccaaatggcatgcatattgatagttaaataagcctatattcttccattaaggaatggtcaaacttataaaaagaatcagtctaaacatatagtcacctaagcttttctgaatgactttgggtcatactgtaagtattcattattatactgatacactactcagggtctagtgagtgctgagcctaagttgtctaccacctttgctgcacttgttgagttttttcttctgctttttacacattttttggtaccttctttgttaccatgcttgcagctctacattcttgctgacacttgtctacaagctctttacaccacaaagtctggcttcttgcccgggagcaggcatgtggttcatgcccactacatgttgaattcatttgaaatttgtggatctcctgccatcatatctcatcctcagccactggcctccatttgagttttgtatttctccctttggataatctctttctaatttttagaggggtagaaaaccacagtgaatttcttagaaatgcagcttaagctacaaaagcagagaggtctttctttatagttgggtgcacacacctttgatatcatctgttttgtcctctcaatggcctcctgtgttttacttctggatttcattggttttagatggttgttatttctggatgggtgacttaggaaaagaattacattccaaaatgtacttgaggcagttggaggctacagtggggctctgtgtcccgggtcctagatatccctgttgctaggaatgtgggcacatggggcccatgtctggctgtgttgactggtgtagctatcagagcctgtcattggtgggggaagtggatgtcataagtgtttacctggcatcaaccacaggacaacttgaatcctttaaggaagagaaaaagaacgtgctgccagtggctttctcaagtcattttctgacactcatggaacaacttaactggcacttctcatgtgcctcggggtgcttgagaacagtgttatgttttttaatgctgaacacattaaaccagtttgttggattccatggacaaatgtaatacgaatctgcatctatgctaaacaacttacagccttgtcataattagtgggaaccactctgtggaaagaaccccaagttgttaggaagagagaagtagagaaaaataattgagagagaatattttcttatattttcaacttagcatcatgatcttccagccatttaaacttcaggtaattgacagcaccattcccaaatggcctcaggagggctgtttctgtcagttctgatgctccacggaggaggggacgtttattgtagtccatgctttaagagtactggccagaaagggaagaaataatgcaggcaacatcacagctgccttcaagcattttaaacatgtgaattcccctctcaagggtaacgaacagagcctactgctaaattattttgccctcttacaggactccagaaggcaaatggcatgcttcaaaagtattgagaattgaaaatattggtgaaagcaatctaaatgttttatataattgcactgtggccagcacgggaggcacagacaccaaaagcttcatcttggtgagaaaaggtgagaaagatttatttttggaagttttgaaacttagctcattgctactgagagacatttcaaagatggccactttctcattttccacaccagaacccagctcctgagaggggaaatcagtcacctcatgtcacaggcattcagtggggcccctctgtctcatgatgccaagcagagaatgaaaacagaactcattcacctgctctcacagtcatattccatcccatgtggaaatcggggggcctgaggcttggagatacagatgctgagagtgaggctcatggggaggccatcaggacaacccctgcacccagcactgcacccagagcagccagaggggagtttgcagatctgcgtggggtgaggccagtgcaaacttggtgtgactgctgctccagcctgcctcagcagggtaccaggctcagggtccttgtgtgtgctcattcattcattgcctcctgaacttggcaagcaggccattgatagccctgatctgtgggctcttaaagtttttcagtgctcacctgatggagggccccagggtcgccatccctttcctccaccaaagtagcacagcccagggccttcagcccagtagctgctcagaaatggctgtgactggagccagaaagctgtgatttccagttgtcactactcattcactgttcattcccaggctccaccatcaactccctggatatgtagagaaaggtcaagatctgcaagagagagagaaagggagagagacagagactaacacacccagagacagatggagacggagagagacagacacagagagaggagaaagagagatacatgagatggagggacagagacaaacagacaactctagagagatgaagacagaaagagaaagagaaagagagacagagacacagagagacagagaaatgagagagacagggagagacacagagacagaggaacagagaaagagggagatagagaggcagagacatgaagggatgcaaatacagagagatgagagtgaaacagacagagagacagagtaagggagagatacacacagacacacacaaacatgcagagacagccacacacacagactgggccttggctttgtgagaaacggaaggagtgggacaggaagagcacaaaggctggaaaccccctccagctgggctatcctggtgcccaggggcagctcccccagcacacatgttttagagccgcctctctaccatatgcactcataacaacagctcacatcccatacatgttaattacatgacaggatctgggtgaagttcctgccatgatctcatccagtcttaacgacaagctttatagaggtgaagaaacttgcccagggtcacacggcaggtgaaggtattgaaactcagacccgattaaatctggaatctgtgttcttaccttctgcagggcttgtcgcctgtggtcttccacccctgtgtgattgcctgtgctgtggtccactcacttgtgagggagcggggctcaaatctttgttggaccatcacctggccaggctttcctggggcctgctcaccaccggatcacctctcctttcttagaacagggcaggactgtcctattcctgccctagacgcttctggccagtcaattctcctgctgctgctctcacaaatgtaggtttagaaattggggctcacaacccaccatcaccccgtgccaatgtgtgcgtgcgtgtttttgcaaatgtgtgacacagttatgactatgcagtcctttccaaggtacaggagccccagaccctgagtctgctcagagttcactattaaacaacattagctgcttgcctgaatcctaaagatagtagaaagatatggaaagataatttttaaaaattgcaccaagatggcaaaagttttaagcacgtttatgctcattgacctagagatgcccccaccattacaatctattttaagaaagaattagaaatatggataaatgtatatgcctttttgtatatgtatatacatatatgcatgtatatatacacatatttgcaaatgtatatgcatatacatacaaggttacacatttatataaatattatacatgtatacacttatacatataaaatgtactgcaactttatgtctacttactaaaaattgcaatcaatctaaatattaggatattatgaattataattttaatgacctactgaaatgctcataatataatattcagaaataatgagtgattaccatataatctcagttaactaaaaagtttaagagacaaaaagaaaacccagaaggaaatattctatcatgttaacacagccttcaccacattgtgatttgttgttaaaaattactttattctttttattcctctgtattatctcagattgtccataataaacataaacggaatcaatctagaaaatgtatttttttccaaatgatacttttatacaaagaatttgctaaaattccaagagctgtgtgctgtattaactactttttgtgtaatatttcatttaatcttccccaaaggagcagccttgtaagtgaagcagttagtatcttcattttacagatgaaggtaccaaggtttaagggcattcacgatttttcctacaatacaaaataattgatggagcccagctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggaatgtgtcagcacgtgggttggcaactactgcattagtgttagcagtaaaaatggacaagcacgtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataatgctggaatttcttaccttatgttctcattaagaaatcagataaataggcattaatcttcatcttattgtgatgatattgtagaattaatctgtgggagaggttttctatgggaaatattgttctgcctgtaccatccattatgaatgttgtctatgtcttcttttcttgtgcttacttatgtgttgcccaaaattgttctgattgtctcgtgtatgtatgtcatagcttcctaaatgccctgggagatgctcgggcccaggaactgtatatctgggtgtctttgtgcatgcatcacttaggtatctttatagtacatacactcaataaagttgctttaagttagattgaattgtcctatcgctcattatttcaacctggcaaaggaggcttacataatggacgtgtaagaacccccagctggccgggcgcggtggctcacgcctgtaatcccagcactttgagagtccgagacgggcagatcacgaggtcaggagatcgagaccatcctggctaacagagtgaaaccctgtctctactaaaaatacaaaaaattagccgggcgtggtggtaggcgcctgtagtcccagctactcgggaggctgaggcaggagaatggcgtgtgaactcgggaggcggagcttgcagtgagtcgggatcgcgccgctgcgctccagcctgggcgacaaagcaagactccgtctcaaaaaaaaaaaaaaaagagagagaaaaagaaccccgagctggaagccaaatgatctggaatcatgtctcctagacctgccagtttttatctgctactatgtcgacccgctggctctatgcctcagtttccttatacttaaaggtgaccagaagtcctcaagtttccagataattactaatttaaaggaagtcagtctaattcattgcacttgattttgttttgcatgtgtgtgtttgcaggaaaaaaaccttcacagagttcaaaacccaaaatgtctatgaaattatacttcagtagccccccttccagcctggtcctggatctatgattcccacccctcattgatagcacatctgaccaaatatcaatacagattcttattacacacctccttttaaaaagaacaaatcctggcttaatatgcgcactcttttcaactttgctctcttataccttagacacacttgcatgttactttataaagcagtccatcattttttagggccgcacagtattttatttgtgcagagctaccactgtttatttagtctccttttgatggacatttggcttgtttccaatcttttgttattataaaaatgctgcaatggacagctttatacattcatcgtttcatatgtatgcagtaggtctgaaagaaaaattctccaaaatggagtttctagaatacaagaaggagacacagccattattttgctagatactgtcaattcaccctccctactgccttcaaaagatgacagcaaattttttcccataaccttacccacaaccatttggagttgtgccaatctgataggtgaaaagttgtatttaagtgacattttaatttgcatttcccttactatgcaagagaaccagcaacttttcatttgcataaggctcagctgtatttcctttctcaacacacccattcatatcttttgcctattgttccatggggcaatggctttattttgcgtatttatttctaggagctatttatattttagggaggttagcttattatctataatatgaaatgcaaatattcccaggctgtaatttgtcttttgactttgcttgtagtggtgtgctatataaaagattttttgaaaaacatactcaaatgtatcttttatggtttctggatttgggatcataagcaaaacagccttcttaacctcaagttatacaaaaattatattagttcctctgagatttttataggtttagttttcacatttagaactttaaattgaacaacataaaattagcaaggttagtgaatttagctttgagcctgcatgtgcacgtgtgagtttgctatggggagagatgatgctgtaacaaacggggaaatctgtatttgatattttctgaatggtctctgtttgcataggccagtgtttgtcttcaaataaacattgactagctcctctctttctgactttctggagctaagatttcttttttccttctccagttgtgtttgacatgatttgcggtaattttttcaattcacacttcttaactgtcaatatggcagtgcagagacatttagagacatgctctaaatcacttccattaaattatggtccatgaacaaatgcagtccacgaaaaggacagaaatggagatataagtatgaagataaaaacttttatcacaatttaatactgctgcaatatctaagaaagtgttcagtattggtttctgaaggattggaaatgaaactaatcaataaacaacaacaaaaaaaggcaaatttaaattaaaacatggtcattcaccaagcatagtttgaggaacatttgtttaacttactccttgaagtcccaaatatccacttgaattataatttcctttataattttcctttatgtttgaatatagagaataaaaacattaccattagttttcaaattcctttttttgaatactttactctgtcaattctcaagtcccctaaaccttttaaaacctgaatttaaaatatattgtaataaaattagcatatttatattaaaagaattgcttaaaataaggaatttgaaagcaattaatagttgaaaagctaatttttcataggtaagagcaaagctatattgtatgtaatataaacccatatttgatgaaatcgtcttcccagtttgttgcaatccattacatcataagaaaattatgccctttaaaaaagtgtgctcatttaattgtcttacatgttgatgcctgttttgtcactgacacagtgacaaccctagtggaagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgcatgcaattctgcaaagcaattgctttaaatcaacaataggttctaacccaaattgctggacagaatgctgtaagtagaactgaagaagattttgccagaagcagaaagtgttgtttggtgaccatgagtgctatggaggatgccaggctgggctgttaagcataaatgatgtggcaccataagagacatagatctagaatggttttatcctattagattttaataggggttgcagttatatgtagcctcaaactcagtagcaaattcattaatcccaacaatatgccatgcataaatcttacccatctgccatcatctgccatcaaaacaattgtcatgggataaaggtagaccattccccactactttccttctttctctacagatcccaattagcatccattgcattttttaggacctgactcaaaatttcctcctttcagaaagcatgtccatcgggatcactctttattctctggccaggttattttgtctgtgagttttgttattctttttttgttatgctatttttcttctgctaatgtgttgtctgtaactttttccaagttgttgcatgcatctgctttgcttttaaaaatagattggatgaagctagaagagagagtggtatcatgttttaattacccaattaggagcatggtctttgttatttaggagacattttcaccttcttgggggtctttctgagcatagaaattgtgatggtggtagaattaaatgatatgagtaaaccagggtgagattttctttccactcctggaatgaggacacctttgggctcttggccttctaaggaacttaaagacttaagttcctttagtgcccagatctatggctcatatatctctgtattcttctgtggtgtcaagcagtgggatcttaaagtagatgcttaaaaacacattggctaattggttgcttggttagcatgggaggtttaaatataaacaactttatatataatttgttttttcaatgattctatactcattacttacgacattcacttaagtttgtacttaaataaaattttatttacacatgaattaaaagagccaatcttacctcctagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggaggaggtaagagggaatgccagatagaaaaatattcaagatagtttctttttaaaaaatgaatgagctagcccccagagagctatcccattttccttaaaaacaaatgaataaggtcctttaagcaagaaataaccacgtaagtcaacaatcgatagtgagaaaacaaactaatgagcttccaatagtctcttctcttgggctctgttctttgtgcttcacggttctctgaaactttggggaaagggagagggcatttccttttcagaaccgggcccagagctggcgttatcatgaagcctttatttagaaatgacccacggtgagaatatctgtaccacagcagcagttcctaatttaacatgtgatgtgtggactagttaatcctcactagtaactcttactagaaataaacacgggttaattattactagaaaatgcatgggtttttattgtgttgatattggtgacgaaatttaagtagaaaataggaaaattgaaaagggaaaaataacaggaaagcggtgatccccatcagatcatagctatgaaattcaatgttttttttattaatataggaatacaaatggccatagtgcctatattaaagcaaattactgttaaatttttctttttaatgagtaacatttttagattttctctgaagtctttagaacaaacatttaaaatctggtgtcaaattattctggatactgatgcttaaaaaaaaaaaacaaatgtttgattattaccatcattcatgtattaatctaatatttattggatactattcctgtgccaagttgtgaactgggcatcaaagatataacagtgagaaagaaatagttacattcccccccatattacaaagtagaaaggaaaatattgctaacttacactactgtttagtaataaacaacttgtcaaaaaaatatgccagattatcagatgcatacattgtagtatttttggatagcagttctttgcatctaagaaggcatattgttacttaggaagcatttattctgggccatacatcaattttactatatttccgttattttctaggggcctttcttgaaaacagatttattcttaattcataaataaaaataatgtttgaatattcagctgtaattaggtttggttaaacctctatttgagaacagtgagaggtctagaacaggggttggcagtttaccagccacgggttccatcacacctgcaacccttattgaaacacagccacgcacattggtttacctgtcgcctgcgtctgcatctgagctacaacaacagaactgagtagttgtgacaaagacagtgtgacctgcaaagcctaacatatttactatctggccctttgcagaaaaagtttgccaacccctggtctaaaataatggatggttttgttttgttgtgcctttttgtcttttaatctttaaattctgattttagcatgctcttttctgcttgaggagaagcaggatagtataatagttagaaaaatgtattccacttgggtttagattctgattctgccatttactagctgtgtgactctgggcaggttacttaaccactctgtgctccggcttccttgtttgttaaatggaggtgataacagtatcttctctgtagcgtattatgatgattaaatgagttaatatacaaaaaacatttaaaataaggtatggtaaataataagtgctaagtaggtgttcattattattgttacctagagattttttaataagcatataaaattaagaacaaatggtttgtcttaaagaaaaacttattagtgaggttaggagttaatataaaataagactgtgcaaaatgacttttatctcatgttccccctttcagttatcttaaattaataggggttatcttgcattttcagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacctgttcataacaaaggctgtgactcgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattcgaatgaggggattttaagtgtctgaagaggcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagttgcagccaacggttcttgaaagctcggtaaggccctgcaacgcagagcctgcttatgtggatctatttatgggaacttcttaaaaggaccccagaatagctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgtggcctctggaaccttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagagggcgaaagatatctctccattgtgcatctgcctcttttgacgttggaagacacatgtcttaccccccaaagggagcccagcactgggagccttcttgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataatttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccattagtctaatgcctttatttttgaaatatcatgacgtctttttcacttactttaagattccaattcctcgttcttaacatagactcctacctgttttaatagaatatgggccattcaaaatgaattcatgcacctctctctttttaaatgtcaaattgccttgcacctaccttcttgtttcacaccttccatccaggagcaaactaattctcttctgtttctcacaagccactcaatactaaacacagggacttatacatggtaagtcttcatatgtcagttaattaatgggcatattttaaaattctggtttaaacattccccaaccaggaccaacaaataacttttcaggtataaaacagctttcttttccatggttcagatgcccttaaactgtgaagtctattttagagaatcagcacaactacctttctagggcacgtgaagaaacacctcttacatgtctgtcatgtcctagaagcatttactcattagagctatatcttctcaaagcagtgagaagccttaggccccacgtattccaaacccaggaacttgaggcatggtaagtccagggacttggtcacagttgcacacgagcggtctgaccaggttggcacaggatggcgtacggcctcctcttggagatgagcatcttggaggctgcaggcacttttctggggccgacaatttaggctaagagggcctagggcaggggcctgcggaggggaagcgggctgtctaggactggctctgaggaggaaaagagagtgagagggatgctcaggattccttataagccattaaaaacaaataggcattcaagttcagtgcagggtgaaagagcacaattgatggagcacatccgcccactgtggcctctgctgagatacagagagttagaacctccggcatctgctaggagcccccggcctgtgttgaggcaaatgactcgccagttgggtttgctggggctctcagcgaggagcagaaaggagacagttgtccaaagagaggacattagcaaaatcagtgccccaaaccaagttgaatcatagctgtaaatactcagaggaattaacctgtcaccttggtctgaagttcagctgtgagggaggggacccagggttagcagaagccatctgagcagaagctgctctgagcagtgtgaccttaagcaatgcaaggatcttcaaagagtgaccaagccacagacctaacaggaaactcatgggcaggacacagggccctccagccccacctgcgtgccatgctgatagtgatcacagtccaggctgggagcttaagaccaacacccagatttctgtgtgagacttttgaaaatttttatctccttctggcatataactcgcgggtgcacagacacaccgggagaacaccatacctcatttacgtgattgctacaatttgatgtgtgtgtttaataattaatagtgaacatgttaactgactttcaaatagtggcttgggagtcttggggttcctcagaggtgactcagggaccatcctggatggtggaatggaaaattggagaacatgggagctgggctcctggatcttccctttcacctcactgctcccaccccctccacataccacaactagagccacactgcttttatccatattgtatgttgaggactcacataacattttatttaacagaacagaatacttccgaggaggtcatggtttagatacaatgaatataattctttctagccagtttaaacagaaatcattacagaattatttggagagatgaagaaacggactctaggctcctcttccagggatgtcttccaaagtcatatgaaaaacctaggctgccaaatagagctgttgatcttgccacaaccagaaagaaatctgtgcaaccaggaagctcttgctgcagctgccagctccagaaacagataggctgaagtctaagttgactgagagccatctaatatggaattgtt

SEQ ID NO: 647 - DNA, 200918 bp, Human
  misc_feature (1)...(200918): n = A,T,C or G
aaggacattaccagcatactcttcttctcttgatgcatttaaaaaaatgagtatgtgtagagtgtttccttgatccatgttgaactttaattttattgttatttattggaagctactcattcttatattaatctcagaaaggcattagctatgttttgctctggtcttgctttaattctaggcttatgcagtaggcaagttagatttctaagggatgatggaggaataaatggctctagcattctaccaatttggtatcctctttaggccaccaatgaacttggtaactaattgttgttttccaccagccttgcaatgcaacacagctttgcaattttatttttttgaggctactaaagcttcctgtatctgcaaaattaaactaaaagaaacaagaaccggagttgtatataaagagagaacagagaataccaagcttaactttgtccttgtagaagtattgattagtctggttaatgctgtactagacatcaaggaaaaacccgactttctttcttagatccctcatagcctcatagagaccagccctctacaaatcaagacttgaaaagttattcagcatattccctcatgtcaaaaactgtagctgggaaactaggtaggcgggaacagaatctgcctggtgttggagaggatgtattaatataaataataaacacaaaacatgaattgtagaaggttgcaaatagaggaaaacttcagacaccaaaaggatcaaaaaacataaaaagaaacagatacaatttttaaattgtaacttgttgtctagtgcaatgataaaagctatccacgaatacagcgattttagaaagttaaattttacatgcagtgctactaaaataccaaaggccatacataatgtctgacccaagctgccacctcatatagcaacttcttacatgggggctttaaaaagattgtttgactggtctactgtcctgcagtgtcaggagacggctttgtctgacatattgaatttccagtgtctctcacacttcctccttttcagatgcacaaaaggtttttgtaaagtttctcttggttttaccgctggcagctacagaaaccatgccacaagtctggtgtagagttatagggtgtgattttatttgactggtatcttcagagcttctggatttttcagtataaccgagaatttccttaagagctgtaaataaaaatcggtaccagttcgaaccctttactggcccggttttgtgtgaggttggctggctgctgtagcacgttctccccctcctcctcctcctgcaccccctcggttccctcctctgcctgcgggaataccacttcagggcgttcagcagccttcccagggtgggtcctggcctagtaccctaaaactataaccgagaatacctatcattgggcagcctaggaaacgcgactgggacttttagtaggggcccctcaccgctctgaagcactcacacttgagtcagggaacatgggtttgaatccccacccggccgtttatcttgtgctcttgggcacactgtgtcccctatataaaataagcacccatctcttcatctgtctcctaggcctgcgacgatgcaatgactgcacgcaaagcgcacattcacggtcaggtcacttctggcgtccggctgtggtccccgcagggtgcccgccggcggagcgcatcctccggcagggggcgagctccgcaccccgctttcctcatgggccggcgcggcccgccgttcaagtggggagcccagaggtgctccgcgccgtgggcggggggcggttggcgcgcacaaggccggactccggcggggcgcacctccacacgcaccctcgcgggcagcgggtcggagtcggggcctcgggccggctgggggcggggcatgggcgcggcgcgcggggcccggaacgccgagacaatgcggcgcgcggcggccaggaacggctcggcgggccggggcgcnnnnnnnnnnnnnnnnnnnnggaaccctcgccccttctcccggaggcgtcggggcccgcggctgggtggcgggtagttcccgccggctgtgcgcgcccgccctccgggctcgctctgagaggacgcggcggcagcggactcggagccctcggcgcgcaggcgggcggaccggccgagctgcgcggggctgcgcgccgcccctgctccgccgccaggccccgcgcggctcccgcgcccggcgctcccctttgtccgcgggccggagcggcggcggcagcggcggtgtccgagcggcggtcggagcctgctgcggcagttgaggcggcggcgcccctgcggctgtgcgccagcgccctcgcgccgaggcgatgccggaccagatctccgtgtcggaattcgtggccgagacccatgaggactacaaggcgcccacggcctccagcttcaccacccgcacggcgcagtgccggaacactgtggcggccatcgaggaggtgaggcggcctgcgcggcggctccggccgcaggtatcccgcgccccagccccgcccgccgctcccgcatccgcatcccgagaaaactttctttgctccgaagccggacgcggccgggccaaccctgcccgagacagaagccctttgttcccgcctaggtggctcggaggagatgggtgatggccaccttgggcctctttaagacctcccctctctcggcctcgtggccctcgcggggttccgcggcctggtcttttccccgcagcgcggccaactttgtccagagtcggggtccgcggcgagcgggggatcccgctgcccgccgccgcccgccgccgcccggggtctttggtacccggtgcggaccttatcaacttgttcttgaagtggaccggcgggggcagctccgcgctccgagctccccgccgcagcccccgagcgccgcagggcccccaccctcgggtccgcgggtccggggcatcccgggctgcccgggaaggcgtgcccgcctcagccagggcggcctggctgcgctccacccgtgcccggagaaggaactgcgggcaaggtgtgtgagagtcggcgcttctgggtccaagaagcctccaggagccgctccccggttacctgggtctcacctgcttgaacccggaatgccgcccttccccctcaacctggaaaaggcctggttttagtaaagtgctctcaaggtgcaaagtcatcacgcctagctgctaagcagtacgctctccaggtcctggggagaggaacacgtaggaacgaagaagcttggttgaaaattaaagccgtggggaaaggggcagagtctgtgagtccaggggccaccgttggctgtggtttgaggcacatcctcacctgcagtcctccttttccttacccatcaaacgggattagtaatgcatcctttccaggatcagagactgtgtgaagtgcttagcactctgctcggctcagaataggtttacaagtcacacgtgtggcaatagtgaatctgtgattaaatgtctctgggccaggatgtcaggttacagttttaaaattgggtattgcaggtgttttagcagaagacgcctgggctagcaggagtgtgtgtgtgggtgggggggtgggtgtcaccaaagagctttaaatgaagcaatggcgttattttttttttctggtttttttttttttttcccatttgaacaaagcatctgctattaggaattgcttgaaaaaaaatccagaatgttttcccttaatggaaaaattttttctttgtagctgtaaacagtcaataaaagggagtcaaaagtaacattcagcattctgaatcctgttaatataacttgggtagccttccttctctccatttaatttggcggaagagagctgcatgtaaacctttcctatgaattcggtgattccccagatcacttaattctacttttagcagcaaggcttacagatgatgccttcaaatgaggcagatggggatgggtgaatgaaattttttcctaagtgccagttaaaaagcacggtgttttgagaatacaccattaataatgtttatggaatgattgcaaccaaaaaggtagctgaatatttcttaagggaaggaagcattgtgcatgatgtctttctttagaaagcttgattatgtttaaagttctgttgcttttccccactgcagtttgtcagttaaatattattaacactggcagatgttggaaagccaagcaaacaagaattgctattaaaattggcatacctttctctgattaattttagtttacagtgtataattccaaagctctttttgtatgctgtgcaggagattaccctagagctcagttactgagcagattacaaagagactggatttggtcatttcattaaattgcaagcttgcttcatgctgccgtctaagcccaagaattggttcaagtctcaaaatggaaaaattaaaatcatttcaggtttatttcactttaagcaaatctacatacatgctatgatgatggtatgtgtgagcttggttttataactaaatttgaaagttgttcactttctgaggtaaatcaatgtggatttctttaaataatgctctttcccaggtgtctaatgttcgtgtctattaccaaaacttgttctatgtatggtttaataacaattgatgtgtacagtattttggttttaaacaaaaatcttctcatactgagacgaaacatgagagggtatcatgacataaagttactcatttaacaaataaataaaatttgcaagctcttggtcttatgtttaaacaaatgaatcacggaactagcaaactaattttatatttatttatttatttgttacggagtttcgctcttgttgcccaggctggagtgcaatggcacaatcttggctcactgcatcctctgcctcccaggttcaagcgattctcctgcctcagcctcccaagtagctgggattacaggcatgcgccaccatgcacagctaattttttgtatttagtagagatggggtttcaccatgttggtcaggctggtctcgaactcctgacctcaggtgatccacctgcctcagcctcccacagtgctgggattacaggcgtgagccaccacacccggccagcaaactaattttaaactgattaacctttttgaatctgttatttccaatgtaggttctatctgccaaagaatcattttacaattaaaatgtgctgttttgatttgcatacttgttgctggaatattattatagtaactgttgggcccttatcctgtactatgaaactcacaggtattgaattcagtccttatctctgctttataggcgaggaaattgaggctcagagaggttaagtaatttgccaaaggttatagagctctgaagtggactttgaacttggctcctgctgttttcagaaaccatgctgcttcctgttacttttcttaatgccgaattctctaaattactcctttgtcagattgacctgggttcaagttcaggctctacagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagctggcaagctgtagagcctgaacttgaacccaggtcaatctgacaaaggagtaatttagagaattcggcattaagaaaagtaacaggaagcagcatggtttctgaaaacagcaggagccaagttcaaagtccacttcagagctctataacctttggcaaattacttaacctctctgagcctcaatttcctcgcctataaagcagagataaggactgaattcaatacctgtgagtttcatagtacaggataagggcccaacagttactataataatattccagcaacaagtatgcaaatcaaaacagcacattttaattgtaaaatgattctttggcagatagaacctacattggaaataacagattcaaaaaggttaatcagtttaaaattagtttgctggccgggtgtggtggctcacgcctgtaatcccagcactgtgggaggccaaggcgggcagatcacttggggtcaggagttcgaaaccagcctgaccaacatggagaaaccctgtctctactaaaaatacaaaattagctgggtgtggtggcgcatgcctgtaatcccagctacttgggaggctgaggcaggagaatcacttgaacccaagaggtagaggttgcggtgagtcgagatcgtgccattgcactccagcctgggcaacaagagtgaaactgcgtctcaaaaaaaaaaaaaaaagtttgttgtcctggcagctggtgagagcatacctgtattttataatttttcacttgaccaccttctctggttcaagtcatcattttgtacaattttagcaaacttagcaaagtctggtgctgcaaccagagtctgccctgtgcttttggaaataatggaaaaaataagcagttgtggcagaaatttgaaaagtaagggttttttgttccttttttttcttctttttttttcgtttcttcgagcctctgggcactttgaaatattctcaaaatagggaaaaattgtatacatatttggaatattcatgtttttagttagaccctcctttatagcaccatccattctgccttacgtatttggcattgatgtagttttaaaaataaatttgatgttgacttgtaagtattaaaatttaatctacttccttccggggccataattctctactttgttgtccttggttaccttggcaatcccattgctgtcataagcacagggttctaactgcaggggtggggtgagcatctgggcctgcaggctcccaggggccctgccgtccatgggaccagacccctcctagcagcaacagtgggaaccagggctacgtgctttttggcaagaatgtgattctgaatgttagccctttgtgacttgtttgaaaaacagttcctccaagtccccagaacagattattgctgtcttcagaaggacatcaccttcttgcccagagcattcatgtttttggaagtgagccttgatgggtcaaacagggccaccttttaaactgtgttctgaaatttgaatttcagaaaattttgaatcacttaaggaagcagccattttctcttcatatgtgagccttcctccctgccccctggtgaatgctgaattcagtttctttcttaggctcaagagtagaagtactgatgccactcctcacgggttccaggtcctgccatgcactcaggattcctgagtccttcagtgtgctgggctgtgtgtgaggtggcaggaatagaacaccaagaagaatatgtcctctctttggagggacctacagtccagcaagaggaacagaatcctgtaaacaaatcagtgcagtaaaatctgaggaccacatctgtaggaatgcttggagtcctgtggatgtgcaagggtgcaggtggtcccagggcgtggggctgtggtgagggagggccttatatgatgtcgtaccgttgagtcttgaagtccaggcagttacctgtgggttaccaaatgctaaggcactaagctggttcattctggtcttctgtacctgcctccctgccttaggtaaatattgatctactcctgaggtggtggccaactcggcgtctgcggtaggattttcacagtcacctggtctctagagggctgctcagaccaagaatttggggtgatcctcaattcttcccatgcaccccacgtttccaggcaccggtgccttcctttgtggagcatatacatgcattccaggcccgcactgtctgatgaggcagcctaagacaaatccagctctcagccgccacattgcaagtactcagtagccacacgtggctggtggctaccatattggctcagcaaccaccgggagagccatcacctggaaacttgctgaaatgcagagccccgggttccacccaggacaatttttacagcatctccacgtacaccacaggcacgtgagagcttgcgaagcactgttcgagacggaaccccggctgcacactggagttgcttgggcgtttgtgaagcagagctgcctggctccactccctaaaattctgacttaaattagtctgggtggggcttcgagccttggcattttttaaagcctcctcccaaatagggttgataatcactgataaacagacagttacgtaacaaccttaggcagttgatacgtgctgtaaaggaaagtcatgcataacatggggatagaaagtggttctggagatcaggaaaccgaaatcaggaaaagcctctctgcagaggtgacatttgagcaggctggaatgcagagaggaagccagccacagaagatgtgggaatagaacagcttgggaaaaggccctgaaatgccaatgggcgggatcatggaaggactgaaggaaggtcagggtgtgtggggaggagtgggcgaggaagagaaggatgagagacgggcagaggggtgggcagtgccaggtcacagagggccttgtccatcttggggaaggaatttggattttgttctagtgtgatgggaagctgttgaagggttttgagcagggaataacatggtccgatatccattttaaagacttcactgtggttctagggaaaacagactagcagggcatgaaaggaaagagggagaccagttgtggggtgaggggctattgcagtcatctaggcaagaggtcttggatgaggaggtagcagggggggtggtggtaagtggcctgattgaggtccattgtacaagaagaggggtccaaacctactgatggattgtcattattgtgtgctagtggcatagaggtagacccaatagaactcctgccccaaacagggcaacagccaagctcagttcatccaagccccctgaacagaccttccagcatccccatggtgaagctgttgctgtctagagctacttagtgtcagaatccaggccagctctgtgctgcttgatgtgactggttataggacttgtgttgggaccagttccagggtcaatcaaggaaagattgaagcatagctgcatagactggggcccagggaaagagagaagcatggctgcatagactgagactgagggatctgctcatgcgaccctctgctgtttctatgcagactacagcaggtgatacttatgggcattgtcagatgcctgggatgctatccccatttcagctccccaaacactcctctttctttccctactaaagagaggtgacgttccgtgatatgaacctacctcctttgcttacgccttttctgtgtaatgtggcctccaagtggattgctagggcccttccaggtactttttttcttttctttttcttttttattttgtttgaggtggagtcttgctcggttacccaggctggagtgcagtggtgcgatctcggttcactgcaacctctgcctctcgagttcaagggggattctcctgcctcagcctcctgagcagctgggattacaggtgactgccaccatgcccggctgatttttgtattactagtagagatggggtttcaccatgttggccaggctggtcttgaactcctgacctcaggtgatccgcccacctcggcctcacaaagtgctgggattataggcgtgagccgctgcgcccggctgcctttccaggtgcttttataccattatcgtttttatcatgtcaacaatgtcttggaataaacagactaccaacccgagctggaatacttgggctgtatttttatgatgatggtcatttctatgaagggatttgactgatttagtttcttcactcataaatgtatattgggcccctaccgtatgttgtcactgccaggtgccagggatgtaaaagtggacaggatggcctggacgtctaaaaaaaaaaaaaaaaaaaaagtgaacaggactagctccttccttagaaagcacttaatagtctcatgttttatgtgcagttctgtttcatccttttaaccttgtttgtgccatggctccctttgacactctggcgaaggtgatctgcctcttcagaaaaatgttttaatgcagagaacaaaataagattccgaaggaaactaatcacagtcatgcattgcttaatgacgaacatgcatcgttaagatttcttcattgtgcgaacatcctagagtgcacttacacacacccagatggcatgcaggcacctaggctatatattaagagcctattgctcctaggctgcaaaccttacagcatgccactgtgttgaataccgtggtaactgcgacacagttacagtatttatgtgtggtatttgtgtatctaaacatagaaaagacagtaaaaatccctcttataatcttatgagaggtcgtctgtgtggttcattgttgactgaaatgtcactatgtggagcacgactgtatattgaaattcagttaggagaatattttaaaaatttttaccatgctcataatgcttctttactaaagcatttaataacaagatttactggtgggtctaacaaataccttaattttgaggtatttgatgaatataaacaatacgagatatttctaataaagataatgtaatgttcatatcttttattgcaagtattgataatattaccatgtgttgcttacatttgtaattgaaagatacgataaatttcagttagaccctaatgaaaatacagataattttttttttccaatccaagtttatggaccccctggattcagacagagaattccaggcttgatggtaagatttgtttagctagttttttttttttttttggagtgatggattctttaaccactctgtttgttaaatataattattatatttcataattattatactgtccttgccatgaattggttctaagagtctagctgagaagagttgcaccctaggccagtgttagaattatgaggcgctaaaggtgtttagaagcgctcttggcggggagccatccactgtggttttacatccgtggggtgccctctgttctttcagggttatggcttggcagcttctcatctgatcccacaggtcagttcatatacttgtgcatgcctcaagagttcagcagagctgcaaattggaccttctgagtcctgtaattaggattctgagctgggtaggtcctacaacccagctctcctatttgtgcctttcttgtttgtgtcacacggcatgtactgcctttgactctgcagggcaagttccattgtgaagcaccagaagattcatgggcaccacctacccagaattttaagggagactttgcagtgtgtgttattttcagtgagggtatggatttgaaatgctgctgctgttgcaagagtgtgttggggatatccagagtgtgggtgaagtcaatgtcagttcatattttttttttttttttttttctgagacagggtctggctctgttgcccaggcttgagtgcagtggtgtgatcttggctcaccacagccttgacctcctgggctcaagcgatcctcctgcctcagcctcctgtgtagctgggactacaggtgtgccccaccatgcctgtttaattttttttttttttttttttttttttgagacggtgtctcactctgtcacccaggctggactgcagtggtgccatctcagctcactgcaatctctgcctcccaggttcaagtgattcttgtgcctcagcctcctgagtagctgggattacaggtgccaaccaccacacccagctaatttttgtatttttagtagagacggggttttgccatgttgggcaggctggtctcgaactcctgacctcaagtgatccacccaccttggcctcccaaagtgctgggattgcaagtgtgagccaccatgcccggtccctgattaatttttgtatttttttgtagagaaggtttcaccatgtcatggctggtcttgaactcctggactcaagtgatcctcctgccttgccctcccaaagtgctggtattataggcgtgaaccaccgtgcccagcctcccccttgtcttttctaacatttatggggcacttattatgtgccagatatgctttaaattctttacatatatcaattattaactcatttagttattatcaaaatgctataggggccagcaaaattaggccacggtaccaagttcatggagcttggaggtgatgaagccaggattcattcaaatcaagcattttgacaccagagtctgctatttcttttagcagccaacagcctctgtagagcccgtgcccaccaaggcccttggtgttgcagcctctgtggccagcatgccctcccttgctgttagtgttagaaagttgcagctattgcattgctcgagtgggtgcttctggcaaatccttgttgcttctcgtttcctgtttgcctcatctgtcctccttgctgcagaaattgttcttctttcctctcctcactgctctgctgacatgcccagccccacggagcagagtggccaggggcattgctcacaccctggcaggaggccttccctgctaacagtgttaataacgatgtcatttttccactccatgctgaagatggctttgtcaataaaatcaggcagttgatgaagacagttccctctcatgatgaattcacttgtcttttaggattctagccaggcagtcaggattgtcgggacctctttccccagcttctcagaagaaatcatgttcttcttagaggtatgtttttgttttttgtttttttttttgagacggagtcttcgctctgccacccaggctggagtgcggtggcacaatctcggctcactgcaagctccgcctcctgggttcacgccattcttctgtctccgcctcccgagtagctgggactacaggcgcctgccaccacgcccggctaatttttggtatttttagtagagacggggtttcactgtgttagccaggatggtcttgatctcctgacctcgtgaggcacccacctcggcttcccaaagtgctgggattacaggtgtgagccaccacgcctggcttttttttttttttacatgaaaaaataatgatgacaatgctttaatttcatttctctgagctttaattctgtattaaggactgtgctgtgttttaaattgatgatttgatcccctcaacagtcctgaggttagtcctatagtgacatgcctccaggttccacatcccacaaccagcatttgatagagtaagaatcccagtgctgtggaggaggtcctactcttcttgatcttttaatgccccacctgtcagtctcctgctgggctctctgttgcctgggaagatttctctgtaggtgttcctgtgagtttccttagtgcaggttaatgatggttgttgatcacctgcagtccccattgtcactgaatgtgattgcctggaggtcatcagacactaactcctggggaggcacttaacatcagaagtgtttattaacttgaccttgaccaattggcctccttagagctgaggggccaagaacactgtcactgtgtgacaaggactaggagccacccagacccatagagtattcccttcgtttcagcaaatctgtattttgaggctgccactgaagggtgaatcatggatgtggcgtgtctaggcagacttgggtggagaggagtcagctccctgttaacagaggactttggagaggttttgaaaggaagggagaatgttgaggccttgtactgtattcccctgatagcctgaatctgttgtcagctcttggaccttggagcaggtgacttcactggtcctgcctcagttgcgtcatttgtaacatggagggttggatgcgatgagtccagtctttccagctcttgaccttccatgtctgctgctgtctgcaacacttcccctgcctcttgccacccttgctttttttggctgtcgtctctgtttttttctttatcttgactatttatatttatacttttcaagaagttagagctaagagtgaacgttacctctttcatccccttctttaaagattccctccttggagatatcactggagttgatgtggtggttggtacttgagctggaatcccaatgggtgccttgctggtttgagattgggccgaatgaggccgtgttgtttgccatctgtcttgcctcagagcagtattttttgcagtctttgctgctttcgttggtctcttaattaaaactttgttgtgctttgcttctctggtgaaaagcaggttgtgttagtgatgatcatggggttttgtggtcattgagtaatgtggactgttgaacttcaagaaaatactgattttcttatatccagcgagcttcctagattttgtggggaaccagtgttctcatcattggaagatgtgctctctagtgtgaagcagtgattttcacatttgccctgtgattcggttgtgtttatgttgtggagcagaaagacctagccagggagttaggagagcgggattggagttgtaaggtcaaccttattgtgaccttgagccagttaactgtgtatctggtctgtaacatgagagatttggactagatgttctctgaccatcctccctgacctaaaaattccatagttctttgtattcatatatactggatgtgaaaagtccctggaataaattacaggaacaaaaatcagccaggaatggctagttgatagtcctgaaaagacaacatcattgctgaatcatatcttcaagttgaattatttatttttgaaaaaacctttctatagcatcctgagaaacttatttcttattgttgttgcttttttaaaaaaaaattgagatagaattcacataccatagaattcacttaccataaaattcaccattttaaagtgtccaactaagaggtttttagtgtactcacaaagttgtgtagccatcaccactatttaattccagatcattttcatcaccaaaaagaaaccccatacccattaggagtcattccctagtcacctgtacccgagtccttggcagtcactcatctactttctgtctctatggatttgcctattctggttgtttcatatatggaatcaaacaatatgtggccttttgtgtctggcttcctttatgtagcctaatgtttttaagattcatccaaatcataacatggatttgtactttatttctttttatggctgaataatattctatcaaatgtgtatgatacattttgtttattcattcatcagttgatggacatttgggttgcctccacttttaggctattatgaataatcctgtgaatattcttgtataaatttttgtgtagacatatgttttcacttctcttgggtatatacctaggagtggaattgctaagtcactttaactttttaaacttaaactttttaaagtcagtttaactttttgaggagctgccaaactgtttgccaaagaggctgcaccacttgacattcttaccagccatgtgtaagggttctgatttctccacatccttgacaacacttgttatgtttgtcttttttattacacccatcttagtgggtgtgaagtggtgggtttgatttgtgtttctctgatggatgactaatgattttgagtgttgttttatatgcccatggctgtgtgtatcttctttggagaactatctattcaaatcctttgccatgtttatattggattatttgtctttttattgttgagttgtaatctgaacattagacccagatcagatatataatttgcaagtaataatttccattttgtagattgttttttcactcatttgatggtgtccttcaaaggacaaattttttaattttgatgacatccagaatagtcatttttcctttggttgcataatacagtcacaaagatttacacctatattctgttttatagtttcagttcttacatttaggtctttgatccattttgagttaatatttgtatatgatgtgaggtaggggtccaacttcattcttttgcatatggatatatctagttgtcctggcaccatttcttgggaagacttttcttcttgaattctcttggcatcctttttaaaagttgatttacttctgatatatgagtttatttctggaccctcagttctgttccattgatctttatgcctatcctttatgctagtaccataaagccttaattaactgtaggccttatggtatgtttggaaatcaggaagtgtgagtctttcaactttgtttttttttcccaagattgttttggctattgaggctcccttgcatttccatatgaattttaggatcaacttttcaattcctgcaaaaaagccagctgagattttcattgaggttatgttgacactgtagttcaatttggggagtatagacatcttaacaatctatcataacctcttctatctatgaacttggaagtttttttcattttcttttcttttcttttttttttttttttgagacggaattttcctctgttgcccaggctggagtgcaatggtgcaatcttggctcactgcaacattggcctcccaaagtgctgggattgcaggcatgagccactgcacctggcctcattttcttgtctttaatttctttcagtaatgttttgtagttttcaatgtacaaatcttacacttcttctgttaaatttattcctaagtactttattctttttgatgtgagtggaattgttttcttaatttcatttctggattattcattgctagtgtatagaaatatggttactttttgtatattgatcttatggcctacaatttgctgaatttgtttattggcttttatagttttgtgtatttgtatgtgtattccttaggatttttaatatgcaaaatatcatctgcaaatagagacagttttgtttattctttaataagctgagcaccttttatttcttttttttgtttttttgagacggagtctcgctctgtcgcccaggctggagtgcatggcgccatctcggctcactgcaagctctgcctcccaggttcacgccattctcctgcctcagcctcccgagtagctgggactacaggtgcccgccaccacgcctggctaatttttttttttttgtatttttagcagagatggggtttcaccatggtcttgatctcctgatctcgtgatctgcccgcctcggcctcccaaagtgctgggattagaggcgtgagccaccgcgctggcctattgctttttcttatctgattgctggatcagttcttaatcatctttaaattcccaatgatttgcacagaataggtgctcagtaactttattgatgaacttcggtattaaaaatcagtttttatgtaagctgcagtttcttgtatttaatttgttttattctttatttggcctctgggcatgttgagaaaataggaagatttgcttgcttggtctttagttgcaaaggaagttagtggaaatgtttttgcatttgtaaatgggttttagatatttgccttgtctggccacggtgcttggtagtcactcaggaggcttagagccaggcctcgtgtgttctctgcaaccgcaaaccctttccaagctgctgtttctgctggtgagtgtggctggtgttttggttgctttctatcaacattgccttgatttggtccccacaggagactgctcacttcttgacaaaaggtaattattgagattcctggttttcttctcaccttgtaaattctcttgtttttgttttttggcaaataggaatgaggtgtgtttactactggagcatcgggctgtcagaacccgtagctttggtttgccttggtcgcagcctgccaggttgcatacttttgatttggaagaggtgccggtgggtgtgttcgctagcaggaatcacccacagtaaaaatcatgggtaggagaaatggccgttcaccttttcccatcttccttccttccattgtctacactcctggtcccaccttttccttggggactgggatgcttatgctggaacctaatcagtgtccaaagcttaaaattctcctctcctcctcacttttttcctctttgttttctcttgactttcattgccttggtctatttccagaccctccaaggcctgtgttttctctttaaaagatcctgttccatccagaggagactcaagagtcccactttaatttgggattttaggcagaggccttcctgcatctctcaagtcacacttgcaagcgactgctttggtgatgacatttaaagttggcctcctttcctaccactctgactcccctcaattttctagaactgggtttattgttctatattttaaaattgatttattatcttctatagcaatgttggaaggagcttaattttggaagtgcacagttctctttatggtcaaagcgaagtaaaggagatttgattgatcttatgacaaaattgctttagtcatagctgataggaaatctcttaagggccctgttttatttgctcttttaatttatgaaccttcttggatccttcaagcatctgtatactaagccagtaaggccttatctggaacatgcaggcttcatttttgcccctaatatgccatgaaatgctatagggttctgatgctttgttagattttggtgtaaattagggagtaacagtgtcagcaaatgtgtatttcagaaatttgttaatttttttttccaaaggaaaatgtactattagctggaataacctggcagccatagggcgtacattagacctggaagtaaacaaaatgacccccaatgaagtagaaagtaagctactataaattatagcccattttgtttccctgtaggtcagggccatgtcatcctcaggcttccagaaaagaccatgttgtgaaataggaacaacagagacccagtgccctacagctaaggccaatgggagggaggggaagagaggagttagaccagcttagaagggtgggggcccccttctactctggaatccttgcaggtctcactaagccacagcagagcatgtttattgatgttaggttggtcattaagaatagtcaaaatcagcgtcctctgatttggtgcgctgggatgcacgtaatccactgaggatagtatccatgaaaatagtttttgaactttgctttataaattttgatgagcttgagttcactgagaaaattaatttctgtagaacaattccttcatttaatgttggcccaaatgaagcatttagtatggaatttgggccttggtggaattttctgggacacgtagcctaatgtgaggacaaccattgctgagcagtgcgagggaagggaggattgcctagtgagtgactggtgccgagcaagaggcttcctgcttgacctctgaatactctggcgcttcctttttggggtcaggaagcttccaaatccagagatccccctgtttgcagttcttagttttcctctgaaacccccacaccagactgagtgtgcctagggttgggactaggtattacttctctttgaatcccaacatgatgcctagcatacataattctcagaaaatgtttgttgattgtcaaggtccagctaatcttgttgatttgtgatttcatacctttttctttcaaaggattgctgtatgcctggaaataaatccattttggtttgcaaaatcaaggttgtcgtgtcatcctttgaaacaattagagaagcaggaaaatcttctaaggatgatcgaaatctccactctataaaccatcccaattaatatctgatttcttctttgaaaaacataatcatatcctttcttctgtagaaccttccctaacactcctcatttatcagaacaaatttctgaattcttgaagcaattagtttttgactcactttatgtgtccttttttatccatccatctgtccatttatctgtctctgtccatccattgatccatctttgggacagacctgggatgtctgtgctcagaagcagagtgctctacatctgggaagcacagtggtcgtgcccacagctgtcaggctccttgcatgctgggctgtggtcctggcttctcttgtcttctgtagagtgggagtctcaccaaaggagggcatgggagggctagcttgagtcaaggtgcgtaagttggaacattgcagatggggttcagggtacccagggttgtccctgtttggtcagggcagggtcagcaaagctccagcctgtttttgtatgcaaaaagtgtaagctaaaaatggtgtttatggtttttaggggttgtaaacaaaatcccagaagaagatgcaacagagaccgtgtatatgcaacctgcaaagtctaaaatatttatcatctgctcctttatagaaaaagttgtcccaagcctggttagagctctgagtgagtgtgggtagatctgtctcacagatctactctgtcccagagtctgtctcagctaggccagaatactgagttgtgaggaaccttaaagacacttgtctagtggtctgtaggacgcatggccctgtttagacattctgcttggtatggtgacccagggacctgctgctggtagaagcagccttttcttccccaggaaatgtatactaaatgaaagcaagtactttcaccttttcctctgtggtcccgattttacctctgaggtcatgagtaagtccaggtgacaggtgggtcagagctggattatggagggctgagcatgtcagttggaaattgattcagaaggttgtggggaaatattaagggcttttgcgtaggggagtgacatgagcatagctgggcttaggaagtctggcctggcatggtttgggatcctgggggagatggagcaggctggaaaggttaggggcagggagaccaataggaagcattggccactgccgtgggaagtggttgtaggggtctggattagggcatagggaatacaaaggaagggacgtattccagggaagttaagtggcaactcctcatcttctagtttgtgctgtcaccagggttggttggtgtgtggctggcacactcaggccggccttcccccttcccttcctcctttcatagagcaactgctccataccaggccgtgggttctgcggagttcctgcctggaaggcgcccatgagctggaggaaaggagaaacaatggttctgccagggaggagatgacattggataagctccttgaaggcggaggttgtgtcctgtgtgctgcctcatgcgagctagtctcaccctggggcacgtaagaggggctcagaaggtcagttgtttgaagtcccacagctggctggccacgtagacgataatgctgtacaccagaaatcaacattataataaaactcttaaaaatccaatcttatctctacttttaaggaacctaccatttacaaataaaagatcacccacttatttattcattcagtgtctgttttctgtaaagcacactgtatggctgtgtacccttatgcacagtaattgccaaaatgcctattgcagggagcggggtcacctccctgaggccatgcagaactcggcatgggtctactttccgcccctcttgagcttttatttccccaaatacctttgcctcatttcttgatctgaggatgttccataatgacttcaagggcaccttccagcttggggattctgtaattttaaagtccagcttgctgaagggctttgtggtaaagggggagttgggaggaagcctcactgaggttgtcctgctctggatgctggcctctgcacaaaggtcctttcaggctgccgtggggaggactgtcctatgtcacttcttcttccctcttaagccctggaggggaggacttgggaaacaggtcacagggagcctggaaaaacaaagaacacgccgtccgtccactcaaaacattggcaatctagcaaacggtgtgctcttccctggcctaacatcatcggtgtgtgatctctctcccagcactcacccagggaccagaaaggcgggaggtctggagagagattgcaggtggcttccttggtcagtcaggaggcattcccttctcctgcatgctggaggggtgcaccatgggcctgggataggctgttgtcagtggagcagaggtgtcgcccagccagaagggtaagggagctcagatccagtccaggtgttcgggtcctgctccctggcgagaaggaagtatgtgtgagagagtatttcagatcctcctctcctgtggctctggaatcctgctcatctgccatccggcgtctccagccctgctgtgcttgagaagtcttcatttctcactagcagcctccattatctccacttcctccattatccccacttcctacattttcagggcacttggcctctgctgtaccctcagcccccaatcctaagggcatgtgctctgtgaagagggggacttggggttgtgcgcccctgtgccctgcagtgcctgatgcatgagtgttgtgctgaccctccctcagtgtcgttcagcagtgagcctcctctaaagcaagttcaccatttacacggtggacttgtttcctgtgtttgtgttcttatttcctaaaaccgaactgcaaactcctgagggcaggatctcttttttctttttttaaaataagctctcatttgtatttatacttggctattttcaaacgctattcgggtgggacagggctcatgcacattttacagctgagaaacagcatcacagaggtttaacggctctgtaaaataagataattggtaagtagtagccctgagactttaaccaggatcttacagctcttgttcaatgaatgatctttctgtaacccagaaccagctgagtatttgggaggtcctcagtaaccgttttattgagttaaaaaaatatgtgggtaaggtatttgtgagtacacgtgcatatacaaagattctatgtgcttagaaacttctttgaccagcctcttcatttgaaaagggatttcaaggttcatatatgcattgtttgttgcatgttactttctttggaaatgactagtgaggacagataacttagaaatatttgcatgttacatcagaagagagttaatagtactggttactgttaatactagtggtattagctgttccagcaaaaggtactgcttatttataataaccagataatagcagcgagatcggagaggatagtctagataacattatgagtgtatctataattataattgaaatggaatgggggtgaatcttttaatatgaggttttaagaattctggaattttagtgtgagacataattcatggtgtatggttgatagggacatactctttggccatataaccttgaagaagtaataatcttgaattatttatcattggaatgaatcatccttttgagagaatcatatcttccttcagtgttaaaaatatacttatgtcatctgtcatggtgagtattccagttacaatgcatatttctttttttcacatcctgcctactcacttggtgttatccttgagaagagaaagatttgagatgatggctaagtggttcccagtctttgagtctataatcacattccctgttttttcgcattccttttggttgctatgttttggtatttggtctttggtctctttctttggggaagagtgattgggtggccacaggaggagtaaacccatttgggagctgatagttgatgtatttttgttatgcttggcagagtgagcggcccccatcttcctgagcagagttcatgtgtgatatacaaatgaatggtctctttccatctggccgtcacagaggcaagaaactgtggtgcctctggatcattgaatttctcagactctcaagggacagcagaatgcgtatgtgaactggcatacccaaatgcaaattatttctggtgatacctaatatatgtaaatgtatgctgctcagttggccaagaaattatgaacggcactcttcctaaataatgctatataactgaaattttagttttattgtcacaatagtgaagtgtgttgatagtcctatttcctgtcaaatttctgtgacatttccagcagcttcaagcacccctcacgggccaactccccagaggtggaagatccggtatctcaggagggagtgctgccgggctccattccgaaagccacacctgccttgttaccacgtagggatctggcagttgaaggctaggggcggaaagtggacaatcaggatagagacaggactcggcagagaagcggagttttagtacagatgtactaaacatctgtacagatgtggagccccccccgcatcatcacacttaacttcaggaacaaagaaacccaacagatttaaagatagtagggcatacctgcagggctggtggcggggcaggtggccggtgctgcttccatggtggacttcgcagttgccctggggatgctgacccctggactggactttgctcagtggtgcccgccacagtgagcctcagccccacctctgttgtcttcaccctttgacctcacttgagcctggactgagggatttcccctgtcgatgaaccaacctgagtactgtgcatccagcctctcactgagctgggaaccaggggcagctacaaaggagacaggagaaatagccgtcccccttgggcactgctggcctggcaggagaggcccagcatgtgtctagggaggagcggagcggttgtggccagcattgagctggctgcttttctgtaggagcctgaatctcagtcgagcctggaaggacatgcaggtgttagggagccaggattgcctgcgttaggcacggggctgggcacacagagcactggagggaattggttgagtaagtgatggagtagttgatagcaaagggagactggagagagcattctgcagggggacaaagtgcctgagcctaagagggggagacaggctgtctggagaacatgaagcaagtgcctggccctggaggtgtgtgcccctcctgtcccctgtaaattgtgggtgggccaggctgttgggggcatttgtgggcctggagtgatgctgatttctgcagccctggcggttgtcagtgtgggctggggtagagatgtgtgtttgtgtatggagcaaggaaggtcctagccttgctcaagaggtaaagaagctgctggttgagaacagcttcatgaattctgcaagaagagatgatgatgtttgcttcttttacatactgcattaaaggtcccagacactggggcatttgctgatgtcagtaaagagggagtcctggatttctaggcactcacagtttcagaataaacacatatgtaaacagctgattaccatatggtgtgataaatgtgtcaggatacagaggcagttgctattggcaacaccaaatcagtcataaccttcaggagtgaacagggcttgtttgctcagggtctggccagggacccagaggaccagtgttggggacccagaggggctgcgtgggcctgctgccactgcgagcctgtgttacaagactgagcagtgcagccgtgactctggcaggcgagtttcccaagccgaggtttctggaagccacagcctgagcccagggcctggaacctgcaggcaaaaactgtgctgagactgattccccagtggtcagccccacagctggactgcaagctgctttccctgggcagactcagcctcctgcaggaggggtgtgggagggaaggagcagtatctgtgtgcagacctgggttcccccagaactgagatgctggatgaggtgcctgcatcccctgagctgcttggcgaggaggacggtccatgttttccatcacagctgggagtaagagcagatatgtgcaaggcaaggacgttgtttcaccttttgaaggaaggttgttaggaaaacgcctgcattttctaatcactggagaagcccttttaagcagaccagatttataagggttttgatgaaaacagtggtttgggagcagcaatgtctttaatagcaacaaagcccagagatggggtctgcctgcacaggagcatgggccagggggtcctgtgtgacctgggaggtgtgtgagggaggccctgggctggttccatggcagggcacagtccagcttcttgcttcctggcagcacaaacccctgcctgtttctggcggggagatgctgcccaggctcggctgctttgcggttctatgtcggtcactttccccaggccacttccttcctttttcttcttatgccagcctgggcaagaggaatttgtgcttcctgccagcaggatggatgggggaaaggcagtggctgggtgtttctctctgctggaagggtttgctggggtgaatcctttcccttcactccctcctgtagccaggaccttgtcacctccagggagcaggtgacagtttccttgactcctcaccaggttttcaggctctgccctcttcctctccccagccaagcttgcctctgacctcagccaggaggaacttgctctagggcttaagtcaggtcacatctaactttaagacccagttttagcatctggtatggaggcaacagcctgggctttgacagacttgggtttgcgtcatgactcggtacctgctacccgttcgctgagatgccagtgagcagtcgctggtcatgttacatagctgccacctcccggaggccagctctgttgtgtgtgcatgcccattgagatgcccgggtgccgccacacccctagcctgcgcctgcctgttcttcctcctgtcagagggccctgttcttgctcatagactcctgcacagcagcgggcctgtctgtctgcctggcccttgggtgtccctggcatctgcatgctgtgttcccatggtccttctgctagttggagcccttgtgccatgccttcctttggagactctcctctctgtgccgtctcgcatgccatccttgaggttttagctctgtcacctggcagcctggcccttccctgcagcaggtgaggactgagagctgggctgtgcccctcccacccacttgacccagcggacactttgggaagtggcaaccataagtctgcctggcttgctccagttgcccatcttgtcctgtgagtgaagctcctgcttccatctctcttgatctggccccttctctccattcctccagctgcagtgggtgcccctgtcatttgtcagccagagcattcaacagcctctgctcccactgaggtcatggtgattgtcttaaagatttgctctttagcttctcagctgaagacacgttggtggcttccctgaccttttggaaagtaaccagactctgggtccttctcctttgttgacctggcccctgcctccctcccaccccatctcatccatgcctgtcctctgtgtcaacacgcctcactgccctgcgcccgatccttttacacaggtggtccctctgtttgtagagtcgccctgctcttcgtatctccctgcctgttctgtgaagttcagcccagtgccccttccttggaggccacattagagggccctcctctgctggctttgtgcccccgtacccctttcgcagctgactgtccacattatactgtctgtatctgttatttactgtctgtctttgacaaactatgatcttggaagtgcagagaacttgtctgatttgtttaaccacctcacttagcacataacttgtcatatttttaatttattttctatctccccttctccccattagatcataagcttcctgggggcagggatttttgactcttacttagtgatgcatcctcagcacccagaattgcactggacacatcatatatgtttaatatgtgtttgttgaatgaataaaactgacaggcaactacagcttagattgcagggagtgagacatgctgttgccggagctctggtgtcattggttcatagaaagcttgtttctctggccatggggacttgattcttagagggtaatggttcgaaagttgaattagtgagtgtaaatccttaaaaaagtaaaaatatgtttgtgcccttgtacagaggggctgccttgcccttctggaagaaggaattccacgttagacgtgttcccagctgcagttttgttctgtatctattgccagcaggaatccaaggatttcctttattatttccaaattgctgcctcttaggaatggagaatgctgccagtctgtgctctgtgttttttttgctcagtgggaccaaagtagttttgtggtagagagatacagagatacggctttgagacagtttgagtcatctaattactgtccaggagggctgggaggttaaccctggtggttgctttggtgatagtgatcgatgtctgtgtgacaattataatgaaggctggtattatgccgggactttgaagagtctatcagatagtgaaggaattgcgaagccgtactatgttgaggtctccagaataaacatcctcagaatggaaggtccagatgagaaggttaccttgatgagaggcctttatgctttttgtgctattttcctttatgggctctggtagttctttagtgttttataatctcttttcagagaaagctttttgtaaattcttcagattttactttttaagtaacacttacaaaagttgtatggtggcttgggaccaatacactttgcaggaaatgcagagatggataagaaatggttcattcccttcaggacctctcgttatagcttagcctatgtagtgattagagcatctgctttgaagccagctggacctggactcagatataggttttgctaattgatacctgtgtggccatgggcaaatatgctcatttactcatttgtgtttaacaaacacttatattgcacttactgtgtgccaggcagtaagtgcttaacacatgttaaatggatttaatccttacaacaaccctgtggctaggtactgtcatcatccccatgtttaaagaagaggggagtgggctgggcatggtggctcacgcctgtaatcccagcactttgggaggctggggtgggtggatcacctgaggtcaggagtttgagaccagcttggccaacacggtgaaaccccatctttactaaaaatataaaaattagctggtcgtggtgacaggcacctgtaatcccagctactcgggaggctgaggcatgagaattgcttgaacccgggaggcggaggttgcagtgagtcaagatcgcaccactgcactccagcctgggtgacagagcgaagctatgtctcaaaaaaaaaaaaaaaaaaaaaggaagaggggagtggttcacagaggtgaagcaatgttccctgggtcactgagcagagaagtcacaaagcctgggcactctggctcgagttcatttttcttcttgacgctatttgtgctgcctctcagcttcctaagcttgagcttcctaaactgtaaaatgggaggcagcaataaccagactgcctagagacaggctggtgtgagaattcagtgagaaaacccggggagaacatttagccagagcctgtcgcatggctggggctctggctagtggagggagaggagacagcacacagattgcaccagaacaaggtaatggcggcgcgtggccttgcaggggccttgataataggaggagctcagaagcagggagagatcacttcctgctggggcagctgggacattgtcatgaaagaccagggaggggacagatgggacatctgggacttcacagccacctggggaagtgggcactatccccattgtgtggatccagaagctgggctgtttctaatcagttaaaatgagtaggtagagccaaggtgaaggaagatggatttactcagggttcagttggttggactgttgaattgagctgggggcaggtggaataaagtctggtcagccactctggggccgatgcacaggggcccagcctggagcccacttccggccttgcgaatgcttcagtggctttgcatattgtctctttgttctcactctttagaaatgttctcccacaccttccttccagtggatttctagaaataccctatttttcatgactcaccaattgaacacatcctgtttggggaagtgataagagaggaatttgagaatggcatggagttgactcctaatgatgactggtgcaaggagtagacggcccagccttctgcttgctctgcctctcacctgtgtctccagacgagctgaatttctccaagtgccgtgtttcactgtccccgcccgacatatgccaactggagcttttcctgtcctgttgtaggcggggatctgtgtgtggctacagagtgactaatggtagaattaatcgagttagagatggggcctgtagttttgaacctgatgagttagatgaccttttggaccacacagatggctggtcgtcctgtgcaccagtgtggcagggatggagcttgtgccagctgccccgggcagagttgttttctttttaagaggtagccaaggcagccttgcctctcaggacccagccctggtgggtggcaccccagcccttccctttccagggctctgattttcctcatggcttgctgttatttcactcgcagagttcagatgttgttcattccagcagaggccggatgtgtaaatcatcctgcagcagttctgtcttgtatggccggaggctccttggtgggctgattggaaagcccagtacattagggagtgaagggagtgaagtaaagagaaatggaggagggagaactggagctggggcacgtgagctgctgtggtagcgtgcgggaggcaggggagttcagaccacgtctcggggccaggagtggctgacagctgaggtgtcgggctgggtagggcagagtgagccgcatggcctggcagctgtgatgggaacatgtaagaagtggtcaggctgctgttgttttagatgtctgaaccctgagggtagaactcggagaacttggttggtggatgcagccggcaatgccttcccatgaatggcaagggcagtgggcttaggcagatggagctgctccacctggcagtttagcctcccaggggacttctggcaaggtccggagtcatgtttgatctgccaggactggggactggggtgctggtggcatctggtgggtggaggccaggatgctactacacatcccacagtgcccaggactgcacccaccacaaagaagtaccttgtcccaagtgtgtccgggcctgatgttgagaaacgctgggtcaaaaggcttcaggtgatggtggacttggagggccggtcagggagggacaaagggatgtccttggcacctggactgctttggggcccctgtttcctgctcttggtgggcctgagtctctctgtaagttttgcagtatgaagttgacctggatgtttcataagcagaggcttgtaggtaatcaagtgccacgaagtaaagatcatttcgggccacttgaatatattaagttcgtcgacatcttcaaagagttagattgaaatgctgatcctcttatattcctgacatattcttatccttgcctgtattatttttttctgttttttaacctgtgttgtgcagtatgccagatgaactttttagggtgtatattttgatatcttacttttatgaagattaataaaattaaaattgtctctgtactgatgtaaagagcttgaacttaatttagttttataattgtctgtataaacattcttaatgtctaaagaggattttttaccggagaggcaaagggaaataaaaacttgataaaatttaaaaaattaaaagcaactgttatctgttattgtatgtatgtatgtgtaggtggttgtgtgtatgtatgagagacacagacagtgcattttacttttttgttttttaaagatcctgcctttaaatttggaactataattatttgtcagcacagttaaattttttttttcttgcttttctttctctttctcctttcctgtgttggagcaaaggtgctgtgtgttgtctacttcaggtttcttttttgagtgaatgggacaaggacagggcaatatctgagtgtcagaaagatcccccccgaggctggtgtgggtaccaggcagggctggggtacggagacgggcaggcggaccaggcaggggctagtgaaggcaggacgaggtccaagttgaggccatggccaaggggaggggaaggcaggaacagcttggagaaataggcaagagggacaagtctctgacctcttggctgtgcgggctgggaatccaggaaaacactggtttctggcttgagtgagtggaagcttttttaaaaaaagagagttaaaaaaaaaagccctgttttgtacacattttgatggttaatgttgctttctgacttttgcttttcaaaaagtgaaaatggaaaagtttaacagggcctcaactcctgaggctggattaggacatttctcatttacattgtgacttttagatgaaaacataattgatacctttgaaaagattaagatggttctgcctattttctgaaatttaggaagcacccactgggtcttttggtctttttttttttttttttgacagattcttgctttgttgcccaggctgggatgcagtggcatgatctcagctcgctgcagcctcgacctcctaggctccagcaatcttcccatcttagcctcccaagtagctgggactacaggtacatgccaccatgcctggctaattacttttatttttattttttgtagagatgagggtctcagtatgttgcccaggctggtctcaaactcctgggctcaagagatcctcctgcctcggcccctcaaagtgctgggattacaggcatgagccaccgtgcctggcctgctctggttgaaggctagattctgagcgaccaggagactgagtcttttcttgctcacctggtggagtacattgtatacagtaggtgcccatgtttcttcttttgatttgcagagcagttgtcttgaggaaaaccagtgagatgatcccatctcttcccatgattttgagagtatgatctctgtcccaattcagaagagccctgaggtgaggtaaagatgttagaggtgagtggcattctgtgtctgacctgtggctccagtgtgtggatccgtgggctggcgtgtctcacatgtgtggactggggtttccctcttccacagggaggtggtcagtgtgtgggaggagccatggctctggcctccgactgctggggtttgaatttagggtgagcacttactaacactgttagctgacccgctacctactgatcttcacacggatgagcttattgatggtgcacacagatgacaggtttagattgtatgctggttccttgtatttgttctgtttttaaaacctcagctcctctagtctttggtagacactcttatgttatatcttgggcaacttagttcctctttctggagcctcagtttccccatctgtaacaccagagagctggacttaggggaaccgcttgatatttgacaatactccaggcttttgtaaacaaattgtccacagctttgctgagctacagccacatccgcttgaaaaagcattgtcttaccagcctgtgcagaatccagatcactttcatccaccttcccatgggggctgctccatcccttgtcttactggaaatgtctttctcaagggtcttttctggtgtacaggtctccctggagatggaaaaccatagcactggtttaagtacagtgttttgtttgcatggggaggagaggctgaggcaacagcctgtgagttcaggagtaataaggtgtttgtttccctttttggccagtttttttttggtggcataatttacatacaatgaaatttaccctaagagtacactttgatgaatcttacaaatgtacagttgtgtaatccccaccattatgacctaaaacaccccgaaagcttccctcttgctaacctgactgacttggtggttctggtggcttttttgtagattgcctggcatttctacatagatgattttgtcttctgtgaacgctgtttgcctccttccttcctgatctgtttgcctgctcctgctttctcttgctgtactgtgttccctgggcctcccgcagcctggaggggtagagaaagagtggcctcctgcccatccctcccagcccctctctgtcccgtggcgttagcagcaagcgctttgtagctgcctgttagtgggttgccttctgttcctagtttgctggtttttttgtcatgaatgggtgtttaatttcatcagatgctttttccgcactgactgagatgaccatatggtttcccttttttagcttgttagtgtggtgaattacatttttaacactgcaactactctttggtgtggaagccttatgtgtggggtaagcacagatttggtgtcatcatgttgggatttgaggattagctgttctgcacttcataaggatatagtacattcagttattgacagcagctaggctgtgtagtcactcctgtggggctgatttgtttaattatgattgttgacctttttactctttcattatattttgggtagaatgaaatcatgtgtgtggtgatggaggggtggtggtggggggagataataacaaactcttctgtagcctgaactcattacttcttataacccataggtgtaggtaccattttctttattttatgaatgagaaaattgaggtccagcttcttggaaggtaagagaaatgagtcccatttcccctaatattaaccgagcaccatttatgtgccggccatttggacccatctaaggggcacaaaaccattgttttttgttgttgtcgttgttgttgaaaccactgtaatggcagcatctttttttttttgttttagatgaggcctcactgtgtcgcccaggctggtcagtggagtggtcacggctcactgcagccttggcctttctgggctcaagtgatccacccacctcagcctcttgagtagcttggactccaggtgcacaccaccatgccccagtaatttttttgtagagatgagtttttgtcatgtttaagtgactttcccaaggccttgtagctggtaagaaggaggtcttctgtttctaagttgaattcttttccctgtcctgctacttttggggtggtttatggaaagaaattaagtcagggtgaaaaaactagtcaacttcttagagcaatgtagataagattttcacagttgatcttcacagacttatctaaatactgaagccccattatccctggggggtatgttccaagaccctcggtggatgcctgcagccagctaatattgaactagtttgccttcaatcacgacatgtctctgttcatgtcatgtcttcctcccataattttttttttttttttttttttatttgagacagggtctcactctgtcacccaggctggagtgcagtggcgccatcacggctcactgcagccaccatttcctgggcccaggtgatcctcccacatccacctccccggtagctgggatcacaggcatgcaccaccatgccaagctaattttttgtagagatggggtttctccatgtttcccaggctggtctcaaactcctggactggagcgattcacctgccttggcctcccagagtgctgaggtttcaggtgtgagccaccgtgcccagcccctcccacaagttaatgatttttccatcataactaagcacttgccacgcaccacggccgtagcttttgcagtttgagatgtgaaggcaaagctagcatgagtttatttttttcttctttaccatttcatgaatagaagacccacttttcccttagatcttagcaacctcagcataggaatttttccttaagtcaaggagtttcatctttttacttaaaggaagtgctgtatgatttctccttggcatatctgcattaccagcatctagggttcttgtgctctgggaccattattatgtaaaaaataagggttacttgaacacaggctctgcaatactgggacaatcatctcataacctaggcagctactaggtgactcatgggcaggtagcatggaccttgtggttctgccagacaaagggaggagtcacgtcccgcgtgggaggcaggacggtgtgagatttcatctcttgacatagaacagcaagcaatttaaaagttatgaattgcttatttctggacttttctgtggaatatttttggactgtggttagtggaaactgtggaaaatgaaactgtggataagagggtagtactgtatctggatgagtccaaaaacacattctaagatgaaatattattagctcacatatttatcttttaggatacaatctttcttaatttagcatgtgtgctggaagatattttgtcagtattaagtaatgctgcagaattttggttgaactgttgtgcatgtagaacattaattctttgttttcctgatagtttttggtgagaggttttctgggaagtcattgtcctattaccactttgcatgctaaactggtgcgattatgagttccttatccatatcagggttggggatgtacatacatacatgaaaatcaaactggctgggtgtggtggctcatgcctataatcccagcacactgggaggccaaagaagcaggaggatcacttgagcccaggagttcgagaccagcctgggaaacatggcgaaaccccatcttttacccaggcatggtggcgccgtgatcgcaccactgcactccagcctggagtctcaaaccaggctcaaacaacaacaaaaaactaattgctttaagtaaatgttcatgcctcaccaaagatatgtactgtaattttcctattgtggatatgtatattttcaactcctccaacattagtgagtatatgccagacactgtgctaagtcaaggaaagcgaggagaaggaaagggatggcattttgatctggacctgaaaggttgaatctaataagtgagaagagaactcaggacctggcaggtggaggattacatggttgcacatgttagggtcccaataagtttaggggagcatgttagacagattaagaactttgttatcaggcggacacatgtgaatttcacacctggttttactacttggtaactgtacttctgggcaagttggttagcttcttcgagcactagtttcctcatgtgaagcaaggaggagaaggcataacatgtacctcacaggcgttcgttgtgtttgctatcttggaagagaggggggaggtctgtgctctgtgctggaatgaaactttttttttatttggccagacagtgatggtaggcattctttggaccgtgatcttaggggcgcatgctttggcggtttacagatagagatctgacctggtccatgggaagtgcagattcagttccttgctgacactgtcaggagctcttccatcacctagccttgtgccagcacactggtggtgcttggtaaatgtttgttgaataagtgcactaaggtttcactgtaacctctagtgatctgcttctagaagccttttcttctggtagggtcacacctagaggaattggatgctacaaactgtgatagacccagtaccatactctagctgctgtgtctagcttgacagggatgggcacttgcggtgccctcagcctggcttgaagttgacatcttgtattgggcggtgtgtgggctctgttccctgagtcttcatcctgaaactgctggggctgatagctggtcgcgggatcacctttcaaaggaacgcagtccagaggcctttgcttcctcaggatggattcaaggagagaatcctcagctgatcatcattttatcccattttttctgtttcctttactgttccaacttttctttcttttctcacctcctttatggaggaaaattgccgtctggggaagcatgatgctggggaagtaggttttgattgtccgatgattgtcaggtgagactattacacgtgttcagaccattgggtgtaagacattggtgcacattagctcctgctttgatataactgaggcccagtaacaacaaatttttgctcaaaaaaagaggcataagcagcgttgtgtgctttctttattttggcctaccctgcatgatggctttaagtattatcgggagaagaagcatacggattaacaaagatgtgtacttcactttccaagaacaggaatgttttgccctagtgagccttgaagattttttgttttgttttgttttgtttttttgagacggagtcttgctctgtcgcccaggctggagtgcagtggcacaacctcagctcactgcaagctccgcctcccgggttcacgccattctcctgcctcagcctcccaagtagctgggactacaggcacccgccaccacgcccagctaattttttgtatttttagtagagatggggtttcactgtgttagccaggatggtctcgatctcctgaccttgtgatccacccacctcggcctcgcaaagtgctgggattacaggcatgagccaccgtgcccggcctaaagattttttttataatgtgcatttttgtccatagattacaatcactgttgtttaggaactcagacggaaaatgtgactgagtcagagaagtaactgttaaaatacaactttgcttacaatatctgctttctgtacgtcaggcagatgaattgtattaaaatacttcctaggtctagtttggtggaaaccaaagatataactgtatttgcagggagattggagaatgagatagcgtttccacttacagaagcttgttttatcttacctagattaagttgaggcagaatgcatgtataaccagggcattctggtacgtagtcactcattcatctgctcatttattcagtagcactttgcttatttactatgctagttgctgaggattctaaatatgggccttccaggactcacagtttagttgtgagggaccgatataagtaattaggaaatagtgtagtaaaaatagccagcaatttttgttccctccccagaataaatgtgctgtgtgtgtgttagtttttatgaaatatgtatatgaagttttcttttgggaattagtgggaacatgatatgtatataaactcatcattaaaataatttgaatatcagctgggcacgttggctcataacgataatcccagcactttgggaggccgaggtgggcggcctataatcctagcactttgggagaccagtctgggcaacatggtgaaaccccttctctaccaaaaaaaccccacaaaaatttggtggcacgcacctgtggtctgagctactggggaggctgaggtgaaataatcacttgaacccgggaggtggaggttgcagtgagccaagatcgcgccactgcactccagcctatgtgacagagtgagaccctgtctcaaaacaacaacaataaaaagaatttgaatatgttcagactttccaccatacagtaccttagcaaggtacactgagattaggaataagttaaaatgcttgtctttggaagattaagtggatgttaatctaagcaaagtggattctgtaaaaccctgaaagaagtttttgagtttcacggtgtgaacagaacagagaacccttgatgagaacacatgcgtagctcctagcacagagtgtgcgacacagttaatgtccacgggaagagcttgacacaaacttaaataccaaacttagttcagaagcacttcgcattaagctcctgtgcctcagtggcctggcacttactggactgaaggacagaatcactaacctgggcttttactaccattgcagcccagtgccagtgacacttagggactcttccctgagcaccttcccaggtacccagaagtgtttgtaggaagaacaggagatggatttaatgtggatttatttacagtatatgagaatacatgatgtgaaggcaaacccttttcattagatcctttctgaggcatcataaaaatcatggttttatggtttttatgatttgagtctaagaaaacttagttacttagcctttctgcggagaataattgcttatttgacagggtgacacgatggtgtgtgagctcagttgcttttagccagcactacttgaagtcctcccgtcatataaaaggtaaaagtctgaatcatgcaggcctaggtttggttgtgaacttttacctcttactggtagtgtggccttgggcaagtcactttgatacccactttgtaggactgcggtaagaataatattgttattaatagagattccaggaacttgtagcttgattttggatgcagagagctgggctcctcccacacaggagcttctggtttgagaaccacagctagcaatggctttgttgaggagggtgttggtgtgactatcgaattgtcagtgccagtgtgttgctgccgtggctgttgcatttgaatgggctctggagacacctggggtgggtgggggctgcctgacacggagccagcctgcctggccacttcttcggctctgtgcttacttgggggcattcactgtgctaggtgtggagggttctataaaaacaaaccctaaaagattagtcatacatttactgttggtcatttctcaaagtgatgacagttaccttctgtaacctacacttagtttctgagtctttttggtgtgtgttgctcgaatatcactatacatcttcctgacttctgaatctaaaagagcaccactctttctctttgtttcttcagtcagaaaatacctactgggtgctggtgctgcgtttgtgaacagagcacacagaaatctgggcctgggggcgcttgcaggattctgcttgctttccttcctcccgtctctgcagtctgacgctgtgtgccatgcattagtcggttcgtcgtctgcctccactagagtgtcatggatgctcctgggggacagagcctttgttttcttcgccaccagatccccagtgcccagagcagtgcctgggacagaacttgttctcaataaatagtttgttattgttgttgtggggcttggatgcaagaggagtgagccccacatttgattatataataattaaaaccttaaaaacaagcatacgatggggatggctatctaagtttagaaggttctgtgaaaaggacaggagggtggtgtgaccccgttgggggaaggagctctgtgttgactggcaggagccctggtttgggagtgttggctttatccctgatcagctgcttgacttcaggcaactctttacatttgagtgaaaaaatgaatggggattctctgtatggtttctccaaacccgtactccttagacatttaaaacaggtggacggaaccaacttttcatttcacctgacttctcagtaaccacttattacactgagcaaactagtgtgaaaattttattttatttttaaattttttacagacagggtcttgctctgttacctagactggagtgcagatcatggcccactgcagcctcgacctcctggactcagtgatcctcctgccttgttctcccaagtagctggagctacaggtgtgcgctaacatgcctggctaattttttaaaacaattttttgtagagacggagtatcaccatattgcccagactggttttgaactcctgggctcaaacaatcagccttggcctcccatgccaggattacaggcatgagccaccacgcccagccccacctgtgtgaaaattgtaatcattcacctgtgcataaagttgcatcctgcattcagaataaagagaaccgtgagaggtcttcaatttagtcatctttactacaactttctttccttttttccttaatgctcttgatctttcttgtcacatctaaatggtttaatccattgtggctcgatgtgggagaggctcattcctgggatactcctggcttctacacaagcctgtgtactgctgcatgtggagaaattgtccaggttttttgttttgtttgagacagagtcttgctccatcatcaggctggagtgcagtggcatgatcttggctcactgcagccttgacctcctggactcaagctatcctcctacttcagcctcccatgtagctggggccacggtatatactaccacacccagctgattttttaatgtttttgtagagatggggtctgtgttgtccaggatggccttgaactcctgggctcatgcagtctgcctgccttagcctctaaaatgctgggattataggtgtgagccactgtggccagcctgtccagtaatatttttaattgaggagaaaggtcttcttcctgacagcagtctgtctgctcgtgagttttgacggcacaagctgcatggatctggtattggggtggcagcagctggaaatcctaatgaggatgaactcttcgctcctcaattaaggagactgacttgcccttcaccagaggctgctgtcttggaactgctcccagtccgcagatgcctagggagtcccagacggtccccggtcctcatttgcacgaggcgaatcagtttagcaatttgcctgcctaataggatattgccctcatggaccttattacctcatgcgctgctttcggtccatcgtctagctttttgatttgagtgcttctgtggatttgctcgctgcgtctgttattatagaagggtttttaaggcagccatgtggatgggcagtgggttccagggttcagatcctacctctgctgctcactagctcagatgtctttggtcctcagattcctcattctgaaatttgggaatgatactcagtcattaattaagtgaaacagcgtttagaaagcgcctaggctggtgccagacgcggagtaggtgttcagtgaatgcagaagctatttctgttattttttgcacttgctaacagttcctatccttagatagtctctgtctttaaacttcatgtgcctcgggtttaaaatctgctgctaaactcagctgatccaggaaactgccactttttggccctatttcccgctctcctcctctgccccccacactgataacctctttatgatgtatcctcccagctctcaggcataattatgctccacttatccagaggtcagacttttagcaacctctgccatctggaacatgtccaggaactggaagtcaacagaaaaggccttggagctcagctgtcctcgagtctgggacagacgctaggtggagaaggggtggctgatggaaggggggcggctgacagcagcaagagatggcaggtgacccagaagacgaactcagcagagcagggccatcagtgtggtggccagcagttctgcatcccacgctaaccacggaggccacgcaggcctgtgttccgagtgggaatctttggtgctcccaacaatactgagtatttaagccaaattatattcagcatttgttaataaaagaggaaaatacaaaatctgttttataaccaagatggtttttagaaaaccctttggtatcttggtgtcatttttttttttcttctgggtaattagtgtatgtgtagctctttatttttcaagcatggggaaaatgccagcgtagagaggatagaacacgggctttggagtcgcagtccagggtgtgcctcttgtttattctgccacctccttgctagttgaccccagtgagagtcagcgttttgggtctcggtttcttcctctgtaaaacctcagaggtgtgttcagaataaacacacctagaactaggcaagacgctgacggtgaggtcttagatacccaggccctggctgggcatgggaattcactgcttctactgtttactctgcttgtaactttcactcctatctaccagccatttggtaaatttccttacaccatttgacatgtaggttgtatatttcaattagatggcagttctttatggccagggaccctgtccctgaacctagttttttagtgtctctgaagtcttcctgatgtcgactctgatgtgagctcagtgttaggtggcaacgaggctggctctgtgtctacctgtcatggaagctctccatgtccccaaatccagaaggaggtaatttgtgtaaaataatgctgtcctttaacttgcgtaaattcctcccaacccgaatacataggatgctagaattttaggtctagaggagattttattttagcattctcctggacaaattgcatgttttgtggctgggctgggcatgtaggggctgagaggctgtcttgtggctgaggccacacagccagtctgtggtggagctaggctggccctcttggggcctccttagctccagtttctttcctctgtcagacagcaatggcctcatgtcttgttcttcctgctgcgagctttagcctcaaactccaccttgaatgtggagtgaacttggagtgaactttgtctgtggctcagcctgcccgtggcctgtctgtctgccccattctgccctcacgtctctagagaggacagcaatgccttccccatatatgttcatttctctgatgattgtagtgtctaatgggtttcattctgatgaacttgagcccctcacttgggcttgttctttgctctgatggggagtaatttgagggactctcatgacgccatgcctgctccagacaacccctaggagcttgcaaagattgccctgtaggaggaattgctgatgtcctgtgaataattcctgggaaggaaatgccaggctgacccatcacatagactgcatagccatgacttagcagggtggagcacccacactgtcgtgtggacagaaagttcacagcctgagtgagactgggcgctgggctgagattgctggcacgggtctcctggagctgcaggcaggcatgcccgggctggcgggggagctgcatgcactgccacccccagaggagggcagggccgtgtggggatactgcagaggatgaccgaggggcatgattagagagaggctaccctgaaaacactctgctaggcttccagatttttgttttgggctggtcctgctcaggatctgtgagaagtatgtaggaacattgggccaccgtctcctgcccatcaaaaggctacatgccatgtggaaggaaggcagggcttggggtcaaatctgggtatacaactcttcccttctttccattttcttacttggaatatttacttactcacttgagtttcagttttatcatctgtaacatgaggaaaataatacctacctcaattgctttgtagggtttcataaagctaaaataatacccatgatctccttgggggcagaaactgccaggatcatttttagcatttaacacgctgcctgacacaaagtggtcatgtaacatttgttggataaaactccacaaactgtaaggaatgttacacacatggtaattattactaataattcagcaaatggtatttgaccacagacttcctgcctaggcaccagggaaagaggggaaagaacacgacatgtgaatacacagctgtccctagggctcctggagttctcgcggtgccccaggtgccatgcatgactttaaagatgggagtggggatgcaggatgccagacatgtggcccttgggtgggaattgggaccccagatctttaatcacttaagccttgggaggtgtaaaagtgttttcccattccacagagggtacaaaaggatacagggcacattgcacggcccccagggcaaatgcagtgtggtgctctttcatttaagccgaggccacaagtaactatcggacaaggttggaagcagaaagcagtgagcacccagagaggaacaggagtaggctgtggagctcaggagctctgaatcagagccagggtggagcggaggtgtctcagcccctgagatgttgcagtcttcctgttaatctgccttgtggaattaagctatacctgcggggtcctagggatgtgattcagcacaggccaccatgggccatctgtgagcaaagtgctgagcccaccatggtggaaatacagaaatagacaagactcggggcttgctcccggggaacttaaaacagtgaactatgaaacgaggcgtggtgaaagtcaatttcttacagagataagatgggaacccggagtgggcaggctcaccaaggaggtggcatttgggtggatcttgaaaggtctgtagagtttgaattggagacagattagaggtgagaaaacacactgaggtgtggaaacccacaggttcttcagggaataagtggacgggagtggagcgtggagggctggtaaacagatcgcgaaggagattttgaaaggaggaacgtggccagagcgttgtcacatcaggagtttagtccgcaagtagaggtgggccctgtggctttccctctagtcacttgtcttacagagaaggggactgaggttgtgagggtggggctggcatttgacttcgtcccactccttcccatcttctgggctccatctgcttggtactcacgtgtaacagccttaggggacctgccctccctgtgggggcccagacctggggaatctggttgagtctggctgctcagtgggtctgggcgcaaagcatgtggagaaattgagaagctcgaagcagaacagctaatccttgatgtccatcgggtgggttttgtatgcttaataagtaaagataacgtgcattttacactttactaaaacgcattacctcatctgactttccttttccctccatcccagctggtgagttggggactcagtgacccttgggagaaggggaagggagcagctggggggcgcaccttgttgaattcatggggtctttcctggggaccttcggttttgtgatgaggaagtggagtggctggaggacatcagcgtggcaaatggaatgccttcaggaatgacgcaaggggaaggtggctgtggctgagggtgaggaacagctgccaggaaggaagactgaatgtgagtttcctggcagtgatggacggagcagagatgggcctgaggccactgacagggagctttaggaatgagaagcctgtgcccacattgcttttttttttctttccttaattttttttttttaattatcatctgtagctcattgaatttagttcatcagttatttgaaataaatcagatgtacttgggaagtactggccagtaggtgttagagtgttagcctgtacaaaaccttccctctgggaaatgctggaaggagagccttcgtgtcacaaaagccgttaacacacactgtgaggtgccttggagagaggtcactcaggccagggagggcaggcgtgcctgacaccagctgctaggactgcattggagtgaggccactcagccttgaaggtcaaagagcagatgacaactgagagtaattgatgaaccagggactgtaggaagagtcattttaaataaggcctttggggctgtgcgcagtggctcttgcctgtaatcccagcactttgagaggtcgagatgggtggatcacttttggccaggagttcaagaccaggctgggcaacatagcaaaaccccatctttactaaaaatacagaaaattagctgggcatggtggcacacgcccagctactcaggaggctacggcaggagaatcgcttaaacccaggaggtggaggttgcagtgtgctgagatcacaccactgcattccagcctgggcgacaaagtgagaccctattcccctaacacccccgccccccaaaaaaagccttcggaagacagttaaagaatttaggaacacggccgggtgcagtggctcacgcctgtaatcccagcacttagggaggttgaggcgggcagatcacgaggtcaggagatcgagaccatcctggctaacacggtgaaaccctgtctctactaaaaatacaaaaaaattagccaggcgtggtggcgggcgcctgtaatcccagctactcgggaggctgaggcaggagaatggcatgaacccaggaggcggagcttgcagtgagccgagatcgcgccactgcactccagcctcgcgacaaagtgagactccgtctcaaaaaaaaaaaaaaaaaagaatttaggaacacaagcagatagtgcgtgggcccaatcactggtcctacaccaagcatcttgactatttagttgttcactgcagccctcaaaagctgcccgtgcatccctaagcccaagccaatcccgaggcaacaaagaaacgaaagtcgttttttgttgttttttaaaaagtttttaaagtcagctgaattgaggtctactctgcaaacaataaaattcaccagtttttgtttttgtttttgtttttttaaacagtttcactcttgtcacccaggctggagtgcaatggcgcgatattggctcactgcaacctctgcttcctgggttcaagcgattctcgtgcgtcagcctcctgagtagctgggattacaggtgcccgccaccacacctggctaatttttgtatttttagtagagacagagattcaccatgttggccaggctggtctccaactcctgacctcaggtgatccgcccgcgttggcttcccaaagtgctgggattacaggcatgaaccactgtgcccggccaaaattcacgttttaaatgtgcagtttagtgggttttgtgaaatcgtctaagcaccctacagatgtaacgtagcagagtgccgtcacgcagaactcccctcttcagttggttcccccattcctgcctcctgtcatctctgcgctgctttctgtccttacaattttgcctttcttagaattccgtataaatggaatgatagggtatgtaaccttttgtgtatgattgcttttgcttgacctagtgccctggagattacaatgttacatgtatctttagaccactcctttgcattgctgaataatgttctgttgtatggatacagagtaagttcccccttagctgcattttactctccaaggtttcagttacctgaagtcatcccaggtccgaaaatagtacatacaacgagatattttgagaaagagaccacattcacataacttttattacagtatattgttggccgggcacggtggctcatgtctgtaatcccagcactttgggagggcgaggtgggtggatcacaaggttgggagttcgagaccagcctggccaatatagtgaaaccccgtctctactaaaaatacaaaaattagccgggcgtggtggcacgttcctgtagtcccagttactcaggaggctgaggcaggagaattgcttgaagccaggaggcagaggctgcagtgagcagagattgcaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacggggttttaccatgttggtcaggctggtctcgaactcctgaccccaagtgatctacccacctcagcctcccaaagtgctgggattacaggtttgagccaccgtccccggcctataaactaaactttatcagaggtatgtgtgtatagaaaaaaaaaacccagtatatacaggatttggtactgtctggtttcaggcatccactgggagtcttggaatgtattccctgaagataagcggtactacttgttatcagttcaccaagtgatgggcatttgggttctttccagtttttggctattatggataaagcttctatgaacatttgactacaagtctttgtgtaggtagacacgttttatattttgacttcgggaaatacctgagagtgcaattgccgtgttgtgtgctaagtgtgtgtttaactttatcaaatgctgccatcccattttccaaagtggctgcatcatttttcatttccactaaccacgtatgagagttccagttccttcacttcctcatcggtgcttggcattatcagccattttactgggtgtgtaatggaatcttattgtggtttaatttatatttccctggtaactaatgaaaccagaatcttggccattgtgtatcttctttgatgttatgtgtctatacttgtaccatgtaagttggttctcagatcatacaatgcatcatgagagtagagattctaatgagtattgaatgtctcttacctgaagggctgttcaggagaaatggactatttaagtaacaataatctgaaacaagattctgaaagatgtgctctgtggaataatattgcacatattcctagaagctgggataaatcattcacacagaaaaaactggaaggatctagcaatttacttaaattctcctatggaattttaaaaagatggcctcatattgccttgttactatggaatggttgatttgatgtaaatgcacactgcagcttaatgaagtagcctctctggttctgtgtgtccttgccgtggattcggcagatggtgtcgtcagagattatggagttcaagccacctagctttacagaggtgaagggaggtgcctgagttgatgaagggagtcgggggcagagctggtgccagcaccatgtggtgctccagaggttcttcaggggtctgcttgacctgtattgcttttatctttaaaatttccaacagttgttaaaaagttttctgaaaagatttatactctgatgtttgcatcacatagcagggaggtgatctcaccagaacattttgaagtcttggtaaacattgggctggggggcacaagatcgtctgatttatttgtatgcgtattggtaggtagcatgctaggcattgagggacttaagaactggggtttataagcaggttataaactacagtacctccagtgatctggctctatagcttagttgtttttaatgccctgttttgatgaaggaacctgtgtagacttaaagttgtagaatgaccagtgcgtcactatattttccctagtcattgacatatttgcacgttcagacattcatagaaatggcaggagaaaaactattctagggtcccctgcaaaaaaaaaaaaaaaaaaaagaaagcaagtaattctggcagcccaattaattcatttaatgaatatttattgagtgccaaccatgtgccagcttggggtgatgaagataaaaaattagcatgtcagtgggcgccaggatgttaaaagttggagtttagcacgagggtgtatatgcatgtgctgccttcacttaaatgtcaggcaaagcggcagtgtcaactgtgcataaagaaattagcgtttaacatgctgtgccaatgatgatgctgtccatgggctgagcagtcaatatatgtttcagatgcttcttgtctaacatatctgagataaggactgcaaggagatattagatgttgttagtggtagagagttgaaacaaatttcttactattccaaagcttttggattttgtttttaaaaaagaatgtggccatctgtttctatttacatgtgcaaatcagaattgtctctgtcttgtgtaactggaagagtattgaaatgaaagtgcaggccactggcatccaactgccaatttcaaatgaatgaaaacagcctcagtgttctcattgattccattttggggatgtgatggtatgcatttgagcaatttgtattccagcaagagacctttttaatccatttcctctgtgtgacagaggagttgggttttaaaaaagcactgaccgagagtcagtatgactgtctcttagccgcttgtcctgtccaccctcagtccttgttcctctccttcctgatcctcctgctgcagccaagggctgggagggggcagcacagctgatggactcattccaagtccttggctggagtgcctcctgcctgctaacagcctgtcactttcttcaggatgtgcctgtgttacctgctccagggtgtctttccctaacagcctgtcacagggcgtttggtagaaactaaagagcagcagaggatggtttcattcattccatgttcgtggagtgtttacacgtgtcgggcattccactggtgctggagattcaaaaatcagaaggtgcgggcccccatcctgaaggagtgacagtttgtccttgttccttagggttcagctaatgaagagtctcaattgccttgggaaatttgaagtctgaaagcagggactgttttatagtagtctcaaacagtggtaggaaggatatacctacttagtaagcattatggaatgaccataggtgcctaaaacttttccctgcaaaattaaaatagctttattttcttggtttattgtttcttaactttttaacaggagattaccttgaacaaactaatgaaccagtacatgatgtcggaaagaacaggctaggagaatgtgaaagtgtggttgttttgttttgtttttgagacaaggtttctctctgtcactcaggctggagtgcagtggcacgatctccattcacgtcaaccttcgtttcccaggttcaagctattctcctgcctcagcctcccgagtagctgggagtacaaactcacgccaccatgcccggctaatttttttgtatttttggtagagatggggtttcaccacattggctaggctggtcttgatctccttgtgacctcaagtgatccgcccgcctcggcctcccaaagtgctgggattacagatgtgagccacggtgcctggcctgaaagtggtttttaagcaaaaaaagagaatacaaaggtggcattttggtttatccttacctatgtggccttggaaaaatacctttgtgagtgttactttctatgttgttgcaataatattgcctgtgttaccaactgcccaggttggagagtcatgtgccataatctgtgtgaaagcacttttagaagtgctgtgcagttggaagcctgttattactgctacccccacaaccagtgctggtatcatcacatttgtaccctgactttggggtaggatatacggacatacacatttcatttctttccatctattttgagaaatctaagccagggaaatgcagtggaattcttcattaaaaattacctttggccaggtgtgggggctcacgcctggctgggtgacagagcgatacttcatctcaaaaaaaaaaaaaaatttctatgattaccagctatttatttgtaaagttgaaataaatgctattcacagtattgatagtaatcagtagttgttttttttttttttttttgagacttttggtcaggagtcttactttcctttaaaaaatacctcacatatgtttgaatgtaattgtaagatttccttcttggaaagataactaaaatgcaagctgttttaaaggtggtactttcatagaattttgtatctagaagctcagaggagaagtggctcacctaaggccccaatccgagtaggtgacagtctccatggtgcccccgccgccacactcatcttctcattttgcacaatgcatgattttcagtccccacaacaaatgcaaaccttcccgggtcctggggcagtgtggcttgagcaggcgaaacccccggaagctgctgactctcttgtggctgttgcaacttctttaggtctcttgaggaacagtaaatattccacagatcagcttcagagcagacagcattctggctgagaaacagatgatcttcacttttacttatttatttctctcgctctctctcctcttcacttctcaaactaaacatagcagcattacatgtagtctttgcttttaggactcagcattttagagtctgtaggtccatgctcctgattacagactggggtctgcagccctccagtgatattcctcggattgcagccagtttcgcggggccagaccaggaccctgggcctgctcttcggcctttctctgtggtgtctgcaggcctgactgtccccttagcagggaagggaattgctctgggccgtggtccagcccgtgggacggaggttcagcctcttccccttacttgctgctgcccagggagcccttcccctcgcttcctctcttgttctgttagctggggtttcaaattttcttttctttggatggaaaacaaacaaagaaagtaaaactaatgggctgaagcccttccttggggagaaacattcatccctcaacgctgagaataaatggcctttgctgaccctagcagcacagccaagggccgccatccctgcctgttgctgcacttcccctcccttctgcgccatcctgcagtggcagggaccctgcccttccttgcgtctgcccccgcttcctgcgccctgctctcctgccaggctgcccaggctggggtgcccctctctgcaggctcccacccctcagcctggcttgtacctctcaagtcctcctcttgtactcctgctccctggtaggtggatgctatcagagggcacagttttcagcccaaaaccttaaggaacaaaaatgaacagcaccatctgcatctctttggccctcgcctctgtctccaccttgctccttggcgctctcaggccccctgccccgaggctggaccgctgttgggagtgtggcaccagtgggtggactgctttccattgagggcagcagaacccagccttgtgtgtgtgttttagcgcagagatcttcagatgaactcatctgaggccgacaggcaaagtagccctgcacatctggggccagggatggaggccgatgctaaatgccccccatgtctcctcagctcccttgcaccctgatgagcccctgcagtgtcctgcatagtccttgggctaagtggagccgagtatggaacccaggtctaaaattgggaatggctgtccagtgtctgcgcatcgccccctcccctatctgggaaactctgtggttgaggaaccccacttacaaggccccaggcaggctggcctctccccgagtcaggcaccagtctgatggcctgatggctctgctatggaggtgggaggggaaaggtcctccaccaacctggggactctccaactgtcaaggcaacaatcactgtattgagtagctattactgcccgcattttaaggataggaacactgaggcccaggtgatcaagtaatttgtgtgtggagatgtgggaatgaaagctcatggtcttcatctgtagcagtgactcccgcagtaagcctgggtcatgaggatgaggtgggatccagaatctgctgctgggggcgggaaggatgcctggctgatccctgtgcaccttcgggccctccctcagctcattccccctctcccatcacctcactgcttggattgtagaaaaatgaaaggttcatgcctagagatgaccaattttggggtaggagctgcgggtggagcggggcccatgacctctgtgtgggagaagctggagaggggcacggggctggccaggctctaaaaggcacatgaccttgtttgcatcgtcacactccttttttagaaaacaatctctgctgcatacagaggttggctttgtgcagggccccagcaatcctggtggttccttcctgcctttcttctcccttccctattctgggtttttctcctccctgcttcccattctaccataggggaatggggtcaagtcttttggatgggaaacaggaactgagaagttgaagatggagaaatgaaagactaaagatagcagggttttaattttccctctgaaaagcccaggaagagccccggattgtgtaacctggacacatgcaaatgatgaccctgcccctactctatctgcttctccgccaccctggcccttcagaagattctgaaacaaggaattggttacccagggtggttaggggggttgtgcctgtgtccctggtgaactttagattcttgtgcccctggtgaacttcaaatgctagtgtgctgggagccgtatgacagccccttggggtggcaggagctggcttgtgtggaggagagccactggcagctttcttggtgaaggggtggacagcactcttggtgtggaagtagcagcccccttgcctgtagctgggctggggttagtggaacagggtttagagaaagcaggggtaatgccgggtggttattttccccaaatgttagagaaagccagcgcttctggctctggaagtgaggctgttgggaagtgggagggggagcacagctctggaagctgccttccgtcctccctccattggctggagctctcccagcatttcatcggttcaaagccaaacacatgattttggacaagtcacttaaactctttgagtcagtttcttctcctttaagctggggaaagaggtggtgatttcacaagtggttgtaaatattgcagtaaagataatggaagtaaaagtgctctgtggagtgtaaattgctgtatggtagttggagttgggccctaggtgtgattttagagtacacacctactgctgccttggtaacttaaaagtatttatctcaaatgctagtgagctgagctgagtggcacagtaggcctttctttccctgggagcactttgggagctttggaggttgcccagtgctgcccccaacctttaacagtgtggccgagtgtaggagggagggggcagagttccttctggctggactgccacatgcaggggagaggccccgctggtggtgtcccaggtgggagaggggcagacctggggttacctcagtcagggtaggtgaggaggggatgggtggacaccccggtggccactcctactcacccctgcacttaagacctggggtttcatgccctgctcctttaaccctcagtgttcaagagagaggccagttggaccagagcgcctcaccccaccatttgccatgtgcccctccccgtggggagtcagaaacacctgagcacaccaggaaaagttttgaaaaacaatgtttttagagacagggtgttgctacgttgcccaggctggactcaaactcctgggctcaagcgatcctcctgcctcagcctcctcagtagctgggaatgataggcgcgtgccatcatgcctgtatgaagttttgaaaaatttaaatgttgatggaaaaaaaaatgtattagtggaaatgaaaggctggtataagctgtaaagtctttttgttcttagagatttttttctcattctaaacattatcagacctgaaaagtatttgtcgtaatgactgagacggtcctggggtaacagcgtcttcttaacggccactttaattggcgtagtttacacctagcctctccgagaactggaggacactggtaatcactattagatattgagtgctgactgtatggcagacacataagcattggtgatctcctgtgaggcaggtattgttattcccaatttatagatgaagaaacagaagtcagtgaggtggagtccgtttttgaggtcacgcggctagtaattggagcctggtttagaaccaagtcagtctcattccagaatccagaaccagtgatttgtaactgatgcacttgtctccaaagggatccagcactgggttttctcatttttaatgcatccattccttaaagcctctgttcacagtcacaaggtgtactttttaaaggaacacagcacacaaatgtgaccgctagtggacagcagtggcagcccagttggatggcagagcctggcatgccgactgggacagaagccccagcacacggtgtgatgatggcgtctccaggctgacctccatggcctcaggaatcaaagtcctcagtctctttcacgcggggttcagaaagaaaactcggctatcttacatctcctctcccctgtttatttgactaaagtgaagttcatgtggcttgagcctcgtttcctggggaaatcagcctggcttaggattccattgtcttctgggactgggaagatgtggaaggctgacctcacgcccagctgaaggtcaccttcccagactctgagctcggctgccttctgcatcgccacggctggagggcctggcccaggccgtggctgcatgctggctttccactgtctcggtgtccctgctgcctgtcagtaatgtgcccagcaccttctggtgtcatgtcccctcttgtttgtgattcttttcctgagctagtccattttctacctcgagtctgctctcctgccattcccaggggccacagctcagtaatgtgggtgtcagggaaccccaggccaggcccccttgtgccactgtggctctccccaaagcagggcaccaggctggctgggggggtcctgcccagagctgccccacgctgccgtgtttgtgctgctgctgtgcagtggtgatcttgccaaaatgtggcttttcctttctcactcccccagagctcccagaaaagtctctaggacttttcttccccctaaataaaagtcaggatgtgaagccttttgacagaattggagtttactgtcatctgtttccgtttctctaagatagggatcctggcgaagcccatgaaagccatggggcgctcccaccgaagcctccgaggcacagacctcccgggagtgcctgtgggcgctgcttccttaaactgcaggaggctgcagcctctcgttgttcatgcgtcgttttttcatagtgtgtgtgggtttagagctacatgggttcttttctcacttatctgttcataccgcatgacaccgtccacttcaggcacagttgacggccgtctggaggtcatcagctgagggcacagtttgcctggttcttctataataggttaagtatttttttctccatttttttcccttttaaaagtactgctagaaggccaggtgcggtgtctcacacctgtaatcccagcactttaggaggccaaggcgggcggatcagttgaggtcaggagttcaataccagcctggccaacctaaggaaacctcatctttactaaaaatacaaaaattaaccaggtatggtggtatgcacctgtagtcccagctactcagaaggctgaggtgggaggatcacttgagccttggaaagagaggttgcagtgagccaagatcacaccactgcactccaccctgggcagtgagtgagaccctgtctcaaaaaaaaaataaaaaataataataataataataataaacacaagtactgctggaacttctttgcagaaacaacttgtggggaaggagggaggtatattttagtatttggccttgggaaaaggttttgcttctgcaggcatgtcttccagagactgggggggcccgtgctggcgtcaccactgtccccttccccatcaggaaccttccttccttggatggcatttccagtgtgtccgggcctctgctgttctcattatgagtccccagctctgacggccactgtggctgatgcacagggtgttggagacagtgattcagcccagcaggctgtattcatgtgctgttcctctgtacacccagagctgtcttctcgctcatcatttattaatctttcccatgcaagtcatacgtgaatatatccttgtggtaaagttttcaggtgatagcgaaaactcagtctcctgtcaccgtcttctctcctcatctaggtgcgcgctataactaagtcctttgcctcttccagagtttttttctccctgtgtaccattggccctctgcacttgtgggttttgcatcctcgtgttcagtcacatagggtctcaaggggaaaatattcaagaaaaaatatccaataaaaactaatacagcaatttaaaaaatacaaattttggccagacacaatgccttatgcctctaatcctagcactttgggaggctgagacaggggaatcacttgagcccaggagtttgagaccagcctgggcaacatagggagacgtctctgcaaaaaatttgaaaattagccgggtgtggtggcatgtgcctgtgctcccagctactcaggacgctgaggcaagaggatcacttgagcccgggaggtggaggctgcagtgagccgtgatcacaccactgcacttcagcctgggggacaaagtgagatcctatctcaaaaaaataaataaataatgaaaaatacaaatttttaaaaatacagtgtaacaactgtttacatagcatttacattgcattagatataagtaatctagagatgatttaaagcatgtgggaggatgtgtgtaggttacatgcaaatatgacaacattctacattacgaattgagcatccttggattttggaattcaacggaatcccggaattaatcccccatggagaccgagggactacagttttgagtatttttgttttattgtttaatctgtccctttgacacatttttgtgctcagagttaaagacctcaataccctgcttgatgggaggagaagagaaaagggtaacaaagtataggatagtacttttcattttctttaattagaaaaaattatcaaataatgtattcatgttaatgatagtttaaaagtgggaaaacaaaaaattcctccaacttttcctaagacaacaatgattattttctttctgtatctttatatacagagttttaagtgtttgatatatcacttgtctatcctcttttataagtatttttttctttgcttttacaatttgtgtgtgtgtgtgtgtctgtgcgtgtaatggatttaataaacaagcttgtgattttcatttatgtatttatttttttgagacggagtttcactcttgttgccaaagctggagtgcaatggcacgatcttgactcactgcaacctccacctccccggttcaagtgattctcctgcctcagcctcccgagtagctgggattacaggcgcgtgccaccatgcccagctaattttttgtatttttagtagaagcggggtttcaccatgttagccaggctggtcttgaactcctgacctcaagtgatccacccccccaccccctgccttggcctcccaaagtgttgggattacaggtgtgagccaccacacccagcccataagcttgtaattttctatttctgaaattggaatttttataaaaacgattgcctttttatcttttttttttttttttggacacaggatctcactctgttgcccaggctagagttcagtggcacagtcatagcccactgcagcctcgacttcccagactcaagtgatcctcctgcttcagcctcaccagtaactgggaccacaggcacctaccaccacacccggctaatttttttactttttgtagagatggggtctcactgtgttgcctaggcctgtctgaaatgcttaggctcaagtggtctgcccacctcagccttccaaagtgttggggttacaagcatgagccactgtgccagttgccttttcatcttctgcagagctgccttacttgtgttttgtcctcagtgctgttcctgtgcgggtggtgggcgtctgcatgtacacaggccagcttccctcactgctggggggcctgcaggtctgggtgcaccttgttacccaggctagccttcctctgcagaggtgtgaactctgccaccaccccgttctagtcaagatgggaatggaatctcagaaaggaagccatctaggagaaaaatgaaagaagtgtttctcttatgtttgctgccgtcaaagttgctactttaggagctcagaaaaacagttatttgtaagatggattaagtaagtagtttagtaagattgcccaaaaccacctcccagagttagtgggaagcgcctgatgctggggagaaaagcccgaggcctgagctggccgacctgcattcagtttcctctgtctctagcttctctctgatggtttagaaatggtactaagggattcctaagtcccttttgcttcctgtggtcaaccaacatgctaggctaataaattactcctgaagttcactttcattttggcaacattttctggttctttcgccaactctaatttcttttctttaaaagatgctttaattttacttgtattcttaataatatatcttatatatacacacacatagcattaaaaattttttcaatgagatttttttaaaaaattcaacttttattttagatcggggggtacatgtgtaggtttgctacgtgggatatattgcatgatgctgagttttggggcatgattgatcccatcacccaggtactgagcatagtacccaacagttagtttttcagcctctctccacatctctccgctctctagtagtccccagtttctattgtttgtttctttatgtcatgagtactcaacatttagctcccacttataagtgagaacatgcagtgtttgtttttttgttcctgtgttgatttgcttaggattagggcctgcagctgcatccatgttgctgcagaggacatgatttagttcttttttatggctgcgtcatattccatggtgtatatgtaccacattttctttatccaatccactgttgatgggtacctgggttgattccatgtctttgctattgatacaaatgacatttaaagaatgattatgaaggccacgtgcagtttctcatgcctgtaatcccagcactttgggaggtcaaggtgggtggatcacttgaggccgggagttcgagaccaacctgcctaacatggtgaaacccccgtctctactaaaaatacagaaattagctgggcgtagtagtgcacacctgtagttccagctactcagaaggctgaggcctgagaatcgcttgaacccaggaggcagaggttgtagtgagtcgagaatgcaccactgtactccagcctgagcaacagagcaagactctatctcaaaaaaaaaaaaaaaaaaaaaaaaggaatgattataaagcctggttttggccagcactccaagcgcgccccgcaggcctgtcccatcgtaacgccctcagaagcttcccctgccctgactgcagccctcagcttgcctcagtttgtagtttgccaacaaggtgtatatccctaaacataaacaatttagtttggcctgtttttgaactttttatactgcatgtattcttttgctcaacatttttgtcaagttcacttgtgttgtggggtaagtttgttctcttccgttgctgtgtagcattctgttgtacgaatgtccatcatcagtttattcattttaccatcgacatttcggtttatccagttgggggctgttttgaggagtgttaggacagcctgtccatgtcttctgttgtggatgtatatttactctgagtaattttaattttttaagataataccaaaacacgcccttctcatctgtccttaggcacacactttcctcagctgtgacttagctcagacgtctatttgatcttaattcttagcgacacctgctattcttcaggcctggctttattcccacaaggggggaggttcgttattgctctggctttaaacggagcccacaggtcacagtgcaagtctacgcttcccaaaaggcttctggaaatatttgacactgtcattaatgctctctgttactttctgaagagtcgaatgcgtggtgagacaaagctgccatctgaatgtctgtctgactcttcttggcaaagccaccctgggggcacggacctgggtgtgttttgttttttgttttgtctactgtctttcagaaatgtcccttcttctcaggctggcctttcgtccgtggaacgaggggagaggagataggacgggagagcggagcatgctagggctgcctgagtgctgcaggcctctgctctccccagggcagcatcttcgggttctaagaaggaagccagcctcttcccacccctgctggttcgcattgagaactcagggtgctggggacaaaccggtgctgtgctgcctgcagtgtgggctccctgtcagggctgggaggagtggggtgcaggggccgctggtgctgtgggaggggcattttgcatggatccttgaggccagggctcagcaaaccttttctgtgaggggccagagatagtaaatattttaggtttggcgggcctcaaggcggtatgtaggtacttacataagagaggtgataaatatctacaaattttttattaatgaaattcaaaatataaaaataataatggagtacaattttttggtaatgcaggtctcctaaggggaagagaggaattattttgcgggggggagggggcgcgcataacatttatcttaattaatttgggttcagttggtctttcctgtgaccctgtccttgcattcattggaaatgttcgtctggaaacacccttagctcacggttggataaaagctgtcccgcaggccgtgtgtgcccaccctgagccaggtcatctcctcagatagtgggcttggcccgcaccattcagcctgtggtgacacaggatggaggccctgtagggttctgtgggggaccaagaagaggtagaggagcccccacatggaggagggtggccatggggtgatgttgatgctgagcccacgggggaaccatggccagggcctccgggtgaccccagaggtggtggcaccgccctcaggcggtacagtggggcccatgaacggaggaagagaagcatggggttggggacattcagaggccactgtgctgcctgggtggctgtagctcttgcagaaggtggcaaggcctgaggaactgaatttgaaatttgaatgaatctttatagaaacattcctctgtggctaccctgttggacagcacaggtgtggaaaatgagtgaacagctttgtggtggtctctcctgtggtggacttcccttacccacagtgtgcaccgtccccactgtccccacacactgtccccgtcccctgtcctggctccagctcagctgagcagcagagattggaagaggcccctcggtaacttgagaggaacctatagaagagtttgggaactccaaacagatgcttttaaagtggtttgaaacagtagttttcctcagaaatatttgggacacatccccctctctggtttttgtgataagttcactctgtaaaacttgtttgacaaactgaaggtcagcttccacctggcccctgagaattaatgaggtctggccaggcggcagctgcagtgcaggccctgctcctgtcttggggtctcttcggttcttgcctttgtttgtgttttttacacataagttcccgtgaaagttgcttttcccccgctctgagctggagtggagttttcgtttggggagcatggtagttgagagcctgggtctggttagaattctcagcctgatgggtagacatctttgcttcctcgagactcaagctttgttattttttgttgctctaagatttcagtattttttttttaatttttgattattgtgggtacgtggtatatatttttatggggtacatgggatattttgatacaggcatgcagtgcataataatcacattagggtaaatggggcttccatcacctcaaagcatttagccttcttttgtgttacatctcaattatactctcttagttatttttaaatgtacaataaattattgttgacctttgtcaccctgtttctatcaaatactagatcttattcattctgtccacctatatttttgtacccatttaccatccccacttccaccccacctacccttcccagcctctggtaaccatccttctactgtcagtctccatgagttcaattgttttcattttttttttttttttttttttttgagacggagtctcgctctgtcgcccaggctggagtgcagcggcgcgatctcggctcactgcaagccccgcctcccgggttcacgccattctcctgcctcagcctcccgagtagctgggactacaggtgcccgccactacgcccggctaatttttttgtatttttagtagagacggggtttcaccgtgttagccaggatagtctcgatctcgtgacctcgtgatccacccgcctcggcctcccaaagtgctgggattacaggcgtgagccaccgcgcccggccctgttttcatttttttttatggctcttttcagtttatttcatgaaggagttacactagtccaagttaaaagcggaccccaaatggttacattatacaagctgtgaggtttttaaacttgtgacaagggacagaagggaaattctactcattgcaaggaaatcctcacttaaactacagtgagccacaagcatttaaaccccatgaatcttcagctgatcgtccttagccagtccaagctctacgaggaactggcataatatatgttcttgcacctgtcaccctgtagctgaattacttctccatattctggatgctcaattacagtaccattgcaggcaaacttcttaaacgccttcactggtttctttttggtgtaatcatcagcgatcccttggacagtagtaagggccttcctgccgtttctctgttgaattcttatatggatataatcctcagtgccagcaggaagcaggtcatcacccttacttgcatcagcaaaggagtttaaatagtggaggttctggatagtggacatacgatccaatttctttttctcggtggaaatggtctgcggaagacggcgggcagagggtacggaaagtagggaagcgacggggcccaagggggaggctgctgagtcctcggcagtggctcagtgactggggtggttttaatttttttttttagctcccacaaataattgaaaacatggagtgtttgtctttctgtacgtggcttatttcccttaacataataacctctatttccatccacatcattgcagctgacaggatctcattcttttttatggctgaatagtactccattgtgtataggtaccacattttctttattcattcttctgttagtggacacttagattgtttccaaatcttggccattgtgaacagtgctgcagtaaacacgggagagcaggtacctctttagtatactgatttcctttcttttgggtatgtacacagcagtggaattgctggatcatatcatagctctatttttagttttttgaggaacctccatactgttctccatagtggttgtactaatttacattcccaccaatagtgtacaggggttcccttttctccacatccccacaagcatttgttattgcctgccttttgcctataaaccattttaactggggtgagattatatcattgtagttttgatttgcattgctcggatgatcaatgatgttgaacacctttttgtatgcctgtttgccatttgtatgtcttctttggagatatgtctatttatatcttttgccctttttaaaattggatcattagattttttcctatagagttgtttgagcttcttacatattttggttattaattccttgtcagatggatagtttgcaaatattttctcccattttgtgggttgtctcttcactttgttgattgtttcctttgctgtgcagaagctttttaacttgatatgatcccatttatctgtttttgctttggttgcctgtgcttgtggggcattactcaagaattctttgcccagaccagtgtcctgcagtttctccatttcttataggagtttcatagtttgaggtcatagatttaagtctttaatccattttggtttgatttttgtgtatggtgaaagatagaggtctagttttattcttctgagcatggatatttagtcttcccagcacaatttattgaaaaaattgtcctttccccagtgtatgttcttggcacatttgtaaaaaatgagttcactgtaaatgtatggatttatttctgggttctctattccattagtctatgtgtctgtttttatgccagtaccatactgttttggctactatagctctatagtataatttaagtaaggtaatgtggttcctccagttttgttctttttgcttagaatagctttggctattctgggtcttttgtggttctatataaatcttagggttattttttctatttctgtgaagaaaagcattggtattttgatagagattgcattgaatctgtaaatcgttctgggtagtatggacattttaacaatattgattcttccagtccacaaatatggaatatcttcattttttttggtgtcctcttcaatttcttacatcatcgttttatagttttcgctgtagagatcctgtacttctttggttaattcctaggtatttaattttatttgtagctattgtaaatgggattattttcttgattgctttttcagattgttcactgttggcatatagaaatgctactaatttttgtatgttgattttgtatcctgcaactttactgaatttatctatcagtgtaaccacccaatgggttcaccttgcccgctgctgcctagaccaagctgatttatcaagacaggggaactgcagtagaggaagagtaattcacgcagagccagctgtgcaggaaactggaattttattattattcgaatcagtctcctggagcattcggggatcagagtttttaaggataatttggtgggtcagggccagtgagttgggagtgctgattggttgggtcggagatgaactcataggcagtcaaaactgtcgttttgtgttgagtcagttcctgggtgggggccacaggaccagatgagccagtttattgatctgggtggtgtcagctgatccagtgaatacagggtctgcaaaatatctcaagtgctgatattatgttttacaatagtgatgttatgcagcctccagctgcatgactcctaaaccataatttctaaacttgtggctaatttattagtcctgcaaaggctgtctagtccccaggcaggaagaggggtttattttgggaaagggccattgtcatctttgtttcaaagctaaactgtaagttcctcccaaagttagttcagcctaggcccaggaatgaacaaggacagcttggaggttagaaacaggatggagtcagttatgtcagatctctttcactgtaataattatctcagttataatttttgcaaaggtagttttttcagttctgatagtttttatgatggcatctttaggtttttccaaatataagatcacatcatctgcaaacaaggctaattcaacttcatccttccaatttggaggccctttatttctttctcttgtctaatctctagctaggacttccagtgctgtttttatatatagttggcataagactgtttctagcattcaatcttttttttttttttttttttttgagacagagtctcattttgtcacccaagctggagtacagtggtgtgatctccgctcactgcaacctttgtcccccaggttcaagcgattctcctgcctcagcctcctgagtagctgggattatgggcatgcaccaccatgcccagctaatttttgtatttttagtagaatcggagttttaccatgttgtgcaggctggtctggaacttctgacttcaagtaatccggccatctcggcctcccaaagtgctgggattacaggcatgagccaccgcgtccagcctaacactcaatcttaaacaatcattctagcttctcgtcctgaccaagtttaattttaattgtctataaatatgcaccataatgaagggtgtgtttctgaatagggaggtaattgcttttcccacttgcaattttaattaaaaattacctcttccacctacctcacctttatttctaatctgtttaacagattgtagaaaagcaagtttatgcactcatccctgagttcaggaagcactacttcctctttggtaacaaaggtagaagattccatatggtgacctattttttcaagagttttatgcagtaaatgatcagggacgggtgtgtcccatgacataatatgggaggaaatttgtcagagttcaattgtgttattaaggtatgttgtctgtgagcagccttttacattgaagtttaccaccgcttccagtcccatgttttgttttttcatttgtctgttttttttttttttttaagagacagggtctgtctgtcacccaggctatagggcagtggcgcaatcatggttcgctgcagcctccaacttctggatttaagtgatcctccctcctcagcctgggattacaggtgcatgttcccatgcccggctaacttatttttattttttgtagagacagggtgtcactgttggccaggctggtctcaagctcctggtctcaaacattcttcccaccttggcctcccaaagcactggtattatagtaggtgtgagctaccgcatccagcctagtccttgtgttcttagcacggttgacccaaactcctgtagacacaagatcactctgtcatctgtgggagtatcagaggcaggagggctgaaatctggttgagagagacagcacagatctccctggctggcttttccagaacggctactgcccagctttagccctgaatggcttttgaaccatgggttccagccagttccctcttctttgcgtagcctctccctgaatgcacttcctgcctgccctgatccattaccctccctgtggcctgagtaaccttcaagcacagctcccgtttcccctctgggaagcactgttgcctggcacttgagcccctgcattttgggctcatcatcctttcctgagctgcttcttgagtcctgttctgtggcaagctctctggtaggcactggggatacaatgaacaaatatcagtgactgaccttagaggaaagcattaaaaaaactaaaaagaggcggtacgattaattttgttgatattttctataacctaagatgtccacaatattgttttaacgtggcacttagccacatttcaggtgctccgtagacacgtgctggtagctactgtagtggatagctgtggcctagaggcagagctggacaagttaaaaaagcagttctgtgcacgtagtaagtcctgggctcctgttttcatcgttaatttgtgtttctctaggtgattatcttttgtgagttgtgaattccaagaaggcacaggcattgccttgtcctgttttcctcaccattgtgtcagtaataccttgcaggtagaaggtgctcacaccattttatccaatgaaatgctaagcacagggcattatgggaaaagctgagatgagtacctgccaccctatcgtggaggtgggaaggcatcagaggccttctcaggagagaggagtgtgtgcacgggctgggaagacagcagggggagggggagccacaggtagctcattatgatggaagcttggggtacatgtgaaagtgatggagaatatgaggagctgatgccagagaagcaggcagagctcagatgatcagatttttaaagcttgctaaagatgttattctgagaacaccaggaagccttatagtgcctgggctgggacctgcccctcaagccttcctgtgtcgtcttttttttctcttttttttctttttgagacagagtctcaccctgttgcccaggctggagtgtagcggcacaatcttggctcactgcaacctccacctcccaggttcaagcgattcttttgcctcagcctcctgagtagctgggattacaggcacacccaccaacacgcccggctaatttttgtatttttagtagagacagggtttcaccatgttggctaggctggcctcgaactcctgacctcaagtgatcctcccacctcgacctctcaaagtgttgggattacaggcatgagccactgcgcatggtctctttcttctttattcgtgaggtgttttctccctttacacttgctggcccatggaaggtgcttagtaagaatggtggctgacttctaatgcttccagagagcctgacaggctgacatgggtgtcttccactgtctgtggggaggcttagaaagaggagtggcttttattaatattatgagtgtggatcagatcctgctggagccaatggcaaagcctggagccggcccagattctgcgagagtgctaggctgcacggtcacagatcaaatgtgcttttcaagaatggcccctctcctgggatggggaacttagagctctgaggagcaccgtgaactggcacctctatgtgtgagagctgtgctgtctgacatgtggtctaagcttcgcgaactggtgtttctggcacagccctgagcacaacctcagtctgcccactggtgctggctgagcctggcctaggtcccgcgagtctgcggctggaagactggggaggaaaagtgatgagactgcaagagaaagataatttaattatgattgtcctgagttatttactgtttccaagtccccttttgtatcttgaaggaaggtaggaatggatcagagataaccacttgggaaaatacgagttaactccatataagaaatcttgattatcttgtatcggtaactctctactctttagtatggcaggaaagaatgccttttttatttaaataaacatttttagttttaggttcacaacaaaattgaatggaaaatacagaaactttccaaatacccgttccccttgacatgcatagcctcctcctttgttaacatcccgcactacaagtggtatgctggtgaccctcagtgaaccgacagggacacatcactctcacctatatctttacttcaccttagggctcactcttgtacattccatgggcttggacaaatgtataatgacatgattataacttctctttgtattgcagccactctgtcaaatgtctggtgccttgtgatcatttttccatttaaaattgccagcactaatcatgtctgtttttagcatccaataaaattatcattgtggcattagaaccagggcttacgattctgctattgaaaactggttcaaaaggtgatttcaggaaggctggaagtccagaatccattgctctgaggagctgtgctgtgtttctgatgataggttgttgcaggtttttatgatctaaactcacatggggtaataatggacactcaatagcagtagttattatgtgccagtagctgtagggcagggtgcttcatttagttttgataggatagcctgtgattggcatcgctatcccagttcacaaatgttgtctccctccagtcacaagtcaccctttgcttttctatgttgtttaagtgggttaaaaggactttttacccagcatgttgggaggttgaggcaggtggatcccctgaggtcaggagtttgagaccatcctgtctaacatggtgaaaccccgtctctactaaaaatgcaaaaattagctgggcatggtggcatacccctgtaatcccagctacttgggaggctgaggcaggagaattgcttgaacccaggaggcagaggctgcagtgagccaagatcgtgccactgcactctagcctgggtgacagagcgagaccccttctcaaaaaaaaaaaaaaaagaaaaagaacaaaggactttttacctttgtatctgttgtgaaagtcaaggtgtaattaaatttccaggtgtgattagtcgttgaacagataactgtttgagcgcctcctatgtgctggacattgtgagtgccatagacaactgccgtgtagtagctggtctataaacatttgctgaatattatatatgagagtacctctatctaattattcaaccctgcaaagtgggtattgttcctgctggtttctggagaagaaatctgaggctcgggaagcaataggacccgtcttctaacacagcttacaagctaatgatatttgggtttttccaaatccagagtggggttgcctccaccttgttagggctctatagggggaaggggtgcaggcacgataggagtccctggcaggcaggggcatcctggagccttgctggtaaccaaggagaacggagggttcggctggagtaattcacttcgctgcagagggctcacgtccagcaggtgctgtgggcaggagacagcttgcatgctgcaggaggaggagttggttttcagtaattgccaacaaacttctgcttagtgccatttggaaaccagtcttccacaccacactgagggcttgtctcccagaaacaggtgccgagggacctggcagaggaggcttgtctcccagaaacaggtgcctagggacctggcagaggcaatcagagtggcactcaacgtggtgctcgctgctagcgtggtctcagcacaaacatggtttaatgactgtattctctacattttaggctttggacgtggaccggatggttctttacaaaatgaagaaatccgtgaaagcaatcaacagctctgggctgggtgagtatacatccttccctagaggtttctgtgtggaaaatgtcgcatttgaagtcctggtaccgtaatattgatgaccattaacaaatgagccagctagactcctttatcggggcatgcagatcacagaggtgagctgggatgtttctttttcagaagtatgttttgttttgccagtcgtctgattcaggtgtgggatttcgtcccctgtcatcccctgtcatcctccgtgctgtctgtcccacgttgcacttcctgttttctggagcatcgtcctgcacgtacccactttgtcagcctggctgatgggggcctggattcattcctgcctctgtcatttggtttttgctgttaattgtgtcacagtgccctttccgtttctcttttacccagtcttgccttttctagtataggaagaaaatgaataaatagacaaacataaagtaatatttgatctagatttacacatacatattttttacacatatatatttacacatacatattttttacacatatatattttttaaacccatgcaacttttggcttaaagatgacaagtaggtcacctgtagcataccttcccttgtacaaatcctacgagtgatacaaaatattttttaaaagtcattaagtgactatatagtttcattcagcaacaaaaaggtggcatccttgcagggctaggaactgtgaggagtccctgagagactgaaacagggctgatgggttgctcaggggagcttgcccgtgctcaggtgcagatagagtttgggtgacagggtgggaggaggaggggcctggggtctgctcccactgaagtagtcaggtcccttcatctatactgtgtcccctcaccctcgtggtgtctttctttagtgaaaggggtgattggaacaggaggacagggagtgccttagatggttgtggtgtcaggagggaaggggaagagcctggaagtacacattccacctgctcccccccaccgcccccaccagttacaatagggcgggcacaagctccagttgccgctcttgattctccccccatgagagctgtgcaagccacaatcgggaagaatctagcaggaaatcccaggtgcaggataatgttacagttgagcattgccaagtgtatttaggaacaaatttaacagaagacgcacaggaatcctacatcaacaagtacaaaacgctgctgaccaaaatgaaagaagacctaaatgagaaatatgtgatgcacaggggttagaagagtcaccactgttagtgtcaggcctccccaaactgatctgaagattcaccccaaccccagtcagaattacagcagcggaaattgacaggccttttctaaaactgatacagaaggtggccatccgtctctagcttttttacctggattaagtgtggggcagggagcaataatgatagttttgatttttttgaacacttactgtgtatcttgtgctttctgtacattgtgctaatcttgtcaacaactgattctccttatacaaatgagtaacctgcaaatcagagagttctgggtgttcccaagatgtctgtgcagctggagctcagaccctgatggtcttactgctgtgtcagggttgtgtgcagtgagtggcccactctgtttcaaagccaccatgccttcagtgtgtctgtcacacgggtgacatcttgaagacttcagtgagtcactaagaaatggtacgcccagtttcattgacaagcaccagatttcaaaaagtatcttggaagattttttttttttttttactgcgttcacttggactttttgagtttataacttgagggatatttgatattctggtcagactcaaaaatgattttatagtcatatgttgaaaaggttgctcttatcagaaataaaaatgaaataatctgtgtcttatgcaaacactggctgtgtagctgctgctcgtctggaggagagacttgtgtgactcccaaggctggcccagtggctggcagtacagcttataaacagccctgcatttgaagggagaaggcgctagtgcttcggtgtcaggaagctggcctgcaggaatttaacagcacctctgtctaatttgccatgctgacctatattgctgagcgtgtaccacaaacctcattcctatttctaaccacccccaagcgtcgtttgctaaaatgcaaccccactggtgttacttctctgcctaaaactctatagcattttttcatcaccctctttgaagttcgtggaagtcagttccagagcatgggagagagaaggaaggcctctgtgggcttcagaattttagggcaattgggataaagatggttctcttaccacagatccatccaaagattttaatgtgctagtaatgtggattgtgagtggttatcgttcttaaccctttcccaattcatttgtcgatgaaactgtcactgcctcccctgatcaccccactgtgagcctcaggtgagtaaatactgcagagcaccagatgagttccgagctcttgtgcattgcctggactcaggccacctgtcccgaccctccccacctggactcctctgtgcccttctttgaaataacttgcagttttccccagagagccacgttttatgccttcttccctctgctcatgctctgctgtttgcttaaaatagcatttgccactttatgaaagaaaactgaggtccaaggaagttgagaagtttgttcaaagtcacaaagctctacagtgacagggctgggattttaacgtagctccttgggctcatgtcctttttgaggccccgcacataacagcctggcatgtgaccttggagggggtctcctatttttgtcatcctttagccatctattatgtcatgccaagtttgagttattctaaggtcatgagtctgagtcctgaaaagtcctaagtcctaaaaccagagcctgatcctgaaatctttatttcggaacaagcgttgtctactgcaaagaagtcacctgaggaaacgtgatactttctcctgtcatgttgctgacatcattcacagtgtctttagaactctttagaactgcttttagtagcacgttcttttgcatatatttagtagagaagtctaaggatagattaaatttttttagaactagatgtcagaaataagtcaggcatattcaagaagggactgagtgccagcgaccacagttggcttcggtgcactgtaactacagtcatgggctctgaaggcagctggttccaaaggagaagtccccatagtgttttgatcacgagaataaaggccaaaggcaattcctgtataggaagagcgctcattttatgtacgattgaaagaacagtgagaataaattagcatttatgcttcatactgccatattccttgtcttgtctcatgtttcttaatttctttgggaccaagatttcctgcctgctttcctgatttgtcacagattggccccatttgacccatctctgtaccagtgtccctcactgcaggctgctggcctgtcactgcttcctgagtgtgtgccagctgtacttctgtgtctttgcacagccccacccagtctgtaaacggactcccccatcccagtcacctgcaggggacctgcccttgcttccccacccattttcatcaagccttagctctctttgacttcagcgtagccctctttgactctcttgtaatagattcttttttttttcctctctttttttgagatggtgcttcactctgttgcccaggctggagtgcagtggcatgatctcggctcactgcagcctccgcctcctgggttcaagtgattttcctgcctcagcctcccaagtagctgggattacaggtgtctaccaccacacccaactaatttttgtaattttagtggagatgggttttcatcatgctggctaggctgatctcgagcttctgacctcaagtgatccaccagcctcggcctccctgtaatagtttcttattgctgttgtaacaaattaccataaaatgagttggcttaaaatggcacaaagttatctttcagttcggccatgggaaacccgacatgggtctcactgggctaaaatgaagatgttaacagggctccttccctgaggcttcaggggaaatcggtgtccttttcctgctcctagaggccacctgcattccttagctcacggctcccttccatcttcaaagctggtcatggccggtggtgtctttctcacactgcattgctctgacacttagatggctcgggctgctataacaaaataccatagattggtgggttaaacaacagaaatttattttctcacaggcctgggggctgggaagtccaagatcagggtgtcagtgtggatgggttctggtgagggctctcctctccttcctggcttgcagacagctgccttctccctgtaccctcacatggcagcgagagaaagcaagatgtccactttctcctcttataaggaccctaatgccatcaggagggcctcacccacttgacctcatctaaacctaattattatgcttcccaatggccccatctccagacaccattgccttggggattagggctttaatatatgaatctgggggaagggacgcaattcagtcccatagcaaacactgactcttctgcctccctcttctacatataaggacccttgtgatgacattggcctcatccagataatccagataatctccccatctcaagttcagctgattagcaactgtatttcatccacaatttcaattcctctttgccaagtagcataacgtactcacaagttccagggattaggaggtgggcatctggtggtggaggagacgttattctgtctaccacacctctcctgaattcttaggatttggaggttgaatcagtttccactgttttgttcagctacaaattaaagggtacctaacatgcaggcactgttaacactttaaatattgctcctgattgttctctagtagttttgtatctgttgatcttttctcagttaattagaagcccttgaggtgaaagaccaattctgggagatggtgtcatttaggataaagaagacgtaggtattagaatccaagaacccttgattaaaagctagcaatgccactcaaaaagcctgtgacattaggacgattattttacctttctgagcctcaatttcctcatgtgtaaaatgggaatttaataggtcataggattgctagtgaagattaagtgagataacatgaaaaagtgccatgcatggttctggacatacacgtggtaagtgtgacagctgtgacatacctcctgtgtgttccttgcagtggctgccatgggtgtgggcgggtaataggtgcccagtaaatactgagtgtttatacattatcaggttcctgctgtatgtacttacactgctttcttagtgtaggaggggtgaacttacaattttagatgtaagtggtgtgtgttacgacaggccctgtattctattctttgaggatttatatggatttatgtagaaggaagatttaagatgccttacaatggaggctggaaaactgtggccagacacctgtgttttcacagcctgaaagctaagaatggtttcttaccatcgttacctgcacaataacctcagtattgcctcagcaacccacagtgtgatggtctctggagatggggcctttgggaagtaattagctttagatgagggcatgagagtggggccctcatgatggggttagtgccctgcttaaatatttactctctgactttctaggaaaaagtttttgaatccctgcattagagcagtggttataaactggagagagtatcagaataccccggggtcttgttaaaatagggattgagtttctggttcagcaggtcagggttggagcctgagtattttatttgctaattgaaaaagctcccaggtgacggcactggactttgagaatcctacctcagaaccccccatccccacttcaaacactgaactgggacaaaagggtatctgcatgtcccacgtgtatacaaaacagtagtcttcttccacaatagtcagtgcattatgtttgctcccagtcttcaaaatgatggcaacccagccagctgtattttctggagagtcttagcttgggtttccaaaagcagttgtcataatgatttatgagaaactgtttgccactcagtgatggattgcttatttattttaaactcttacttgtctaaaatttcccaagctctggctcagcccaaaggtgttccttccacaccccaggaagttgaagctaacatttttagctgtttgacatatcagtgggtggaaaaattcatctctatcaagaaggaagcaacagaagattttcattttcacttctctagaattattctgtcataaggacttgttagaacattcttatcgagagtgatattcctaccctcaatcagaatatcctagaaaattatcacattcttgaaagtacaaagaaatgctgattttccctcaaatccttaccatctcccacatacaaaagaaaatgagaatacaacaactttgtgtgtgtgttcctgcctgttgtttgcagtgttaattggaatatgatattaaaatacacttcaaattcatacagaaaactatttctattgtagatattatcaattagaacagggcagttcagaacaaatatatataatagttgaggaaatgaagtttcactgtgcattaagaagatactggctgggcacggtgactcacgcctgtaatcctagcactttgggaggctgaggcagatggatcgcttgagctcaggagttgaagaccagcctaggcaacatggcgaaaccctgcctctacaaaaaaatacaaaaattagctgggcatgatggtgtatgcctgtagtcccagctgtttgggagggtgaggcaggaagattacatgaacctgggaggttgaggctgcagtgagctgaaactgcaccactgcacttcatcctgggtgacagagtgagaccctgtctccaaaacagaaaaaaaggaaaaggattttttttaaaaaaggaaaaaaaaaaatatatatatatatactgtatctgatttctacctgttacatgagaaaataacaaaatcagaataatctttactgtttggcaagcttacagtaactagtactctgctccattgttgtggcactgaaaacatgcacgcagagtttctggaaagcagtttggtggtacacatcaagaaaaataacaatctttttgtggaaggagatccatgcacaaagatgttcactttgttgttgcactgcttatcaaagtgagaaattggatgcctcctatatatagctgaattaggatttagctgcttgctggaattatgtttatacagcaacaggaagagaaatgcttgtgatgaaatcttcagcaataaaattcaggatgcaaaatttatgtacaccgtgtgtgattaaaaaggaatagatgataaatgatgataaagaatatttttattgatattcacaaacgagggtagaagcatagtggtaataaatactcatgaggtatttgttagaatatttgtattataaagctaaataaaaactttatgtgaattccatccttacagccttgtgagttgggtcctgtccattgacagatgagctcacagaggcactgagtagtgatctgccagtgtcatctagccaacagttggaggagctgagattcaaaaccaggtgagcgtcccgtctctgcttctgactgctgcggcatgctgcctggtgctgaggcgggaagttgctgggggcacacggtggagaaaacaagcagcaacgtggggaacaccctacgtgccacctggctgagccatcgtagtccttctgaaaaattccaggtggttttggttgattacagggtcagtgtgagccagtacgtggcacatgccccaaaggtgagccacacatgacctcagtgaagtctttggtgcttataaataaggttgttgtttcattatttagttgtaagagcagcatttaaagaagaacctgaaaaccttagggatggagaaacctccttgtaggacggatatctgaaggacgcggggctcctggtttcggaaggggcaggagagggcgtacatgaagggctttctctggctgaggaaggtagacatagtatttgttcctctctagaggaggctttcacaagagcaagccttgactcagatatgagggagaggataactgggtgagcagactgagcggcgagctggtggttggaaggttcctgcagcgggtggacggcctctgtctctgaggaagttatagagggaggtgaggacgtgggctcgaaggccctggagatgtcttccagttgtgagactctggagtccagccttctccccgctgctggctaacaacaatgattggaatttagatggtgacttgtggaatcctgtccgcagtgaccactgcattagtcatggaaggagggtacctctgaaggaacacagaggtctgtgacttaactaacgtccaagtgttggcatgaatcatactttggttcagaggtatctgctatttaatttggctggcttttatagtcagccagtctgtgggccaacctgctggccgcatgcatctgtaagacatggggctgcagtttcatcagtggttctttaatcttttggttatcatagacatcagtaaaaataagaaggctgttttggatgatccctccaggaaaaggtacctttacataattttgcatacactgtttgggatgcccatacccccataaacctgtccgcaaacccaacctaccaagcaaaaaagctcagaccttgagcttaaatcttctaccaaatcaacacgatgacttcatctgtttcctcatctgtaaaatcctgcagagttgtaaggatgaaagatatttctacacgtatgtcatctccacagtgttcatggtagctactatctgaggctttagagaccatgtactttccaagggctgcttgtccctgagggtgaggctccaggatctcgtgaaaccacaggagtcagcttgcttcccaggggctgtgccctccatggagttgggtgggggcagcgtgtgtttttaagtcatcactgtggtgagcgtggggtcatggggtatgacgtggcaaaaatgaagggctgaaagctgcttaccctggcaaaatgcacattctgtaatgtagcgagtcagattgctttgccaacatgaactcttcctccattaaaggatgtgaatataattgggagtaaaatttctaatagcttgtactccccatacaacaaatgttgaattcacctcttggctttgaaccccagacaccttggggtagcctgtctccaggctaaaggagagccctgcaagttttttagtgaaacccccttcccaccacctccaacccccttctccttccctgatttggtctcagagcacccctaggagggaagcagctctctggttaaggagagtctagggtgagtcaagcagctggtagctcagttttaatctcatgccatactacattttcaatgaggaaattcctctaaatgtcatctgctccaagaagccttttctgttaccagcccccagaaaatgtactcctttccccatagagtgctgtgtttccacctcgtgtaatttacatcacagtggattgttttcgcatgtttatctttgtcttgctaagttgtgtgttggcaggtaccaaggtttattatctttcttgaatgcagatctcttagaagccttttggctgctctccgttacctgggatgaagttcctcatctctggctcctgcctgactctccagcccttccccatgctctggacacaccaagcgccttgaattccccagagctcattttgtttcttgcctttgtgtcgctgcactgaactgatgggctgagtctttctcacttattggatgcttgcttcttgagggtaggggctctgtttgatgaatctttgtgttcattagtgcttgctggagaatagactttcagtgtgattggattttattctttagtaaccagaaatattcttgacccgtaatggaagcacacaatgaatgaataaaagtaaatgcggatacattctgtactctaaagcctaaagggacagaaaccatcaacataaaaaaaaatatgcagtagcccagtctccactcttcaccctctcacctgccttccaagtgtactcctacaagcagtaggagcttcacagggaggtcattggggtgacgtttagttattcacacagactttgaactcatttgaacatcactggaaggatgggatcattaatataaggcaggatcaaagaggatgggatgatcatagacaacaggttttgtattttaatagcgcacaccttggcctgattagtgaactccattgctagctgcctgtgctgaacacaaccagactagatacatcctggggtaccatccacaaagactggctgtttcttgaggaatcacattccaagggacttcctaggaaagatgatggaaatgggtattgaaagtggaacaagcccggggtgttggagaaggcggaggaagtggcaggaagaagccggtgagaggcatccttccagttgctcatcctgcacgggagctctcaggggttatgaatagggaggacattcttgttcaaccccttctggttgtggctacttctgtcttgtcaaagatgatacaggtatactcagttccgaaggctgtgtccctcccgtcaccttgtccagggaaagctttgggagagaaagacatattctaatgttatttatttatttatttatttattttcttttgagatggagtctcgctgtgtcacccaggctggagtgcacagtggcacgatctcggctcactgcaacctctgcctcctgggttgaagtgattctcatgcctcagcctcctgaggagctgggattacagacacctgccaccactcctggctaatttttgtatttttattaaagattgggtttcgccctgttggccaggctggtcttgaactcctgacctcaagagatctgcccatctcggcctcccaaagtgctgggattacaggcgtgagccactgcacctggcctaatgttcttaataggcacaggcacagagcactgtaacaatctagccattagagctggtgcttcagatttctttttaaagttttatttattccttacgttgttattataaagctaagataagcttagtttagaaaatttggaaagttcagaaaagcactaaagcaagcaagtcttgagcctggcaggatctcagtatctttataaccagcagaggctcaggtgagcgctgggtctgaggcccactgcgacttggaacacagctctgcctcttagaagttgcaggatcctgggcttgttcacactctgacagtctgtttccttgtccactcagaggagaataaaataacatctagaaagcacttggcctgggacctagtatataacagccttgcatatgacagtttattgactgctagcaagtgctcagttttccccaccactgttagcattttgatgtattatcttttcaacctcctctctacatttcactttttgcaaaattgagactaaatatctaattttatgtcctcccttttttaaacttggctttctgctcctaccatattcctatatcatgattttaaaagccaacataatattccattttgtagaaatactgttaatttaaccattttcatattgttggaacttaacacattttaaattttcactctttataaatgttctgtacacacatctctgatcaccttgattatttccttaggatagatttctggaagtgggattatccagaagaatgatacacattagtaaattggaaatgaaaatatgttttcagccgtttagttgggatgattctagaaataaagttctgaaaatggttctctctcacgagatgtccactaagtagagaccctgttaagaaacagggatgatgtttgatttgaagaaattgcattcccatgagatcatgcgccacaagtgaggtcggaaacaggtggcatgtacagccgacagccggaggaaatggtctccactgtgcagagttgtgcacaacatcacaacattcgtgtcgtgacacacatttgagtagtaatcgtcatgtcatccgtctagggagagtctccaccaggctgctgccatagagaacatatgtctctccttaaacgctcccttcgccgagctgtctgcatggaaggttggaatgtggggtgtcagcaagtgcttttccctctgcctgattcccaagtggcctgtggtctggcctggagcaggggtttggagggtctttgttgggtcagcaaggaggctggggctgggtagccatgaggctggtgcaccctgccttcgttctgttatgctggtgacagcacttggtgttcaggttaatggtacatgcacttgactggaaggttgtacattgtcgctgtcttcagctcttagctcttatctaggctaagagctgaagatagcgacaatgtcattagcaaatgaagaaacggtttttgctgtgggaggaagagcactggactcagagtcaggaaacccgagttcttgttccagctctgctgcaaactcactgtgtgaccttgagcaagtcatcaccctctctgagctttggtttccatgtttagactaggtcatctttcaggatccatggaatgaaaggactcagcagtgagtatagcagccctgaggaggtggggacaatgagacctgtgctgccctgtggcgattttgagagttgagagctggatgcagacaggggctttaaaacagagaaagtaggctgggcgtggtggctttgggaggctgaggagggtggatcatgagatcaggagttcaagaccagcctggccaatatggtgaaaccccatctctactaaaaatacaaaaattagccagaagtggtggtgtgcgcctgtagtctcagctactcgggaggctgaggcaggagaatcacttgaacccaggagttggaggttgcagtgagccgagattgcaccactgcactctagtctgggtgacagagtgagattctatctcaaaacaaaaacaaaaacaaaagaaaaacagagaaagtattaacagtgggaacacataggactccctggtattcccctggggctaatgcctgtctgtttctgtgatctgctccttctctactcgacaagtcttacctgtccttggagccccagttcaatgtctccttgccatctgagtcctcagcgcctagcacattgcctgatgcattgtaagtgatcagtgcatagactgacatatctttccccaggcattcatcccagccatgagcatatgtgtccttgtatctcaccccagcataccgtcacatccctgttgccgggctggaaatagtaagttttatgtttgagatgaaaaaggaggtgattgaaggtgagttggctgggggacgcccatcctctggcagtgctgtgttggtggcttgcttcctcactgtgctgtgggccacactgacctgtcaagagccgtatctacatgtgtggcccgtagagggggcgcaaaggagccattcttgtcctttttgtatccagcaatttttgctgaaacaatttgcactgggccttctccttgataccagtttttttaaataacagaatccagtaaactaaaaagcacacaacaaaacctagtcattgcctctaaactctgtatgtacacatgcatgctggcttcatgatcgatttctctgccagagtctctcagttcatccttttgcagggattgatgggtttcgtgcagtgaggtgggggagataaaggggtgatggcttagaattgagaagaaacgaagtcttgtcctagcatggtctctgtgactcagattcttattttccaaagtccctcccaggtcagtgattattggatctggatcattaatgagaattagagtttaagatacatttgaacaagggggaggtgagagtgtgagctctttttagaagaacagctttcacaattctgtaaataaaagctgatagacccagtttgagatctttccagaaactttattcccaagctatttattttaggttcctgttttaaggttgtttttggcaaaagaaaaacaaaggcactgaatgattttctgttctctagtaggaaaatcttcaccttggggtgatctgcagcagtgggtcagtcagtgccatgttaatcatggagggatggctgttgtcgtggtgggcaccgtgctaggtgttagaggaagacacggggcttatgggcttcagcaggaagcttcaagttcatttgcaggatgaaaaatacatctaaaaatccccaactaggccagtgcacaaagattcccactgacctcaactggtacagtgtgagcatcagaagacagtgctgattgcagtggatgaaagcactgtaaacgtaaatccatgagatgatgatggtgatgatgagccaaagaactaattgatcaccttggggttgctggggatcaatacatcgtttagaagatgtataaggacaagaatttttttttttttttttttgagaatagagtcttgctcttttgcccaggctagagtgcagtggtgcgatctctgcccactgcaacctccgctttctaggttcaagtgattctcctgcctcagcctcccgagtagctggaattacaggcatgtgccaccatgcctggctaatttttgtatttttagtagagacagcgtttcatcatgttggccaggctggtctcaaactccagacctcaggtgatgcacctgtctcggcctcccaaagtgctgggattacaggtgtgagccaccgtgtccggccactaatttttttaaaaagaaaaaaacttaacctacaccaggtagtcagttgaggagcccagaaggagggatgataaggagtgcttttgtatttcttggtgctggaacataaagtctactatcagtgagaaggccggctcctctctcctaccaagggctggaggaccaagggctggaggcagcctgcgtggtccataaagtgcaccgatcctcctaccaactctatggtctggggcaggtgacatgactctctgaactgcacttgattcagaagaaaatagggataataatagccaactcttagtgctcaggttaaactgaacaaaagacttacaagccacctagtaggcgttgacctttatacgaagtcccttccctttgggtattcacttagagcaacactgaggtccagtcctcctcttggtttgagggacaccacgaggctgcatagagtcttcagcttctctcctgctgggctttgcattcattgcccagcaccgtgaaggaggacaccacggcccagctcccctcctttgtcatctcttgaaagacccatggctcagaaagcagcgagcgagggagtaagcaggaccatggaggttgcgttcctgtttctgtcatgcagtagacagtgtgtagtgacagatgcctgcctgtggccaccagcccccttcctgaacccaatgaaactaaactgcccatgtcttgaccgctaattttgagatagtttaaaaatagtatgtggtttgaaaggacctatccttcactgttaaccacactctagaattataaatagagtaaaacagaaggaattattgatccatctgtgaaactggattttaaaaatctaaaaattagatacttttgtttgacaaggtaaactttttaacgatgaaaacaaacatcgtgtagtagagtaggagagtggactttggaatcagaaaatttgggtttgaatcccagctctgccactttctgtgtttccttggatgaattatttgatctctttgagccctaattgcctaatagtgttatgagaaataatacatgtcttacgaagtttagaaaaaatatatgtgaagtttgtgctttgaataagtgacgcctgttgctgctgttacttttgttagtgttattggttatgcgccaagtgtggtaaactgagtctctttacctgattctttcattcttcctctgaccttgagagcatctcccagcaggtttttatcctttatgtagctgacgccgcaggcccagcgtcactgtgacttaccaaggtcatacagatatttacaggtggacataggactggaacctagatcttctgagggctcctgaggagctgcgtttgcgggtgtgtgtgtgtgcacatgtatgtttctgtcagaatttgtttgctgaatctggtctcagaaattcatttaatttatctagaactctcaggctctttactggaatgttaaaaaagaaaaaggactcaaacagtgaagtgagttttcttttgtgtctgctagatccccattagaaccctctagtcccccaaatgccactggaggtcaaagacatggtgcttcccccataggatgggtgagcagaccattcataggtcatagggattggctcagggtccaggactgccctccaggaacaaatgttccctcgttttcccacattgtcaggcccagcctagccattggcgttagctgacagtggtctcatttccccgagaaggaattcgggagctacagaggggctttcaggatctgtcccttggtggaggagctgcagcactaaggctgtctctggtggagttcacatccaggttcacaccgcaggtctggctgccctgttgtgcctgtaaatagttgtgttatatttccagttgaactgatgaaaacatagaaattaggtagccatgcagatagaagttgttttattatagactggctggtttcctttgaaagtgcctgacctagaagtgagggaattatattcaaccacattaatttaccagaatcacctgtgtcccctcccccattcctacccacggtttaaatcagaggtctgagatgggacggtggtgtctagagtttggtgaaaatccatgcatgcatttggcgtccagcagggattgagaaccactgtgccagagacccagagtccagattttcactctttcaggtgctactttgaggcctaatgatagtaaaatgccatgagatgtaagcacctggtatgttttttctgctcaaacaacatgtgtgttgtctaatatttcaggcacacgacttcgtcgaagatgaatacaacttagtctgtcaactctaagcacatccgatgtatggggaacacatttgccagactatttcaatataacatgctgagtgcaaggataggagaggtgccaatgaaatacccagggtgtagggcagagtcatggaaggcttcctggaggaagcatgagtctgtaggatgcagaggagtttgggagggaagggcccctgggtagaggctgcatcctgagcagaggcactggagctgcaaagaccactgctgttgctgtattaaaaggagaaggagctgctgtgtggggctctgaatcagagtcctgggctgcaggctagagaggaatggggcatctgtggttgagtttctgggagggggctgagtctggtgagttgtgccatcatttggtgaaggaagagtcctcggagaggtggaaatgttgtgtgtccttggccatctcatctgatatgctgaggaccactggacgtgggcaagggcttcccctcttgcataccacacttgttctttgggatctgttgccggcaccacgggttgttgttgggataacgaagctatttctgttcctggtgcagcttgacttttctcagatttttcttctgctgatgtgttcagtgttattcacaaccgagaagaacctggtggggagtgagggtggcatgcctgagactcacagcacctccgtcattctgttgcagctcacgtggaaaatgaagagcagtacacccaggctctggagaagtttggcggcaactgtgtatgcagagatgacccagatttaggaagtgcgttcctgaagttctcagtgtttacaaaggagttgacagcacttttcaaaaacctggtaagcagctctgtgtatgaaatgctgcggttacttcagttgggaaagtggctcagtagaggatagttatggtttgtttgataaactaggaatgcatttcatagttccttgggtacccaaaagaattatgtttttatacacattgggtcagtttggaataaagtttaaaattgtaatttttactttaacaagacttaaaattcagctctgcaatttaaatgtacacagctatgggacaaaatgggtaaatgcattcgtcttcttaagggcctctgacttgaatttttaacagtttctaaactgtgtagactactctccttctggtaattatagtaggcatttaagcttataatatttaataaatatgtttcaggcccatcttacacagcaaggtaacctgtaatcaaagcacagaaattaccatgaatatttaaaggccttttgtgctcccaagtgtagaacctaaaaaaaagcaggactgagagcaatgcctcggttttcagccgtgggaatgcggtgctggtgcctgctgcctgtggctgctgcttggtgctgtgggtgaattgcgcctttcttgtgcctggcagctctgtgctatcctcgtgatggggacaacattttgaagaagtgggcagcccaagagggctgtttgggaccctgcccgggtggaatggaccctgggatcgctccagcttttctttcctgtttttcttctccagtttctcctaaaggtcagggaaggccaggtcaagaactcagtaatgctttctctgtaggccacacacaacagcatctttttcgtgtcctctgttaggaagctcataacaagtgaaaaacatagctcattcctgagatggtgatgacagtggttttgggagaccggccttagaaggggagaaatgagggagcatcacatgtgagttcctaatgggaaggggaagagcaggagcactcgggcccttgctctttctccccgtcttcacttatgaacatttctgtaggaaatggtaaaagtaaaaaactgtttctctgctcgagcttttcacttagaggaatttgaaatcccctggggctttggtcaagctcatcccccttcatccttatcctagagtggcggcccacctgctcagcagtggagccctcgccctgcctcagccccatgccctggacactggcaggcatgcatggtggggtctcatcaccaggtcgggaaagagtggagattttttttaaactggagaaactgcatgggcccagggtaaagatccgtagatgctgccatggagggcgtctcctggtagaaaagtcagttggctgcctgctctccccgcacctgggtggataagccctttccatgcacacagagctgcctgttagcttcctggtgcctcacacttcagtacagatgagcagcctccagcatgagggagaccagaaatagcagaaaaatgaacgtacgggaagactgggatgcagcatgctatgaaagaaggccagggacacaactatggtaagaaaatataacattaaaaatccaacaggaagggctggagtagaggaaatctctcagaaaatagatcaaaaagaccaaaaagtgggaaatagataaaagacgaggattaattctcaaggcccagcatccaactggcaggtgttttagaaagagagaaggttgtcatcaatgcaacaaatctaaaggcaatttctaaaaatggaacggaagagtctccaagttgagaggctcacaagtacccagcgcaataagggaaaagacctaccctgaggcatccctgtgtgaacttgcaaaagatcttaaaagcttccagacagcagccggaggattcagaatcagaatggtggtgaacttctcagcagcagcactggaaacgttatggcatggagcaatgccattaaaatcgtgaggaaactaactcagcctggaatgatgcccagccaatcaaagacgagagtagaattaaagatattttcagacatgcaaggcttaaaaactttggctcccatgtgtcatttctctgaaactcctaaaggatgtgttttagtaaaatgaagggaaaagccaagaaagaagaaattgagagtcaggaaacaggacccaacacaggaaagcaagcagtggaagggaattccaagaggatcatggcgaagggaagtcccagcggggctgccaagcagggggcctagaaagcagccagcccaggacggctgacgacgtaggagacgggtggaggcccgggttctgcttctcactcccagactgcccttttacctttattcagctgatatctagacctggattgtctcagctgtaacatggagataataataccatacctgattgtgtggatagattatagccagccggtgactcttacacaggatagcttacttaattcttatgacaatcccataaggtcagtcaatgtcatccccactttacagattagataactgaggccctgaatggtttgaagagctaatatctggcccggcacagtggctcacatgtgtcatcccagcactttgggaggccaaggtgggcgggttgctttgaacccaggagttcaagaccagcctgggcaacatggggaacccctgtttctacaaaaaaatacaaaacttagccaggcgtggtggctcacggctgtagtccctgctactcgggaggctgaggctgaagaattgcttaagcccaggaagcggagattgcagtgagctgacatcacgcccctgtactccacctgggcgacagagagtgagaccctgtctcaaaaacaaaagaagcagcagctaatatctctctggaggggctcagagtccttgcctaggcaggcccacttggagcactccacaccatggaatccggacgaaactaacttgtctcagttaacaaaagggcagctgcatagttaaataaaaggaatccctccttctcctttataaaatttcctgcaaaagcagaaagcagagcagggcctgcatgttacagctggtacattgctcaccaccctgtggctttgccagtttttaatacttcacatatcactgcaggtcctagttgctgtccagctttctacagagagtaaaggtatcaataaaggtatctgtggcagtgatttgatgagcacccaccggtgtagcaatcactgggctatgcatgaaggatactctgtttcatttattcctcttggcagctgtgcaggatagtttgtatcaccatcctcttaaggcacacagtcacttacagggcccttagctagtgagggacagagttgggattcaaacccaggtattaacactccaaacccaagttgttgtcattgtgacatttaaaggaaccatggcctcttgtcaccttcttgactgatcataagggttcaagtttcaacttgcactttatggaagtcggattgttgatcctatttcctggcaaagatcaaagagagagaaaatttcttacatgagccaaaattagcactcaccatgcctggttttccaggccagcgccggtgtggaagctgcacagccagaggaaggcccagtggcggctcctgcaaagctgggcaaatggggagcggattatggcggaagtctccttttttggaattttgtgcaccattcttcttcctgtttttggtcacatctggcttatctcatatcttccaagccttgcttttgctttccctcgggcatttaaaacatttcagttctgtctggctaagactcacagtgctacctcttgtccagaaagaataacaattaccacctacctgcttggaggcgtgaaagaatgtttataaagcagttggaagatctccagagaaatgccagcttaatataaagcaagattttcttactaatgggtgagattctcacctgcagaagtctgtgaattttctctgcggtgatgcaggatgaaagggaaaaccagacggctccagaaatgtgacatgtgtgaaattaaagtgcttatgaagtcagcctagtttcaggggttcttttcctcttccccaatggatgtgagaatcctggaaagactccaagggccacctctgtgctgagaagtggctttctaatgaaaggctgcatttcagggcaggtttctgaaaggtttgttacagatatgtagtctctgtctccagtgttagaggattgttagtgaaagatgtcctcacggtctgcagaacccgctccacatgaagatcagcatccattgaaagcaggagccaatgggtgctgaggagaggacagagttgcagcatgagatctgaggtgaccctgggctaaggagttttccctcacccatgttgatagaggaaatggaaagctctaccaagcaacgtgtgtatccatcatctttttttttttttttttttttgagacggagtctcgttctgttgtccaggctggagtgcagtggcacaatctcagctctctgcaagctctgcctcccaggttcatgccattctcctgcctcagcctcacatgnnnnnnnnnnnnnnnnnnnncgcccggcctttttttttttttttttcccaaacacagatgatgtgagttagaagcctttttttttttttttttttttgagacggagtctcgctctgtcgcccaggctggagcgcagtggtgcagtcttggctcactgcagcctctgcctctcgcgttcaagcgatccttctgcctcagcctcccgagtagctgggactacaggcacgtgccaccatgcccagctaatttttatatttttagcagagacggagtttgactgtattggccaggctggtcttgaattcctgacctcgtgatctgcccacctcggcctcccaaagtgctaggattgcaggcatgagccaccatgcctggccaactttttttgtttgtttgtttgaaacagagtctcactgtgtcgcccaagctagagtgcagtggcacgatcttggctcactgcagcctccgcctcccgggttccagctattcttgtgcctcagcctcccaagtagctgggattataggcgcgagccaccacacccagctaagttttgtatttttagtacagacggggtttctccatgttggccaggctggtctcgaactcctgacctcaagtgatccacccgcctgggtctcccaaagtactgggattacaggtgtgagccaccacctgtaataccaaagtactgggattacaggtgtgagccaccacgcctggtcagaagacattatagctaaccttactagggaggtagtaaggttctgttgggacaagcagtagtttgtggctttctcatatgtgctgcacctggcagaggggcatcctggcttggctgcattggtactagtacagcaggactctgcccagtgctgtcaggcttaggttaagtgtgagctgattgtccatattagtaaggcttgtctcgtcactcaatatagacatcttgctaccagaggtcctcaccctcagtacttccatagactttctcctaacttcttgtattgcaaatgtcttagattcttaaatgtcttactttgttttttaattaaacaagagcaatgatcatagtatcatctttttgggaggaagatttaagtcactgttttagacataaactaatgaactatgctgaaatctagagacatccccagtggcttggggtacgtgggaatatccgcccttggattagtcctggactattattaggtgtccgtttctgacatttgctttttaatattctgacactttttctattggttgccctttttcctgctgtcagtgcttgggtgcctctaaggtctctgtttcacgatgctgcgagctgaagagcaaggtgacttggcttgttagacttgggtgcaaattaggagtccataggcttcgcttgaggagggcttgagggctagggctttgagtgaggaggggagagagagtaccttgatggacttgctgacagtcgctttgggcccctagaaacctctgccatttagattttggcatggcctcatttatagttggaaattccttatctaagacccaaaagacttcaacgctaagctatgttctatactcacaaatctctaaccaaaaacaaaagcacattgtttgatcgagacaatgaacaaataaggctggtgtcagatatctacattttggttgtggcatagccacataatagatttccattggacttggatactgtttctttttggggttgggagggaatgctgtgatacggtaacccccatacagagaaagtgggagaagccatattgggcaaagatagcatggtgaggccttgggcgtgggagggagaactcacagagacgaggactgggcacctgctgggtgctatccatgcgctggtgctgtatggggcggtgacctctggcaactcctgcctgggcaggggacacagatgcttttattagaagacatgtgccgggacagccactggcagcctgcggagccctgagggtacagcattggaagcagggagcagtgactccccgccctgagccctgggtccctgcttccctggatccctgagggtggaggggcactgcagtatggcacttgtccatctgcacacaagcctgcttgcaaggtttagaaatcagtttcttcacaattgtcaaatgtgtgtaggacatgctgtttctgtttgaaagtattaatgaacctaaaacagggtttgtttttgtttttgtcattgtgtgttttcttaattgctggctattaaagggacaactgccacgatgtaggtgacctcaaacttagaaaaaaattgtttgccaaatctacaaggtactgtgtggaatggctctagtggggatgtagatagggggtggaagggctgtagggggtgtagatatgcggtggaggggctgtagggggggtgtagatacaggtgggagggctgtagggggatgtacataggtgggagggctgtagttgtgggggtgtagatacagggtggagaggctgtagtcttgggagtatagatattggtggagaggctggagtagtggagtatagatattggtggaggggttgtagtattgaggtatagatattggtggagggggtgtaatagtggggtatagatattggtggaggggctggactagtggggtataggtattggtggagggggttgtaatagtggggtatagatattggtggaggggctggagtagtgaggtatagatattggtggaggggctggacgagtggggtgtagatattggtggaggaggttgtaatagtggggtatagatattggtggacaggctggagtagtggggtgtagatgttagtggagaggctggagtagtgaggtatagatattggcggagggggttgtaatagtggggtatagatattggtggacaagctggagtagtggggtaaagatattggtggaggggctagtgtagtgaggtatagatattggtggaggggccgtaatagtggggtatagatactggtgaggggctgtaatagtggggtacagatattggtggagggggttgtaatagtggggtatagatattggtggaggggctggagtagtgaggtatagatattggagggtctggagtagtgaggtatagatattggttgacaggctgcagtagtgggtatacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatccactcacacaatcatatcttcactcacacacaccctcacacaatcattcacattcacccccaactcacatccacacacacaccctcaaacacacacatgctccctcacacacctacacatactcacattctcacacacacatgtgcattcaccttatactcagtcacttacacccttacacacccacttacacccccacaatcacaccccacactcaaatccacacaatctctcacatccacaatcacactctcacacacccacacacccgtacacaatcacattcacgcactcacatccacaatcacacccacacacacccatacacacatttacacacttacacaatcactcacatccataatcacatcctgaaaccctcacacgcccacacacacccatacacaatcacattcacactcacatccacactcacactcacatccgtacacaatcacaccctcacacacccatacacaatcgcattcacacactcacacaatcacacccttagtcccttaacatgctccctcacacacctacacgatcactcatacccacattcactcacatacaccctcatgtgcattcactcttatactcaagcacagtcacacctttacacacccacaacaccctcactcagtcgtacacactcattgacacacactctccgtccccaacacacacacgtcttttctcattcgcacccagcattcgctcgtgtgcctttgcagcagacagaagactctgcctttgtttcccctgcttggagcttgctgtggagactggggcctggggcccagagcaccaaccccagtacagtccagcttatgggtggagccgtgattgagagtcagaagtgggggtttccttttattctaggctttcgacgtaattctgtcattgaatgttttgaaatattttttcttcactgcaatgattgtctctttacaaactttctagcataacaatataagattgttactgtgaaatatatacagacctagacttttcattagccctctattcatttgtaagatgaaattgttacaaagaatgtatgactgaataaggcacagtacatgcaccggccaggttttaggtggaggtgaatcattatcaaatgttctctctaatgtccttgctgtccttactttagattcacaaggaagctgaataagaatctcctttatgtttttgttttttagattcagaatatgaacaacataatctccttccctttggacagtttgctgaagggggacctgaaaggagtgaaaggggtatgacattgacactgtgacaccaggggcagcttttacaccatgtagagtcacagtagcttggcctgccgggcagcagccacgccagtacgttctcattgggacgataggatggctcttttatctcagcttcctctgatttgccatcttgggaccacctttcagccaaaaaggtggtgacttctggcctttctggccgtcctgttggcacaacaaagttggtgaggggaggagactgggaagggaaagaaaactgctattttggaaaaagtaaagagtttcggtctctccagggagcagggaaacctgtgggaggagtcgggctttctagctggcacgttgcccatttagcactgggaaaggatcctagcaagggtgtattttcctgctgggaaggtcgcagtcgtcaggcatgagccaactttgtctctctgtccttcagaggatgttggctgtttaggacatgcctagccaccataagcacgcaggccaggagctgtttaagggggcagcagacggggctggaggggcgtttgctcatgagcacgcaggccaggagctgtttcgggggcagcggacagggctagaggcgcgtttgccaggcagcgcgctgcccctgcgcatcgccagccctgacagacgtgcaccacggaagggacgtgattgtggctgccttctcgggagactcaaattctttggatctgcgcacgattcctgggtcccatcggggatgactggaaacccagtcttgacccatctccaggacctctacagaggcctctcagggtctccttcacagagtgtgcccggagagagctgttcagacacattccccatcgagccttcaggggcttggagaacaggtcagcggagttagcccaactcacgggcgggaaggcatcccaggcagaggaaaggcgcaggtgcgcacagggagcagggctcagtgctgcatgtcaggctgccagggtgcaggaggagccagttcgtgcagggacttgtgtgccaggctgtggcacttgggccttacctgaggccattgaaaagccaaaaagtagtcaacagcaacaacaaaaagatttctgtctccctgaagaacccctttgaagggagcataaataggtgaggaccattcaatagaatttccagtggctcagtagtttttgaggcaggctttaccagagtgtatgaagtcctgaattgcacacggaagagcagtaagagaccctaggaggatgtggcggcctttctatttctgtcgttgggcttaaagcagggttagatgtgatgagattcatctatcaattagagttcctttcttttagagagacatcctgaagtatttgcagatgaaaggttgtctttcaggatttactttcagattaggcccagggcagggagtagggcacaggtgacacaaggtggcccaagagtgtcataactgggtggcagcaccttgcttttgtgtacatttagtatattctatattattttaagagaaagaaaggaaatgccaccactggtctacttaaaagcatgtactcttggttctttatttttcgtgggattacatacgtcatttattgcagaaattaatgctcctttcagggctagtacagggataagtaagtttatcttgcacagaagtgaatgattagtcttgcctaatttattattctttgtttacaggatctgaaaaagccttttgataaagcttggaaggactatgaaacaaaaatgtgagtgttctcgtttttaaatttacgtataggtaatttgggatttcaaatttaaaccaacctcgtattgcttaaagggattgtccaaataaaccttaatccagaaaagaatgtttatcagccatgttgctgtggttcattttgatgacagatgtgtttggtgatgctgtcttcttcttctaatctgttttcttctgttcctttgtctaagatgtcatagtggttataggatgttattttcaggaaagttcattgagggaagttaagaccaatttctcttaggaggtatttctttctgtttttgtttttaaacactttgtccattccgttactgtttttgatagcagggcagttttcagacttcatcttcctggtgatttgtgaaagctgcttagctttgtatctgtgtttctctgaaataccagttcccttggttttagaaagagggttcaatacctgtctccttcagattcatctgccaaaaaataacctgaagaatggagaattgattcttggatgtgaactacggtttctacaagaagtagaattggtttcctgacccgaagtcaaccaatagacaagactctgttggttgacttcaggcagttgtaacttccccaatcacagtttctcatccctagagtagagagagtcgagctacagggaattgatcaagcaagtaattatggggggaataatggcttcaattattttaaatactggaaagatatgaaatgtggtgtttactttgtaatctctgtgtcttggagtgctctgaatggaaatagaaacttccatatgaagctatctgttaaactaaaaggtgttatgaggaagtcatttcaaatctaagtacaagtatttcattagattgtttaaaaaaaaaatagctcaggatatctttccagtggtgaaggatcacaaagctcaaatcagtgagccccacacctttgatactccttctatccatgggaatcttacatttccatacccgaggttgcttggccccgagttctggagtttcattgatggtgtacattcattcagaagcacaggcagagtgttgactagagaaccctgcaggtccattcagcccagggaggcccccacccaggatccctggtccgtcagcatcctttatttgtgtgccagttgggtgaaataaatgggaagggaccagcggattcctgctttgcagagggaaaaccaagagtcagtggtttctgcttgtcagccagtaagagtaattgagccaggccaggaagcagctttcccacttcactcagcctcccttgctgcccgtctctgtggctgataggaaatggtcctgtgtgtgactagaccaagggcagaaagggctttctgaagaagagtgcctgagagagtcatctggttctgaaaagaaaaggtttggaagaaggataacatcaaattctgtaaaatcgagacacacatgggtaggatggggacagaattcctcacaaaaccctagaatttaggaggagggagcagcaccctttaaacttgaagtaattgtaggataaataaaggaaataattctttattaatgtgggagattcatttatcccaagaggttttgtgatatgtaacaaccataataggttttagatgtctttaaaattcctgggcagtagtcccatacctgattattaagagaaatgaccagtgtctggacggtctcttgcctgtgaaggagtgtcagcgacaccttggagttgtataattctagtcccagggaccctccagtcacactcctttccggatgcatagactcattaaacaacaacatccctcccaaagggtctcctgtgtgtttatttttcactcattcactccttcaaattattgagaacctacacagtgcaggacacacagagaaatcacatttcttgcctcttcttaaacactctagtcctccttgccctaatgacagggagccctctggaaccctgagtagcccatttcatcactggatgcctttgaaagaacatgctacttgggtcttctggtgtctacttcaggctctacagaaagagctgcttcccttgtcttcatggcagccctttctgttttttgagtgctttctgttggttttgtttagtctccttttctccagaataaaaactcacggctatttcaagcccaccttagcagccacgattaccctggtggctcttctttggatgtgctcattggtcagtttttaccctgaactgcacactcgacatttaggtaatacaggttaggcacaagatgaatgtagaaaggataattaagccgacagcatggaaaggtggttggtcgtcttctacagtgatgagcggtgttgtaggtcaaggcagagagctggcctggcttcactgagtgaggaggtgatgacagagactagggaggaagtccaggaggagaaacagtgggtagggaagagtcagacggtgcccttgggttactagagggcaggaaggctctgaatgctgatgccaaaggagccctccaagccctgtgcagacttcctacctcctctgacccatacctgactcaaagcaggtgcctaggaaatacttgttgagtaagtgggaagacccggtttgacatcttcgtgaggacacccattttccttttgagggagttgagaggctgcctgtgctgaaacgtgtggtgagcgttggtctcgccaggctgggtactggggtggcttcaaggctgtcccgttgagttctgtgccaacaggcatcttgatgtatccttgctttcacacgtagaaccaagatagaaaaggagaaaaaggaacacgccaagctccatgggatgattcggactgaaataagcggagcggaaattgccgaagagatggaaaaggagaggcgcttcttccagctacagatgtgcgaggtaaggcggtggtgaaggcaggtcctacagcccaggctgtgccggctctgccctcacctgtgggagcatctcactggtaccagcggcttcagagaaaacaccacatgcattgctggactccctttgcccctgtgttgacatttcttttactagggaagcgttagcctcctggagggtagaattaggttactttaacaccaacattttcttaaaagtagagaaaaaccactaaatgtctagaatgttctttctggcttcacgtacgtactcttgctaaaatatttattccttgggtgtatttaaatgagatctctgagttcccttgtaccaatggagtcagtgactggcttgtgggagggtgagaagtcagctgaaaacaacatacagcgatgacagaccatggcctgtgtcagtgtctgtgagtggatgggaagtccagtcacctgttttgacttcctgctagacctcacctgctcaggcgggggcactcatctagcccgaaggcccaggtggcctggggagcgcctctctgctccactccattccacccgcagcctcagcccttcccttagtgaggcggagacagcaggatggacactctcagagcatttctctgagatcagagaccatggattatgaaggcctttgctcacagattttttatttttgtgccttgcttgccaggtacgtgtatacaaatggcacatggaaacagctgccacctctgcctggggttaattcctcctggcagtgccagcgaagctcccttgcactggatggtatttgtttccctctcatagcagtgcaaacttaggtttcaaatgtacacaatgtgtgggtgatgtttgtgacaggcactgaaactggcattggccagctcttaattccctctgagcaatcaacaacaaagctaatccagaaggcactttctgattttggaatgtatgtttgttaattgtagcaggagcttaacccttataaatacatatatcttagaaatgtatttaaatgagtttttattcccagagcagactcttaagtggtcagcagagaggaatcagtcccaggaatcagggtggcagttgaaagttaagtccattttgtctaatgttagaatatctacttatcttagcctgttttctgttgctataactgaatacctgagaatgggtaatttataaagaaaagaaatttcccagttctggaggctgccaagtccaaggttgaggggctgcatctggtgaggaccttcttgctggtgggcgctctgagagtcctaagtcagtgcaggacatcacatcggtgggggcctcacaagagacagccaaactggctttttaatagcagacacactcttctcataattgtaccactcccccagtaatccatgaatggattaatccactcatgcagtgacctcccaaaggttctaccactcaacactgctgcattggggaccagtttccaacatgtgaacttttaggggacacattgaaaccatatcaccactccagctcttttggttactatttgcacccttttacattcaacctgtgaatctgaagtgtatcacttatagataatatatatagctggatcatgtttttcttatcagtttgacaatctctgcctttcgattggattgtttaatccattaacgttgaatgttactattgatatgattggatttacttctgttattttacttttttttatgtctgtctcgtgtcttttgctccttgattcctcctttaccgccttgtttttcattgagagaatgtttagagatattcactagatgaaaaacaagcaaatatttttaaatattcacttgatgaaatgaattctcaagataaagcctttaattaaacttaaagggttcttatagacaggagaatggatgtttttatacacatttttttgtaaacacatatcatgtgtagtgtaagaggttgcattctcaaaagaaaagcacataccatgtataataccaccttcctggcctacctcatagagtggcagagaaatcagcgagacagcatgagacagggactaggaaactgctgtgtgttatacaagcacaaagtattggtttttgtttttgtttttctcaatcctgcttctgtaagggtattgtttctaattaagtactgtagtagcattttacaaacaatcagggtgaaattaagtagtagtgttttacaaagaatgaatttggaaaggggtgtttgtgttcaggtcatgctctttttggttagtaaagtagacatctatttacctaaacactttaagactacttaaaatgcgtactgaattttgacattcaagtagtatgtgaaggtcatagccatgacttgaggagtaattggttccccacttggctctgtcgttgcttcctgtggtatgcaccttgcactggttactacttctcttctgtatccaggtgaattgatcctgtgaactgactaagtcatttattttaatggaaatacactgtgtagatgatgcctctaagtcatagacttgagccatctttcgagcagtcctcaggtagtgctgggtcctggctctgcagagctggcacttggaggggtcaggcactaatgtttcacagttgagtgagagctgtactatatgcatgcataaaagcagaggtgggcttatctaacagtaaactcacagttttcacaggagaagacatctgatgaagagtgtagaagttggccagatagtcatgggccgtgaaggcctttctttccatgggtgagaaagatcatttgaaaaacagttccttgagaatccaactctgaagtgaattagattgcctgcattaaaatcatgttaaaaggccgggcagggtggctcacacctgcaatcccagcactttgggaggctgaggtgggaggattccttgagcccaggagttcaagaccagcctgggcaacatggtgagaccttgtctctacaaaaaaacaaaaacaaacaaacaaacaaacatgactttaaaattatttgactgtttccccaaactgaagttctcaagctttaagtgcttgctgttgtttaggtgtttaaaatttgagttgcccaggatctaatccagaagagtggctttcaggcttttattttaaagctatggagccctttcttcaaaattcatttaataaagaaattcagtatgtcaaataggtagtacagaccttctgtgagcggagaaggcgtgagaagatcctctgttgctgattgtaaaaatagtatatacttttaaagaaaattggttaatataagaaaatatatataaaaggaattaaaaatcgcccccaaattttacttatccaaagataaccactttgacatttaagtaaacatctttatatgtccctatgtatacattcaaaaaaaatcgtataagtagatctttcgctgctgatgctttataacctattttcactctctagtatgttgatgtccatgtcagaaattttgggttttattggcttagtggccgcacagtattttctgtatggatgcaccatatgttaatttcccactcattaggtttggactgttgccattgtttacttttataaacaggatagcagtgtatcttcttttctgttcatctttgtaaacttttgtggttatcttcttagaataaattcctgggagtagaatttctaggtcaaaatgtacatacgtttaaaaatttgatacattaccaaatatttaatatcaaaaagaaagagggaaagaaggacctataggtggttgttacaggcagaaggacaatttgtagcttacagtttcacagcagctttccacctcctccttgggctgcagagagacctcagccagcaactgaacttgggtacccctaccccacccccgcccatcctttacagctgagagccagggcatgaatcagcagcttttccaggggacattccatttcagagatcatcttctgacagcggaggggatggggactcatgaagtccttctatttcctgacactggttttgtagctccctgaggctttctgatagcttcgtggtcactaatgaattctccaagttaaaaatagctttaattcatttcaattaaactttgtttttttccaacaatcacattattttccttgtaagggaaatgtctcaggacgagagacatgatgccaagcatctcagctacaatacgttagcagttattgttcctaaagtaagggaccttgggcaggagtgtgtttgagatggttagaaatcccatttatttgaaccatccatagtcttccatgtagctagagtgaagatttctcctagcaggccaggatagactgtcttattattaggagtttttggcacttcaatatttaattatctgactgtcagataattcatatggccccaaaataaagaaacggttacggaatccaggcgatactaagtgtcgatcatgcactctacgcattgtaaaagatgccaaagaagtagaagaaatcatctcagtcctcagaagctccttttaaactcgtattctgcttacttccatgacatttccttttcattgttcaacagtatctgctgaaggtcaacgaaatcaagattaaaaagggagtagatttacttcagaatctgatcaaatactttcatgcccaatgcaagtaagttcttctctgttatgttatcttaaatgtttgttcatgtgtggcaacttctggtagatctatagatagctcataggaaataaacaccacttagaagtctatagtaaagggaatgaggtgctgactcatgcgacaacacgggtaaacattgagaacacgttcaatgaaggaagccagacacaagaggccatgtactgtatgatcccatttatttggaaggtcaggaataagtacatccacagagacagaaagcaggtgagtgattgccgcagcttggaggaagaaggaaatgggaaatggctgctaacgggtatagggtttctttgtgggatattgaaaatattccagaagtgagtgctaatgattgcacaactttgtgaatttactaaaaatcactttaaaaggatgaattttatggctttatggcttagggattatatcttaattaaaaataaaagcatatatacaacataaaaaatctgtagtaattgccagatatatttatttttggctctttttgtagagggacaaactcatttgacctattccgcaactctcagatgtttgttaaaagagaaatgatacgatgttaatgcagtgttttaaaataagaaaacacttttatatattatcctgtggagccaatgactgtgatgagcaaaggaagatgttagtagaggagaaggagaggattccacgtgcaggggctgctcaagtactcagctttgccatctgtgtcagtacttcagtctgacccacgtctctgacctggcttctgctcctcgacccccagtcactgatatagacaggcctctggctccttcactcacccacccaacacacatgtcaggtgctggaccagaggcgagagacacagtgatgtacagtgctggcatagttcctactcaaagagtcaagtagggaagttagactgaaagagacaaatttctaattagatgtttacaaaattgttttaaagtataggaatctaagaaagaatataatacagggacctgatttagataaagatttagggtagagttttttgttttttgtttttctattttgttccctgatacagtctccaacagccagcacacagtgcccggaacacagtaggtactcggctgtttcttgaatgagctgcaggcctctctgaggagacatggatctgagatctaaagtatgagtaggagccggcagataaggagtgggggaagaacattccaggcagggtctaggtcttaaggcaggaaaaaggccaaggtgacataagctcagtgaaaaaggagagtggcgtgaaacgaaactgcatggaaaagccttagggatgtggatggccccagacatcttgcaaaagtttttagattttatcccaaatatgttgggaagctcttgaagaaattgaagcagaggaccatttgtatgcactcctgtgatctgccaggcgctattaggggttttggtgatgcagtaaggaggaaaacaaagttcttgccttcacggaccctggggtctcatgggggaggcaagtaggaaacacgagccaatatttaactgagtttatgaaaaggcaaaacagtgatggggagagagacagtggtgttggttagaagcagcttcaggaagcttctcggctgtaacaagattactctgtgtgttgtggagaaggaaccaaacaggacaagggtggatgtgggcaattgcttgtgtacacagctcctgtccctgtgcagaccagagatgacgatggcccacctggcttcgtgacagcgggagtggaaggtgtggactgacaagaaatcttttccttgtggaattgccatgcctgtctgcttaccttcccagagcaggctgtgccaccagcagcctacctttgtacagaattgtttcttttcctagaaggcctctttcctttgtgccctccctgtcttctgttcctcctaggacccagcttatggatcattcctgctttgcgatgcttcttccttttggaattccttttcttcctcctgtgttgccaccacaccgtctgcttgtctccatgatgacatcttccttgtgtctctgtgccactgaactatatgctcttaaggaaggggccatgccatttatttgttttatatctacagtgtgtggcacatttacctggcacgtatttgcagcagtgaattgcactgtggaattgaactgagctctgctttggaattcttaatacagctttgatgatgttgcatttctaaagcacttgaggtcaggcggcaaaggaggatgtgctgagtggttcatccaaagttaaaagagagcttcagccatttaaaaaaaagaagagtgaaatcatgtcttttgcagcaatagggatagaactgaaagtcattatcttaagtgaaacaagccagccgcagaaagacaaatatcgcatgttcccactcctaagtgggtgctaagaaaggcatacccatggatgtagagagtagagtgacagcagagtctcaggagggtgaagggagtggggatgatgagaaattattaatacttagtaggtacaatgtatgttattctggtgatggataccctaaaagccctaagttgaccaccaggcctataacaaaactgcacttgtaccccatgaatttatattaaaaaatataaaaagagagctcatctctacttggtggaaaagaccttgcaattatatagttttcaagatgaattattttatggagactcaaaattcttactttgtgatgagcatgcaaattacttctacagttcttatgtcaggcaatttaggaagtgggtcgcttccttgctgatattttatttttaagaagaagctattctgggatttccttcccccgcccctttattttgcccaaaccagtcagttgggtagcaacagaccacttgtggaaaagtgaagtagttggccttttatggacatgatctcagtaacctttaaaaatatgaatcttccattacttcgtttttggatatgagagagagtgtgtacgctgcctgctcttcaaatcagtcaggcagctttgactttctcaattcacattctggagggtacaacgtggagctcgagcaactcagctgcagagtaagagctcgcagccgtgcgtgtttccacgtgtgggagcgcctctcattcccccaccacacacgcccagtttccgcttctcgcccccaagggcacagctttgcctgctgggtgctgtgccctgctgggcacacgcgggcctctgcacactgctgtgctccgccagggtgaagaggccactgtgtaaaccagattccagggctcaggtttggctgttgacccttggaactacgtagatatgcgttattttgctttttcttctcgctttaagtgttcttaaagaatacttcgtgttcttttatttttatttcatttaaggaaggaattttcatctctacctctttcctggaatatcttgaaaacttgtcttattagtctttgctcctgaacattgaagatcctgtactctagcggaatctagaagtagggcattataacattataaaataaagacagccatggtttggcaaggcatggtggctcatgcctgaaatcccagcactttgggaggccaaggggggcggatcacctgaggtcaggagttcaagaccagcctggccaacatggtgaaacctggtctctactaaaaatacaaaaattagccggatgcggtagtgcacacctgtagtcccggctactcgggagactgaggctggagaatcacttgaacccaagaggcggaggttgcagtgagctgagatcatgctgctgcaccccagcctgggcgacagagcgatttttttttttcaaaaaaaatacaaccatggtttgaaaggtggtgatgaatgttgaattgacttgttctttgagccaatacctgctggaaaccactgtgaccagctgttgctcagtgaacttggaatgcatggtcaagataaggctcagccccggatgctgcagaagcttgcagaggagggaggggcgggtgtcacagacagaccccatcagcagacaccgcattggaatgtggtggcgtgaaggctgcaggaggggccctggcacggtgtgtggggcccagagaagaaaggagctactctgcttggtgggtttgataattgcctctaagtgggtgtattttaaaggatagaaatacaccccttctagcctggtgaggcaggctagaaaatgtttaatagacaacaaaatttgattgggtaatgttgatggtaaaagttctgtgaagcttggaaaagtgttaatgggctcaacttaagaaaattttctggggctatgtagttaggactgtcatagggacagcagccagcggagaaggaatagtgttccttttcttgaagcttctcctgacgccagggctgactgcactttgaaggggcgtctgggtgccaagacacacctcaaggagggtacgggaaggtcagcactttgaaaaatcagagggaggagattttccaggtaggtggatggtgaagattggctgggctattacagagatgaaatctaaatctaaatccaaattcatattgttattccaagtacaccattcatcgtcatgctggaaacagcatcctgacgagaagtctctgagcacttgattccactacggggctcatgctcacgcgctctcactctcgctctctgtctgaccgtagggagaattgccaggtcgcaaagattcttggagctgtacacctgctccctctccctgggtggttttgcatttatcacctgtaatatttttcctactccttatcttagatcttagagatctctgtcctcctatctatttcacaagaatttgaaatgattaagaaaatagttacataaagaaaaacacgtaaataaaatacaagaattagatgagttcagaaacatattctatattcagaaaaaaacgtattaaaatacaggaacaagagtataaaataaagaatgatgtgtctgtctaaaggtgaatgaaaacattctagcatcctgacctctgtgactcctaataaacactggtcagagttcatgccccacggcctgtgtgtccctctccttcctccttggagttgctgcattaaaggccacgctgcagtgttttcacggcgccttctgtgtgtgacgcatttggtctgagaaacacccatagagctactgctgagtttaaaagaagtaaacatcacctcacatgacatatgtgaaacccagatcactttttaaagatagtctccttggtatctaataaactggctaaagttggtgacagtccatccttcattaagttattcattcaataaatggcatgtgcttgaaatacaccaaactttgcgggtactttgtgtctcctagaacttcatatctaatgagggaattctgttttaaacaatcacactaatgaatacataattgcagttacagcaagtgttttgaagcaaaatacaaaatgctctgagaaagtataagaaggcctcttataggggaataacttgtaggggattatggaaggcctcactaaccggggatgtttaacctaaaacttgaagaatgagtgggaatcagccaggtgaagcagacacaccttaggagaaggctttagagagaagaaacagaatgcagagggccaggggcaggagaacttggtggtcatggaggaagggagaaaaggccggtatgtctggaactgagtgaatgaagagggtggaatggtgtggattgaggctggagctgcatcaggcctcattacaggttagaactttctccttagctcgtggaaatgcccgttcttcattcctctcaaaagggttacacacagcaccctccagaggcagcactgaacaccagcccatggctccagcagaaaaacttgtccagcctctgttgtatttcctgaatcacttgttataggtgacctcacagcattgagttctcagccttaaaataaaaaattcctcttgatatttgatctcaagttctctacccacggtttcctaccccgcagacacagtgtggccaccaaagctgcttggttggttcttttctgcattatttctctctctctctgtctctgtctttctcccttttttttttttttttttttttttgggagacagtctcactctgtcgccaggccagaatgcagtggcatgatctcggctcactgcaacctccacctcctgggttcaaacaattcttgtgcctcagcctcccgagtagtagctttttgtatttttgtatttgttttttttttttttgtatttttaatagagtatttttaggggttttgctatgttggccagctggtctggaactcctggtctctagtgatcctcccaccttggcctccccaagtccctcaccctgggattataggcatgagccacagcacccggcctctgcattccttttcttttccatgtcgcggtcgcctgttgcggcacattcttcagtgtcttccacttgcgccccatggcctttctggcttcagatgcagaacctctcccgttataaactgaaactcaaggcctcattttatatgggtcgagaaaaatctcaaatacttaagcttattgcatttccttttctgttcgctcctgctaattttgagtgtcattttattcttggtttgcctgatattttaaggttctgttcatacagtcttttcccccaggagttacataatgacttcagtcactttaaagaagtttttaatctgtctgacaaaattattttttcctttgtgaaatgtcatctctgtttcttctttttcctgctagtttttttcaggatggactcaaagccgtggaaagcctcaaaccttccattgaaacgctgtctacggatcttcacacggtgagtagcttccctcccactgtggtttaaaaccatcttaatgcaacagacattttcatctaaatgtcacttctgtgtaatcctgtgttttcatgccgtgccgcccacgtggagtgtggcgttcccacgcctgtcctctgtcttggtgggagggaaggtttgaccagcgagggaggcagttgtcgcattgtgtggaaatggccccatgagcaccaacgtttcactgtacctcagtcttaattttctgattggttctgttgtgtgtgtgtgtttttaaagatcaaacaggcccaggatgaagaaagaaggcagttgatacagcttcgagatattttgaaatccgcattgcaggttgaacagaaagaggtgaggggatttaattttgaaagattgcagttttcaccccattcttggaggctttgggtctgaagaacatgaagttcatgtcttctaggagctcacagttcactcgggctgtgtcaggcaccagtaaaacatttaatgtattcttgcaatttagttctataaaaccatcttttaaaatatgtttatttcaggaggaagcatttactacatgcatggccttaatggcggtgtataaaccctgtgctctgtcagttgctagataaggagctctcagtggcttcgtcacagagaccatgtgtcatttgtgctatttatcctgtacctggccctgtgtcatttccctaccctgacatacgtggactctgcccctttaggcctaggcacgtagcaggggaccagctggggctctgccagccctgagattgtgttctataaaatatgaggcatgagcttttcttacagctgcctccatcatgacaggcagaaatccttagttctcttacttcccctctttctgtaatgacgtctctgtgtgctaacacgtcagcagggacagtttgtgttgtggggacttgtttttaaaaagccattaaaaagtaagttttaaagataattttactatattttcactacaatgtgggtatcataatgtgaatttagtataaatccatttccttgttaataaaaggaatgtatctaaacatatatctagtgattttagagaaattgctaaactacttgacagcataaagttccctgttggcagtttggtgagctctattttattgtaagttcttgtactataactgaatattgttgtttttctcccaaatgcgtttaccttttgtgaccgaagtctaggagagtaagtagttcagtattttaataaattgcagaattttgcatgttttattcgtgaacatacatatatatattccttttatatattaatggttagtagcattttttattttaacccctcacctttcattgttgtagactttattaaaggctgaagagtttgcataaatattagggaagtggacattttctgggtttacagtttacacttttgctgctgttcctttatgaagatgaagcaggtccctccctccctccctttctctcccctgagtggctgaattctacacatctctctagtccctctgaagccccacctctggagcgctgcctctgatcaccccagcccacagtgatctgagttcacagagcacatcctgtttgaatgccccatttgaatcacagcctattcctctttttgagtgttggttgtgccttaagtgcacagatggcttttcaccagctggacctcgagcagcctgaggatgccaccctgccttctgagccattcttccatcacactgtagtgccacagcgctcatttagtaggattttggtaaacatgggtcaactaagtgagacactggcagagcaaggttatatttagtgctagaaaggacctacaacatggtgacttcctcctagtctagagaatgtaggccctgacgctttgatattcccaataagcaaaaaaaggaaaaaaaacttggcgtaaggagaaaatagtgggctagcggtaacgaggaggaggtagtgcgagggcaggagccagaatgccgtccaaggtggctgctccccagcgcaccgttggaaatgatcgagaactgcctttgtctaagaaggaagatccaacccatgaagcaaagctcaggtttaaaataaggcagagcagctgctggggccaaatggccctctgggcacagtgcaaaggctgtgtttgctttgcctgtgcagaattaggaggtttgggaaaacgggctgttgtgagagaactggttatttacagcttcgcaggaaagtaataacaaatttaccagcacagaccagaagttctttatagtttgttgttttttgttaaccagcccatctgcccctgattgcacagagggatcaaatgaacctcctttactattcttctttggctgtctgcccagttggctccttgtcaagacctaactcaacagtctcctagttgtgggcgtgttgtgttttctgtgtatcatgctctgcgttgcttttaggtgatggcattcagcaagttggacaatctttgaacacagttgcaagtaataagcagatgtgaaaatgctaaattttctgttttaaaatgatttttatgatgggggttccatcttgtatacctcaaatttgcaataagaattgatcatttggtcattattgtttaggccgtcattccctttggttggattttcttctgtgacttagacaactgaaggtgttaagaggatttttattcagtgttataaaaattctaaccctccctgtgtaataacagttgatagaaattaagtaacatgccccaaagaaactgccttgatggttggtagaagccagtgctcctcattctcttcctgtaaatcccaagcatcagttattgaaggaatgaagagtggccattccagtgtggtagcttcgtgctgctgtttccttgtgaccctgcagctttgttttagtgtggagcttgtgccgttctggtcccggtgacctcacacctcccaatcactggccattcatgttttgttcttgatattttctgctctctgtaaggagaatactactctttggtatttccattatttttctttgtgaaggttttcatacttggagaaaagttgaaaaattgtgcagtgaccacccatagtgcaatattatacaatgaggatcgaactatgtaccatagtgtttgatttttggagaagatcctatttacacagttaaactcgttggcactgctcatctttggttgagctctctccccgtcagcctcgcctcctgccttccccatcccacgtcgtccatccgatggtgttctgccaggatggaccctgttggggtgctggcggagtcccaaagcctcatcacttgtgtgcaggctctctctgctgtttgatgtggagaacccagacttgtgtgcttctatggggaggatcaggctctggggcatggtctcacaggtctgagtgctgaaaccaccatggttttccactctgcagatctcaagtatggttgctctctctctctctctctgtctgtctgtgtctgtctatctctctctgtctgtctctatctctctctctctctctttctcttgctccctctttttcaagcatcctgtctagtaggatgtgatagaacagtttgtgccacccaggcagccaaggtccaccacagccataattttcttctgcctctgggttcgcgtatcttacatgcccaaatctggccttcatcacagagatctctgccaggggccacctgcctgcctctcctgccaagctgctaggtagcctggctctggcctccatgtcaccctcagtggaggactcgtttgttgattcacacatccagctaccctttcttccactgttaccctaagccagcactccacaaacacaacagaacaagatggatcaggttatcatctcttcaggggatcatgctctgggggtggggacagagaagcaattggggtgcagtgtaatgagagcactcgtggacatcagctccaggaagcagtgtctgcccagtgcgggctgggcaggtgccatcagggatgacttcccaaaggctgtgatacctgggatggagcttagaaggatgattaggagttggcaggccaggcatggtggctcacagctatagtcccagcactttgggaggccaaggcaggtggattgcttgagtccaggagttcaagaccatcctggccaacatagtgagattccatctctaccaaaagtcaaaaaaattggccagttgtagtgacatgcacgtgtagtcccagctacccgggaggctgaggtgagaggatcccttgagcctgggaggtggaggttgcagtgagccaaaatcgcactgctgcactccagcctgggcagcagagcatgacctcatctccaaaacaaaaacaaaaaactggggacggggcaggagttagcagagtcccagcaggtgaggctggtggagaggacagcttctgactaggacggggttgcctggggagctgtctagcagagcagaagagcatggatcttggcatttgaatcctgggtctcccacttcctaccctgccctgtgacactgggcaggttcctggacctctccatgtcatggtctccccgtctgtcaaataggaataatacagccaacctcagagttttcaggagatctaagagataatttctgtagagcacttaccatattatcttaataatagtaaaattatttattaataatcttaataaatattaataaactatcttaatagttcattcaacaaatactgagctcctaggtggtaaagataccgtagtgaccaaattcccttccctcatggtgtcgcgctcttagaggttcaacaggaatggatactgctgctgtcgttgtgtgtgacatatcccttagcctccttgttggtccgtcctctggccctatgtcttcatggctcttgcccctcttccttcttcactatctgactcaagatgctgtcatacccagctctaggcttctcctcttactcctgacccaggccttccagcctcacctgcctctcacccacctctctgtgtccagcctgcgtcacattccacattcactctaggggaggagggacctgttcctatccattgcagggcatttcctgtttacctcacttttcaggttttccaggcactttacaagtgtggccaacgatccttacaagccactttacagggtaggcaatgtttgcccatgtctgcagctttttgtttgtttgtttgagacagaatctccctctgtcgtctaggctggagtgcagtggtgcaatcttggctcactgtaacctctgcctcctgggttcaagtgattcttctgtctcagcctcccaattagctgggattacaggtacgcgccaccacgcctggctaatttttgtagttttagtagagacggggtttcaccatgttggccaggctggtctcgagctcctgacctcgtgatctgcccgcctccgcctcccaaagtgctgggattacaggcatgagccaccgcgcccggccagccatgtctgcaactttattctgtgagagagagaggataagtgcccttgctgggctcacacagtggcatcagagccaggatttgaccctgatctattccatgtcaaactggttctccggagtcttttaaaaattacccttaaataatggagaataggtggtaacgatatttgaaagcattgttcttagaccatggctcagtgcttggctcagcaaggcttccagctcccagttgtgcccatgtgggtggacatacctgtcatatcttcagaagatgggggaatgaattggacatcacagccctcctgggcagagaaattttaagcttccaaaaatgactcctcgacaagcttgtcaatcacaggaattgtctggacactgactttctaagaagtgggcaaaatgtcagtttttaagctatcctagagtctttagagtcttagacagctcaaggattctactggtcatctgggcagattctgtgttggccagacccaatggctaatacttcatagggccacagaaaagttaagatcaaggatgatgcctgagctctgagaacttgtctgggtgtcacaggacagaggatgttggacactgatagaatttcatgaaagccttttgaggttccaccaagtgcccacctaccctgcatactcaggcacacaaacagtccctgcacgttgaggctttgtcagtcgagtttaggttgtcttcgtctctcttaggaaagtggagagtacattggagtctccaggaattggggcaacatggaccgccctggcctctcttactttttatgttattcttctctccagaaggagaggttctttttccttgcatagtattctaaaagtcagaaccttggtcatgtgaaagggccggttttctctgtcaggccttcacctggtcaggcgttttgtacaggctaacaaaggctattgttacggggtcgcctgggagtcacctagaggatactgaagtaattcgcactaaaacagtttcaattttatgttaaacagattatattcctcttttttacaaatgtgaagtttaataggccagcttaattcagatttgcctgcatgcttcaattggcctaaagaaaagaataaaacagggtgatttcattgtcaccttctggcatagggtctgattctgttgagaagaatgtcccttatcctgttcgtgagacctgaaaatcgctctgattaatatgcgcggcacgaacagtgttagcggtgttgtcacatgatttcaccacttactttgtgcagggctttttttctcccccaaatcaatagacgtatttcttggttgtgcagttgagtctcctgacaggtttatttttagtctttcacagagacgctgtacaggtgagcagtatttctccacattccttccacagcattgttctcagcaacgttgaaagctggatttgctctaaattttggtgccgatgttccgcccttctgagaaaatgtggaagctgggaccatcctcatcccatgaatgcgtgtgtgccctagtttatccagaggctcaagtgctgtgtgaactttctgtggaaatgagttcatttctcccctcctgggctctgcttgtttcagggttggttgtcagttcagtaatggagagtgcctccgcatgttactgattgctcacgtggagttttttggtttttcttttttggcagagtttaaaaagtcagtgctagacactcatgtgcatgggttggaagacttattgtgaagataacagtactcccctaattgatctacacattcagtgcagtccccatcagaaatcccagctgcctttgtgcagaaattgacaagctgatcctgaagttcatgtggaaacgcaaaggacccagaatcgtcaaaacaatcctgaaaaagaagaacaaagttggaggattcacatttcctgatttctgaacttaccacaaagctgtaataatcaagacagtgtggtactggcataaggagagacatatagaccaatgaaatagagctgagagtccagaaataaatccttacatttagagatgatttatttttaacaagggtgccaaggcaatggagaaggagtagtcttttcaacaaattgtgctggggcagctggatagccacaagcaaagaaggaacttggtcccttacctcacaccataatcacaattaattcaaaatgagtcaaagagctaaatgagagctgagactataaacctcttggaagagatttataagtataaatcttcatgaccttggattaggcaatagtttcttagatagcacccttacagtacaagtgacaaatgaaacagtaggtaaatgggacttcattaaaattaaaaagttttgtgcttcagaatcttttttcaaactcagaaatccaagaggctgcctgtgccttgggatgcagtcgaaactctgactccagcccgtcttgtccacccctgggccttactgcctcagatgcagtatttgtctagcttccctgggtgctgaccacgtgaccgtgacctccctgtgtcttctgtgtactatccactttgccttgaagatcctaccctgattctgtgccagttcttgccttcatgtttaaaactcgctttttcctgtgcttttctccctttgactcttcagttcctgagtgctcttgttctcagcttccatcacactgattttcctgcgttagttctttcatcgtttggggatgtgcttcgttctccaaggatggtgagctgctcagtggcaatgatgagagtggccctagactctgaggatgttctgtggggaaagaagatggtgtaatggaaggagcctcagagtggaaggcaggattccattccactctctgctcttgctttaaggagctctgcacctggagcaaaccacttattttcattgtgtccctgtttctcccattatggaatgaactggataggcgttctcattaaacacctacgagcagccctcggccctttcctggttgacctgtgaacacttggttcacatcttgctcccctctcgtttcctttaagtctcagggaaatagaatttcctgcactggcactggtggcctctcctactctcaactcagagtgtctgctactgtttgttttgtttggtttttgcttttttgagacaaggtctcgctctgtcactgaggttggagtgcagtggtgctatcatgactcactgcaacctcgatctcccaggctcaagcagtcctcctgcttcagcctcccgcatacctgggactaccagcgcctgccaccatacctagctaatttttgtattttttgtagaaacgaggtcttgctatgttgcctaagctggtcttgaactcctgggctcaagccatccgcccaccttggtctccccagatgttgggattacaggcataagccactgcgcccagcctgatatcatttgttaaacaccagttgagccacctgttggatgccagacactggacttgggccctgggtgttcattgctagtcctcgcttaccctaagaagctgataggctggaatttcccaactgtggtagattcaatcagattctcagctgaccatgtggatggtttacctatgattaagctcccttggtcagggtcagaccccccttactcaagattggtggagggaggaagtgaagatttttgcaatacttgttgatgttcacatgtgtgatcctattgagtccttactgtttattggccttactgggtattcttttcttattgcccaagaagggaactgaggctgagagcttatgtgatggttctgtagtaagggacagaaagctggttttgtcgttttgcttggaaacccctgcctttccactcactgcatcacctccctcctcgagggctactgtggccgtagtgggagcctcatgtcattgtcagggggttaaggctcgtaatgaaataaaacctggaaacttccagggctcattccttcagccagtttgggaatattggtttcctgacatttccttctccagcctgatagatggcatttatcagttcctagagcagaatctgatgtcccttttttgctgtgttgagaaagggaaatttttccaatttttgttgttgttaaaaaacacattaggcataagtttcctttgtgtactgcttttctaaaaattaggacctggacaagattaaaaacacactcttcaccattttttaggactcccaaattcgtcagagcacagcttatagcttacatcagcctcagggaaacaaggaacatgggaccgagcggaacggcagcctctacaagaagagtgacgggtacgtgagggggtgtggctagagtttaaatgtacgttcgttatcttgtgtccaaaatgtctaaactcttattgtttctcccacttatccacaaggatccgaaaagtgtggcagaaaaggaaatgttcagttaaaaatggttttctgaccatatcccatggtaccgtaagtattctcttttaatccatggtgtctgctgtattaggtgaggttggtgttggaggactttctgaagttagagggcaggagttgttctccgtgtgtgatggtattaaggatgtgtcttagagaatttccctgtcagaaacgcttgctggcctccgtcttgatttggtgcacctgcagcctgtttatgttttttttttttaattttaattttaatttttattttttattttagccagatggagtcttgtccttgttatcttccactccctagcagagtcaggagtaactgataagccaggttgtctttatttagaagcctgtgactccagaaagcacagaacagcaaactgctcccccagctctctttgtctctggaaatcaaacatctcacttaggaagatttctacttttccattaagagaaaaaaatgggcaggactctggggaccagaaatccatgagaaaagacatctcagtaattttattattgaaatcttaacatatggtgcccaactttaaggcctctttccatcatcctgtttatcagagtctatgcaagaaaaaacggagccctctatgttgagcttatgaaaagccggtcaggataaagttccttaccaatctagctttcagaggccaggaacttggatcacagacacagccctgcacaccacactgttctttccatggcagcgttatacatactattgcctcacctggcatgactagagctggtgataaccacatgggctggtagacagctttggtaacatctcaaggccgaggtcgttgcctttttgttgctagagagatgctgagggttgtttgcattcccattccccaagcagaggcctagtagtgcatgcaatccagcagccttgggcgtgtgagtggatgatggtaaccgtctttcctgccccttgtccctccagtccctggtgaaggcagagctgggcaggagctcagaggggcttttctggcccctatagaaatgtcatcactcaacatggggtccagagaaacggccctgaggttcataagggaatagagtaaaaccccagccgaagcatgtcacagcagcaaggattgtgttcctctgggggtgcctttgtttttgccaacttcgatttagaaagggagagaggagctagaatagtatatacccagtggagggattctcggtgacctctggtctaggggtttgaatgtgtctctgaacttggaaatgaaggtcattttctattttcaaaacccagctttcactggtcatgtgatcaccaccgtactccccctgcccccgcgaccccagggccatgcagtatggatcttaatgggacattatgggcaggtgcagtggctcaagcctgtaatcctagcgcttagggaggccgaggcgggcagatcagctgaggtcaggttcgaggccagcctggccaacatggcaaaaatcctgtctttactaaaaatgcaaaaattagccaggcatggtggtgcatgcctgtatcccagcaacttgggaggagagaattgcttgaggcaggagaattgcttaaacgcaggaggcagagtttgtggtgagccgatatcacgccactgcactccagcctgggagacagagcaagactccatctcaaaaaaaaaaaaaaaagccattctttccatgcgtggatgtgagggtatgagttctgtagaccaagggaagcaaatttatccagctatcactgtctttaatattaggaatgttagattagatgagactaggcacccttctaaataccttccagatctcaacacctgtggttctgtggtttgctttcgaattggtgtccactcgctgtttgtttgaactccgattgactgcctcagtgcagaaactgtcatacaactaagttctagttcatgcttttacagctctgaagtcaaggggcatatttgcttcattgagagttcccctagatccaggcctcagcttaagccagtgagtggctctttccatggcagctggaaaacaggtctggtaatcctttgctgacagcataaacttcacttcgagtcacttccatagcttgagcttcctctcaaaagatgtggaggcttagttgtctttaaatttggatgggttgccccagtttttggtagatagtacggttataaccggcattactgggatgctgagaactcagcttgtcacacagcgtgtgcatatttaataggtgctttgtgtttggaggggaaaaccctctccagggaatctccacttccagaggtctcctgcctttagcagccatcgccgcctacatcctgcaggggtggcaggtggggctgtcttgattcacttcctcgctgccatgcagaaaaataaagtagttttccagccctccgttcagtggctgagtgttccttttctcaccttttccctatttccctgcgtgctctggaagtcagaatccagaggacccctctgtatgactgcgtctacagagaggttgcatgtggggaagtgagttcacccataccaagaaagagaattgagagatgcccttttggtttggtttggttttgacttgatttcttgtgcagctcacctgtttggccagcagctcctgagtgtgctcgtttacagtcaggaaaaaagggcacatttccaaagacttgattaagtggaagtctaagagcagagcctggcacatagctgcgaagtaggtctttaagaaatggaagcacacagggtgtatttacactggtaggaaaacccttcccaggaagctggcagcctctgggaaatgaagttgttgtattctgattggagcagaggattgaggataacatccgggagattcgttcaaagcccgagttgaatttccttcttagccaagtctgttttctggccctaggaagaagtgatccttgagacaaaataactctaattagatatcctctttgccagattcgcaggattgccacaccactgagggctggggactgtgttacactggaaggaatgtccactggctcttacacaatctaaaattttaaaaaatgatcagtcatgaagaaagaagaaaacagcttccttctaaaagcctgacaaatcgggaaaaaatagaacggcacgattagaatggagaatcactgataatctctgcctgcatggcaaactctaaagctgttgcatcttttttttaccattccttcccaagttttctactaaactagggcttctcaaattaaattctcaagaaaatactggtattttgtgaattagatgaaaccgttctatatctcaattaactgatgacacttttttgtttgtttgtttgtttgtttgtttgtttttttctttttgagacggagtctcgctgtgttgcccaggctggatggctcactgtgacctctgcctcctgggttcaagcagttctcctgcctcagcctcccaagtagctgggactgcaggtgcatgccaccatgcccagctaatttttgtatttttagtagagactaaaaatctctactaaatcagccaggtcaggctgatctggaactcctgatctcaggtgatctacctgcctcagcctcccaaagtgctgggattacaggcgtgagctactgcgcccaggtgacactgtatttttccaaattgcaacagggaaggattttaatggatagaattttctcccataaatttttctaatagctttactgtttgctaatacttaatctgtgtacttaatatttaacctgaatagcaaacagttattaatgtaaaacagaactgctggtgatattgcttaagatcaacttgtgtgttttgtggacccattcttatggttgtcattttttaatatgtaggcacatttatgtcttcataaattattcctacttcaaacaaaggtgctgaatatttttctctattttgtggtatgctgcgaagtgagaaatctatctttgatagtagttaagaacgaacacctttccccgtatcacagggaaaaaggaagactgcaaggtggaggtggggagggagaatgagttgtagtaatttaagttgtggttctttgctgctcttaaagataagtccaggcaagcgaccgccttccatggatacccacgtcgaggacagggagggtggcagttgagccccgagccctggagccagcctgacttgttggaatcctagcttccccgctccctagctgtataacctcaaccagattatttggtctgtccgggccagtgtctttagctacaaaattggtgtagttcctacctcaaagggcagttaggaaaattaaatgaattatttcatgaaaaatgtttagaacagtgcctgccttgtataggtatataataaaaatagctgagtaaatgtagctattgttattcaaagtcattattttgtccatgaaggtgcttctgtatttatcaaagcacacaaaccttagatataggagttattcctatatctaagaccccacaatttggaagtagccctaaaatttgcacatgtacagttgtgtcatcacagggaggtaacagaatagacacaggctacgtatgggtgggtgtacacccgtgttaaagtacttggttgcatacatgttttgtaaccatgtttctagaaatagatcatttgctgtattggttcctggataagttaggtaatccgattggtaacaatccacgatcagtggtgctttcacttgaaagtgtccagatttacaagattaggcagagcttggtatcttctaatactgatttctgacgatccaggaattctctgagatatctacagattatggagaatatctgactaacctgtagaggaaaagaccaacacagccacgaaccaggagagtctagtacaaccctgtttatctgactttatctgactttcactagtccaaacttacatttattaacccaaatccttcacgctgcaaggatgggttcaactctcccaccctaactctgtagacttactggaaggaagctgctgggcctgtaagtgcttgagggtttcacaggtctgtccaggtgtagatgcatatgtgtatgtatctggattaatcccaaattcaggtttttttcatcttgaagtgaccggtgggcaagggaagtggggcccaagaacgatggaagtttaagacattcttatttgatctttcctttagcagcttggtaggtgggtaagataagcccactcccatttggatattcctccaagatttctaagaggtattctgctgttcgaaatttttgtttctgaaattatcttcttaccctcagtcctttgctttcttggactaagtatgatcttttttttgaaactgtaataaaatagccatttttcatacacctctgatgaaagtatgttgtgatcgcttggtgtcgtgtgtgggggagagggtttgggggttacagatgtgaatgaagtatgttttgttgaaacttaagtgacagtgatggttggcatttaggaatgtgagtctgttatctgtcaccacttcaaacagtaggaaaataatttctctgccatttttgtactgtgaaattaccttcactggaagtgaggtttatgctaagaaaaaacgcttttaagatcaccagaaattgagctgggtgcccaagttacctggcaaatcaactgtgttgtcggtaggaatcagaactgaatgttttgggcttagccatgcaatatcttgatctgaaggcacccactgccagcagcctcaaagctggcatcgcttgtcctcttgtccaggtgggtttgtgtagaccaccaaggtgcccttgcagggaggcagttgccctctgtggagatgaagttcaaaggcctctgtaacttgtcccagtcaagccttcctctgtcaagtctgaaggccacctttgcaaactagtgaagagcttgctgttgctgtatctcgtgaggattgatactgtatgattttccattccttccacccaaccccaaccttttttgttgttttttgcttttaaacaggctaaccggcctcctgcaaagctcaacctgctaacctgccaggtgaagaccaaccctgaggagaagaagtgctttgaccttatttcacgtaaggctccctctgagatgccgcgccatagagacgttgtcttatgctctcctctggggcgtccttcacatttcaaacactgcattcggaagaattggtttttgaagagacataccctttttctagtgatatgcgtgctttgtgttccattagtaactgctggcttgccagcctttctagttgagagtttgactttgagggctggccctgctccttgggggcactgtagtcctgagacattacctggctctctgagcctcagcattcctgttcctaaatagggagatcctacaagagaagcccacaagcctaaaactccttcacttgaaaaagagagaaggaggacaattctgttttcaagaacttacataatttgggtgatgttagaaatgctaaaatgagggtcttcaacaggtcccttgaaacttcagtgtttgaaattgtttttcttcctcaccacaggaatagtctttctgcttctctgtgcttttcctttttgtggcgttcacaaaagaatccccacagaaccatccattgtggtgaatgtttactcagcaccccttaaattaaagggcccatgatgtctaaaagaaaataagataaaccttttttcctaggtagttctgtgtggcagggttagagtccaggggaagaaagggccagtctcccctttgaagaggcagtcactagggatttgggtgcaagagttacatttgcagaggaccacgccggactgtgtactgtaggaaggcggtgctgttctctgtgcctcagtacccctgagtgggagatggctaccttttcaaatgtcagttgacctgtattattgagggctaggaagtcacttgttatgtgattcagcgctcccagcaaactgcgggtaattatcactccacctcacccacaatggcttgctcttatcctccctgttccccttctcataccctctgtgtgaatctctggggagggttgagcactgtgatatgtgcagagggttccagtaccatttattctgttcttcagactctagactgatttgtaaaataaaatggactttatcctgtgtcaaacacccatcctgactcagtctagtaaggtccacagattctcatcaaagcttgcctttcattcatacaagatgttataaaatgctgagtactggccagagtttaaaatgtgattgcaagccaggtgtggtggtgtgatcctgtagtcccagctactcgggaggctgaggtaggaggatcacccaagctcaggagtagacgtccagccttggtaacatagcaagaccctaactctttaaaacacacacaaacacacacacacacacacacacaaacacacacaccactgctgggatacctgtgtctagctagcaaaaaaggcttgaattgaagagtttcagaaaacctgatggtgtaatctgatgtctgccagtggctggggctaactcagggttttaggcctttctgttttctgaactagtaacacacaagaagccatgcgttaaaatgcccatccttaactcataagcaataatagtgaacctatcacctggaggtgggtgtagggacttcttccctcaactgccctaggcccctccagcatgctccacagggagaccctgctagatgccatatgtgcagaagcacttgctccaatgtattcccagcctccacctttttacaacacagcaggcagcagggaggatcagtagacggcaagtgtgcatgcctcccttctgggtgtgagttactgcagcccttacacgtgtgggaatgcagtcctctgtgaatctggccacacacaagctctgtggccaactgatatttaccaagatcctgccagtgtctttgctgcagcctgatgcattgaaacatcttcaggaaggacttgtagcctgtgatgcccagacaggtttgctgagcccagttgggggcagtgtcgtgagtttgctagagtccattgtcatctttgaaaagagctctcatccctcctccttccttgcttgtcttccagtgggtaaaatgaattccagtcctgcaaattcttcatcctcagtgagttttcaaaaggtgccttcctatgagtatctgtagtgaaaatggtttgtgcaggggtatgtgggtttgggttgaaaactggccagataccccagagagtcatcacaggaaacctggctgcagtataagccgtgatttgatgaacatcctgagaaggtgagggacatggggtcaagacctgattctggctgattgaggagcatctgtcttcacccctctcagattcctcctctacttcctcaccagcctcatgggatgagtatcaccaagatgcttttgaactctcaagatgcttttgaactgcctgggtgggccaggcagtggctcatgcctgtaatgcaagcactttgggaggccaaggtgggaggattgcttgaggtcaggagttcgagaccagactgggcaacatagcaagacctacaaaaaatttaaaaatagtgcagtatggtgacatgtgcctttggtcccagctactcagggagctgagatgggaggatcgcttgagttcaggaggttgaggttgcagtgagttgtgttcgtgccattgcactccagcttggacaacacagcaagactgtctaaaaaaaaaaaaagacatttgggcagttggggaagtcaagtggaggcacatgcattgaggcagtgagggtgatattttctgtgtgcatctgccaggcactccatggtcacccattcctcctcttcctcatctggtcagttcatcttggaatctgcccagagaactcagaagagcaatagactggctggctggttgcagttacttcctacaagatgttcctttaccatccttgctcctaaacaggggcttcccattctcatgaaggtggaattggggccaggggcagtggctcacacctatagtccaagctacttgggaggctgaggtggggggatcacttgagtccaggagtttgaggctgcagtgagctgtgattgtgccactgcactgtagcctgggtaatagagggagaccttgtctctttaaaaaaagaaaaagatgtaaatgagcatgggcttttctaggaggatggttctgtggcaaggccggcccttctgggagctcatctaatccattgcctgcagaccgaccccactcatagcaaattcaagtcctgagccattatccgcgaaccccataggcaccctgggagggatggaaggaacagtagaattgtgaggtgacccaagtgagtcccctgagtaggatggagccagagggagtcaatgaccttccaggtccacatggcaggttagcggccagtagagccagagccctggccacaagctgcccttcactggccaccagcacctgagtgctccgatcgccccctctgtctcctcctgctcttctccctcacggctgaagctctggaagccgtccgcttatttgtagcatctttaaagagagtgtagtggaggggattcttgcttgaagtttttcctcagaggtttgcctcctgcttgtgcagtttttacacgtcagaatgcagaaattggccaggtgcggtggcccacgcctgtcatctcagtactttgggaggctgaggtgggaagatcgcttgagcctgggagattgaggctgcagcgagctgtgcactgcacgtttgcaccactccactccaacctgggcagcagagtgagactccgtctcaaaaaaaaaaaaaaaagaaaaagaaaaagatgccatggtgttgtagaaagtggtcgggccagaagtccaggaaccaagttctgctgctggctatgcttgttttttgcagcttagcctctctaggcttcagccctcacccagtcacttaccaagagttgttctaagaaccaacgtgctttcaggagtaaacaccactacagagaggtggcgtgtccactcacttttaggagcacagatgttcgttgtgtttccctaagaagagaattggtacttgtcatcattctgccatctgcaaaagctggattcccctgcccctgcttttctttattaaatataattttattttttgctttggttttagactgcttttagacagagaatatccatatatccctcccctagctttcccttctgttaacatcttaatacagttatccagtagtccgtggtacatgttatccaatcatatttatgtagttatcaaaaccaggaaacattggtttgatgctattaactaaaaatcttactcagattttaccagttttcccccaaatgtccttttttctgttccagaattctatccagaaccccatgttacatttagttgtgattttatcctggtctcttgcagtctgtatcggttctgtagtctcacttgtttttcatgatgccttcttaaagagtattgacctgttttttggtcagactccccttaatttggatttctctagtgttttctcatgagtggattgaggttatatgtttttggcaagagcagcacagaatgatgctgccacatcccacacagccgcctccctgctgcacacacacacaggtccacagcctggcaaaacacttgtaaaactgtgctgacaccagcagtatgtaagtgtaggattttatattcgaccattatttaacacactcctcttgatttagctacatttctagtatttgattctcaaagcatattattcttagaatttctcatactaatctttttctgagaaagccagaaaacttctaagatattctttttaaaaaaggtttttattattcaaagggcttgaacaattactttttgggggccaactctgtagtgagttaaaatgaagctattgagaggatagtgatggttttcattgaatagcttcagtttttagaagcggcgtcttttaaaacttgaatgagggaaagggcaggtttattttgcattagaatgccaccgttggtgaaggcagacatttggaggatatgagggagtgcctgattttatacaaatcagtaatttcgtaacagagagctaagattattccagaggctaattagaaactattttcttttggaattgtgtatggattgctgtctgggctcacagttgaaattcctcttgctatgcagatgacagaacttaccactttcaagctgaagatgaacaggaatgtcaaatgtaagttacatggtggtgggactttgggctggactcagccgttgtttgtggaatttaacacagcgtcgctcttgtttttctagatggatgtctgtgctgcaaaatagcaaagaagaagctttaaacaatgcatttaagggggatgacaatactggagaaaataacatcgtccaagaactgacaaaggagatcatctcagaagtgcagaggatgacgggcaatgacgtctgctgtgactgtggggcgccaggtgacccagggaccccacccgaccctgggctctaggacatttcaatcccattctgattcacagaatccgttcattgattttcactttcatttcaaacacgaaattaagtgcagctcagcctgagttcatcccattacacaaatgcttaatgaactgtgcagaccgcggcaggggagaggggcgggaagatgtttgcctgccgggccccagagcaggactgagtaaagagggtttgacagagctgcaaagtttgaaatgctttttgagaaatgaaaactgaagggtacagtgagagtgaactcaaggtcatgtgggctgagaggctgcatgtggatgggcttccttgcttggaatctgctctcttctccctttatcctactttgcagaacttctgaagtagctttaagccgctgtctggctctgtgaccctgggagagccacttgctttgttaaacatcgattttcctgtctgtaaagtgaagggacaggaccctttcagctgacacattctgtgaaataagattttatttttacattttgataaagcatattaggggctttatagtaggatgtgatttaaggaatttgcttattctaattgagacacaatggtggggagtgggggtcggggactacacaggtgcattttctgaacatttataaaatgaaaaagatggaggcttggctagaatggttaatccccttttcattcctctaattctatgacaatttttcttaaaaaaccaaacacaaccaaaataagagtggacagttgagaattacctttaggttcccatgaccctgaagactgtatttggccttggatccattaaaaaaaaaaaaagaataccgactgggtgcagtgactcatgcctgtaatcccggcactttggaagactgaggcgggcggatcacttgaggtcaggagttcaagaccagcctggccaacatggtgaaaactcgtctctattaaaaataccataattagcccggcgtggtagtgcgcacatgtagtcccagctacataggaggctgaggcaggagaatcactcgaatccaggtggcagaggttgcagtgagctgagatcacgccactgcactccagcctgggcaacagaacgagactgtatttaaaacaaacaaacaaaaaacccgaaaatacgtttttggcaggagatgaggtagggggtgataagtagtgaatcatggtctttcttgagaaagggtaaagacagtctatgatttgggtgtttcatacgctttgataaagaactcaaaggtatgtactcattattttaaaatgccaagacagtgtgggtaatataaaaatgatgtagagtcacctaaatggatgcttgtacctccgcaaagcacaaatacagtggagtcgtcctacacaagtgcagacacagacgccaagaaggttttccaacatggataacatttttaataacttgaacatttaaaaaataacttcatgatttcctactgactaaagttgcgatatttacctgccgtgagtttctcagggcaacaaacagttctgaagagaattgtatttatgggttgtgatgatgtactcaaggacatcttatttttaatttcccatttttagcaaattccacattcatctgtcaagcattttgtgggtccctatcatctgctaaatgtatggtaggtcatgttagtgagtagccgagctgtgaggggaaaacgtggctttgaactcaggtagaggcagggccacagtctgctctgcactccctggcgacctcgagcctgagcatcgcaaagctgtctctgccatatagtgagataaaaatccctgccctggtcatctcatggaactcttagatttgatacaaaagtgctctgtgattgctgaagctcttaacaacacaaactgttattgctactaccagcatgctgaacacagcatatcttatgtacatagtacgttctctgttattatcagcatctgtagatgcatatgttttaagcctattccccttttacaagtagactttggctggtctcattgttttcctcttgctccattctgctagtgtgaccaagttggtgatgggcatggtgtgttttcaccaccagccattgaggagcccttggtcactggagtgtgtcctgtttatttttgcacacacagcacctgtcacatgaatggaaggatggggagatggagagagagggaagaagagggagagtagatgtgtgcatatttgggtattgcatgtaaattggtggtaattatggacaaagtttccagctgtgttaaggatcagaaaatgctcatgctcagaactgcttgttcagtaactatgcaggaagaaagatgtgactcctgaccctcttttttactggaagctcaaatctgccctgttctctttggcagatcctacatggctttccaccaacctgggcatcctgacctgcatcgagtgttccggaatccaccgagagctgggggttcattattccaggatgcagtccctgaccttagatgtactgggaacatctgagctgctggtaatttttaaatccttgatttcagattggaaacaaatgagctgtaagctaaattttacttttggcattctaatccattttggtaagctagtggttgttgatatgttgccagattggtttggataattagaaactcattgataattcttcatttttagctacttgtggttgagggcacttcttgttgcaaaactttattcttaaatgaataaaggggagtgaaaccaaaacaggagcattgagagtggtgtgagattctacagaaatggagtaagatggtgacatagaccagctcaccccatccattagacagatgtggaatgcaacgtctaaagacaggaaagtacttgttttcccttatcaccagcgatttctgacaaggctgtggtgacaacttgcctcaagcctccgacttctccctaccccagattgtcccccatggggggagatattggtcttcatttttactgcctttgtttcttaagtctttcattcttggttcagtggtaacacttaagccatgtgatagagataggaggagacagaagcattttctgtgaagtggctttcaagagtatcgagactgtagtcccacaaggtccatcagacagggtgcttctggccacctaatacatgagctttcatgactgtcttccctagaaagcagttcttgaattctctcctgggatagctggatgttgacagtaaacagtaagtagatagtgattggcattgattttaatgttgaatttaaaagtttacatgtagggaatttaacgtcaagagcaatagtcttgacagaaaatcaatagttgtggaccatgttcctctcaaggggccatcagtcttattgatgacttcgaatccagtgtgtctgaacttcgaatgcattttgaactctcttgtcaaacctttccagtctttctaggaattcctttatggtcttgaaagacagagttgggagaaactacagtggatcctggcagcctagttagtaacatccttagttacttacagtttaaaactaagctagactcacttaaaatgtaaaactaaggaactccaaacagtgccttcctggttacatacagcaattattgttcatgtaataatgcacgtaacctacagcttagagaggtgcacaggtgtacatgtggtatctcttggataactgatgatggcatagattggaggttgtcatggtacattttcaaagaagcacaaagtacttttcagtaaacactggtgaactatggcagttgtttcttttactgattttcttaaaacaatggaaagtgttaagtgattcaagatgatgtaataattgtttattttgtactatgtattttgcaggccactttatatatactaggctcatttgatctccagtaacaacctgatgaccttggtatattatccccattttacagaggaggaaactgaggcttagaatgtttcagtatgcctagggttatgaagcttttaaggtgacagatctggggtgtgggcctctttaatctgataccagacctcacacttaaacctttgacgagcctgggacacaaattggcattttagtgggttgtcttgctagatgataaacatttaaacatctctactgtccttccctatcaccgtccccaacaaatgtttaacagtcaactctggagaaaaaagaaccctggtttgcaacctgcctgttctcatggtgtaaatactcccacaatggccaatttcaagctacctaagtgaattactcaatgtgaagttggaaaaagatgttcattatatagtacattcactatgcaaacacagtggatgtaaataacttcatgaacatggacaatagtaaaatgcagtataattaggaagtgatgagttttgagtatatacttgttattaatgtaacataattatgagtttatatagcataatttttaatagtagcagtgcttaacagttggcttgcaaaattcctgaaattttaacagttgactcatatgagctggtaggagcccgaccccaccatctgttataattttttaaatgtgtctcagaaatttcatgttcttcatgagactgagttgcctactaaagaagaaaatgccaaagaaaggtgaaaggaatatgttgttctgtcttgatgaaacgatgaggtgacttctaatgcctggttaaattctccatttctgtctcccagagcctccatctgcattcttgtaggagtttaaagtttggttggctgtcacccacaatgagaaatcagccagtgcctgcttaatcaatgtctgcagatattttcaaaatctaattgcttccagagttttaaactctcccttacccaagtcttttttcctcagtggttatcaggaaaagtagagacagcagtgaattgtgtaggatttactcccttcaaccctgctttccctgagctctggctggtcctctgtggttcacaggaggtggacatctccccacggctcccccaatccattttttgtatgctaggagtgtggtcatggtgtcgtggctctaaaccttattccttagcccttcagttaagcagtacgtagggtgtcaggtgttagtattcattggcaaagcttggaaatttcaaggcttctttctttcttttcttttcttttttctttctttctttccttcctttcttttcttttccttttccttttctttttttgacagggtctcactccatgacccaggctggagtccagtagcacaatcttagctcactgcaacctctgcctcctgggttcaagcaatcctcccacctcagcctcctcagtagctgagactacaggcaagtgctaccacgcctggctaagttttgcatttttggtagagatggtctttcgccatgtccaggctggtctcgaactcctggacccaagtgatcctcctgctttggcctcccaaaatgctgggattacaggtgtgagccactgcgcttggcctcaagccttttaaaagtatccagattgttttattttgcttagacaatcaggtactgggatgaaggatttcctgaagtctttttacctctttatcttatctctttctctgcgtgtgtgtgtgtgtgtgtgtgtgtgtgtgtgtgtgtgtatttagaattatgtctgacacaccgttaagaaccataaagtattagttatcattgttatctcctttaacaaaatcctttcagaaaaatggtccccatgtgctagcatgtgaacccccagggaggccatgcatggtctgtctggttgtctgttcttacgaacctttccaattcagagttgcatgccatgcagggcctcggctgacttgcttattgaagtatgttttattgtatagtgagtgttcattaggccccttggtgccttgtgaaaggagagtggtgggtgcagcctggacaggttctctcacaggagtagcatctctcctcttttgggtaaatagaacagcctctgtttcagggtgacatgctgtgacagcaaaggattttatttttttaattaattttttattgcatgtatttatagtgtacaacatgatgttttagtatgttgtatacattgggtgtgactaaatcaagctagttaacatatctgtcacctcacatgcttatgttttgtggtgagaacacttaaaatctactctcttgagcctggtgtggtggccggcgcctgtaatcccagtactttgggaggctgaggtgagaagattgtttgagtctgggagttcaagaccagcctgaccaacatagggagacctccatctctacaaataattttttaaaactagctgggagtggtggcaagtacctgtggtcccagctacttgggaggctgaggcaggaggatcacctgagcacccaggaagttgaggctacagtgaactgtgatcttgccactgcactccagcctgggcaacagagtgagactgtctcaaaacaaaatttttaagtatacagtacgttattattaagtagagtcactgtgttgtacactagatccctagactttattcatcctaactgaaattttgcatgctttgaccaacatgcccacccccaacccctggtaaccatagttctgctctctacttctatgagttcagcttttttagattttgcatataaatgagatcttgcaggatttgtctttctttgcctggcttatttcacttagtataatgtccttcaggttcatccatgttgtcacaaatgacagaatgtcctttttttcaggtcgaatagtattccattatgtatatataccacatttttaaaatccattcgtccattggtggcatttaggttgattccctatctcgactattgtgaatagtgctgcagtaaacaagatggtgaagacgtgtcttcaacaaactgatttcagatcttttgggtaaatacccagaagtgggttatatggtggttctagtttttcgaggaacctccataaccattttctataatggttgtattataataatttacattcccacccagtgtgcaagccttcccttttctccacatccctgccaacacttgctatcttttgtctttttgataaaagccattctaacaggtgtgagatgatcgtggttttaatttgcatttccctgatgatttgtatgattaatgctgtgtactttttcatacatatacctgttggtcatttgtaggtcttctctttctcttttttttgacaggttcttgctctgtcgcccaggctggagtgcagtggtgccatctcggttcagtgcagcctctacctcccaggctcatgcaatccttctgggtagctgggactataggcatgtgccaccatgcccagctaattttttaaaatttttccatagagacagggtctcactatattggccaggctaatctggaattcctgggcttaagtggtcttccagcctcggcttcccaaagtgctgggattataggcatgaaccgcctgcagcctagcattacttcttttccaatggaatggaagttgcataattgaattattaattagttctggggaatcatgtcatcttaactactttagcacacaccagcttaatatctttagattctaaagcaaacctactttgggaaaaactttctggtaaacacagattttaaaaagataaatttccttcttaatgtagaagatcatgatttcagctttgatttttcaggtcatatgaaaaacagtatcactggtactagggtactactatcatgatcaatttcactatcatacatgaagttaataaaggaattcttgatattctgaaattgaatttgagtcagtcatttaaaaatcttatgagaccaggcgcagtggttcacacctatagctccagcactttgggaggctgaggcaggcagatcacttgagcccatgagttcaagaccaacctgggccacatggcaaaaccccatctctacaaaaaaaaaaaagttagctgagtatggtagtacatgcctgtggtcctagctatcagggaggctgaggtgggagaatcacctgagcccaggaggttggctatagtgaactgagattgtgccactgctctccagcctgggtgacagagtaagaccctgtctcaaaacaaaaaaacatcaaattaaaaaacaggcatcaagagcattaccaaatatttactgactcagctttctgtttcttgactttcttctatttctgttctcatacggttgttaataagctgtcaaatgttaaagcgggtcaacacacagtctgatctgaaagagagcatgtggagaggaaagctcctcaaagacgaagaacttaacgacttacaactgtcttctaagttcacctaggactgaaatgtgccacccagatactaaaagcaattgcttagggcaacaggaaattgactatcagtggtcatttacggaggaactgttatgctccaggcattgttgtaggtgttctacgtacactgtattatctaacctaaatggagagctccatttttaaaaaaagaccagagaggttaagaaacttacccagtgcaggatttacattccaactatcagactccagagcctgtgttttagcctttttttttaaagccaagattctgaacattttttaaaccacaaagtctatcagaaaaaattgagcaccaaagcatgtacttacttacatatgatgtacctacacttactaagaaatacatactttgtaaactacatcaaaaatagagcttttaaagggtcaggtaaagacatcatatgtaaactttttccctgcacaccagagtgtccttttgtgctctttgctttggaggcagcagtttggtcaagccccttcccttgtctgggcctttaccctctgtactttagagctggactgcactcttcaggccctccacccttcggggatccaaggggcccagttaacatcagggaggagctgaccttggggtctcctgagctcagcggtcagggaagtctggtttctctcacttgcctgttctctcctggggtgagtcagagaagaatgtcacagcaattgttgtccttcctcatggagacatgaaaacaggacaggaggtttccctgccccaccccaaactctcaaaacaatgtccagataaaacctaaagcttcattttggctcagtgggccctgctcaggtaggtgctaaggacgtacaggtgtgtgattctgtgtctctgtcctgggtgtggccatcagggagggagatgcccacacacagacgactcccccgtatggtgagtgccaagaaaaggggcctcctggccaagggactgctctgctcatctgggcctggtgccgctgtcctcatagtgttcaggatgaacttcttttccagggcttcttattgactcatcgctaccttgttgaagtgagctgccatagagcaggagggtgcctcatgcctcatgcccagcacagacgaggggctcagagtgtgctcctgaggccacaggaagggcgacggactgggctgagctaccctgggtgatacagaacttaaacactccctcctctcctccatccagtctggctcaatttctgcctcagtgcagcccacaaattccttctgggtgccagtgagaagcaggagatgccagggctcaggtcgacagccaccttcctgcccccttggtttctgcctgcctgtcctgctggcacctgcagcctccatttgcaaatgctttgcttttgtcgatgggtctggaggggttctctatgggctgaaacgtaaactggaacttggcagaactgcaaggtagcacgtttctctagcattggatgagtgtgacacatggatgcggtggctccctggaccagctgtctctcagttaaccagccaagtccaagcagaagggaagcagctcttcgattcctggggaattctcctcctcccatctccccacccccatctgcttaacacaaactaggaggcatcagggtggttggcccctggctcatagagggggccacagtgatttttgtcactcaacttgggaaaaccattgtgctcacctggggacagtgtcctgcttggattgtatgctgcctggctataaaccaggcgctctgacattggggttcagtcctggatctgacaccagctgcctgagaaacccttcacagggcattagcttcctggtgcataggtacctgtcaccttaagtggtgtgccacctgaccattctgttgtccctgggaaaattgcaacgcagcctctaggcttttgcctcctgactgatggcttgaggtcccagagccaggactgagcaaggaggtggagttggttaatgttttatgctttgggccgcctagaaaaagctttttccacgtgtcaagggccgggttgaattaggaaagctcatcatccagctattaggctaccccacataattcttctgtttttaaaaaattgcgtctgcatcctccactagcccactagcccatttcaccgtttgatgttatttgccgccaggaagttccagtgtatctaacccagacctcttgggctctccttcagtcagttccctacaagagatagacccgatttcaggctgcagcagcctctcccaaagcatgtttgttaactcctttgcctgcataattttttttttttttttttgtagagatggagtctcactctgtcgcccaggctggagtccagtggtgtgatctcggctcactgcaatcttcacctcctggattcaagcaattctcctgtctcagcctcctgagtagctgggactacaggtgcacgccgccatgcctggctaatttcttttgtattttagtagagatggggtttcaccttgttgcccaggctagtctcgaactcctgagctcagccgatccacccgcctcggcctcccaaagtggtaggaatacaggtgtgagccaccatgcctggcctgcctgcataatcaatagagagcagaaatatcacaagcgtcactgactccccagcagaacatggaaatgaaaatatgttttctcaaagcactgagcttggtgctcccttttggtattatttcattaaacgtttaagaatctgacctggccaggcgcagcggctcacgcctgtaatcccagcactttgggaggctgaggtggccggattgcatgagcccaggagttcgagaccagcctgggcaacatggtgaaaccccatctctacaaacaatacaaaaatcagctgggcgtggtggcgtgtgcctatagtccccgctgcttgggaacctgaggtaggagggtcacctgagcctggggagggcaaggttgcattaagccatgatcatgccactgcacttcggcctgggcaacagagcaagacactgtctcaaaaaaaagaatgtgttaatttaatgtttaacatgtcagaagattgattggcaagtaaagaccttacatctggagctaatatattacatttttagtgtttcagtttactgttttcacctaaattttatcaacccagaagtataggtatcatcccattttactgatgaaaactctgccgctcagggaaactgacttgcctgtggtcacacagccggtaatggagctgtgatttgaacctgagtcttagctttcctggctcagtgccgcttcactctaccagaactacctcatagctggcataagtaaaggttgtttgaggatgtgaaatagattcactttggttgaggcacaggtcattgggaggagtgggtaaggatggaaattcacattggaccaagttactggttctccctgtctctgtctgtactctatccagagcgcgttttatgacaatgcgtctctgtaataggcatgccgcttcttatctttaattttatgggtacctttgggctttgggttttgtccatcttcattaaaggcaaaccactttattgctctatttcttagtggccattaaataaatcatcagatggggatgggtaatgtgtagcagtagaatgtattaataattgagtatcctgaaatagactttcatttttgcagctcgccaagaatattgggaatgcaggctttaatgagatcatggaatgttgcctaccagctgaggactcagtcaaacccaacccaggcagcgacatgtaagtatgggactggctattctcatttgctgagtaaaggtttgcctttgcccgagccccgggaggcaggggaataagaagttttgggtgcatccatcgttgcttctttagggaataaatcagcctatgttgggttttcttagtcactttaaccttttgggtgaccaaatagaaatttttttaggaagaagccaaaagcaggcaggtttcgcagatgctgtgcgtgtgtgcagcgggtatgtagagagcctcactcgccactggtgggtggaagaccctggacttttcacctgtgctgtctgttctgttgagtcacttccccgtcttggtctctctgcataatcctgagccaccgagatggctggttgtggtagatatgtgattatgtagcgtccttcttgccaacgtccttgcctccttgcaaatgtggaatgtgttacttccttcaaaaaatgtttgtgtttgtgttattgttgatacacaacttgacggagaagcttttttttttttttctgggagacggagtttcactcttgttacccaggctggagtgcagtggcacgatctcggctcactgcaacctctgcctcccaggttcaagcgattcttctgcctcagcctcccaagtagctgggattataggcacatgccaccacgcctggctaatttttatatttttagtagagacagagtttcaccatgttggccaggctggactcgaactcctgacctcaggtgatccactcgctgcagcctcccaaagtgctgggattacaggcgtgaggcaccgtgcctggccagcggagaagcttttgtgtctactggtgcagagctgacaacagggaatgttcttgcccatcttatcagagtgtcagtggccatgtcacactagtcttcgagaagaggtggacagggagacccatgggttcgggcagtgggtgtccggctcgccttagacttcagctctgtttagtattatggctcttatgtctatagggggacatgggtggtttacctgttttgttgtgatgcaaagtgaaacagacggaaggaaggagagaggctactgggccagttaacagagcacctgcatttgagtggtgaggctgggtcagcgtgtcctggcaggacagagaaaaatgaaaaatatgtgataagaaaaagtatttaaaaattcatttacagaaacagcattttctgtggaataagcctgaagtagaattaatgacacgagtcttcccaaaggacagtgagcaacagtgaacaatgtctttaagggtggtttcacaaataggtggtagtgtatggaccctttgtaaagggagagaatttagatttttttttccccttcaagacctcttgcccaggctggagtgcaatgatgtgatctcggctcactgcagcatccgcctcctgggttcgagtgattctcctgcctcagcctcctgagtagctgggacaggcacatgccaccacacccagctaattttttgtatctttagtagagatggggtttcaccatgttggtcaggctggtcttgaactcctgacctcgtgatctgccccccttggcctcccaaagtgctgggattacagacatgagccactgtacctggcctagattttttttaaccattttgtgtggcatgtctttgagaaacggagattgcaggacctgtattctttctgcgttttgctgatgtaacttgatacagtgaaagagccagaacattgcgagggagtgaacagggaccatgtgcattacagtctttcaggtatcaggtatctcaggtgagcgatttagttgttgttggattaaagtcagtttatgtttgaatcctgtaacaagtgtttgtggtgtcgcatttccttgagaattggataacgtgtggttttacataccaggcatgaggttgacaatgtgatcatcctctcttgatgaggatctaagtttcaaatctatatttttacccaaacctagagaggcagtagggacatagatatctcagtccttatctgagccatgggacaccggcagattgtttaacttctctgagcctaagctctgtaataaaaaaagggagataacgttccccctcacagaggcattgggggcatgagcgggatgatggggtcagacatgtggtgcttagttttagtgcctggttgacattagctgccctgcttgctcttcttcctgtgggtgacagaagtcacatctgtaccctgcattgattccatacaccctgaaaatgaggttcctctccagttaagtttcagtggagagttactcaaggtgaaggagctcttcctgggcgagcctgagggtcccgcttggtgaaggaaacgtcgtgaatccagcatggcgaggtcatctcctgctgtgcagttgacacctgctctttcagctgcttcatctcacactgacggtaccagcaccctgtaatgctgtcatatcggtcagttctgaacaaagtgtgtgtcgtttcttccaagcaccaggggtacctaacgaaagcagggcatttggttgttctggggctaggcgattctaaaaaatgaacactgtcaatgtggaacccttcagtatgaacgttctgtctgcactgtagccctcctccagccttggcactgttgaaaaagaaatttacatcccccaaccccgggcttttttcaaaatgagggcggatgacccgtgtgatggcgaaacatcagctacttccattccttctcaactgaaattactttcttggctctgtgctcctatagcatttggctctattttaaaacatttcatcccacttcatagtatactcaggcatttacatatatttttctgatgaattacttcttactcattttggtttttcccaccgtaatatgttgcttctggtgaaccagtgactatttaatgaatcagcgagtcaaacaagtactcccagctctgtgcctgcttaaataagctagtattttacttccagatgaaaaggaatacactgcttctagctttatttcagaacagcacaccatctgcagataaatctgttgaaggggaaaccaaggacaccctctagtggcctgtgaatcccaagacggatcttgggggtgtcagggacgtgtaactgggggaggtggagcagggaagctaggcttgtatttgctcacaggagccagaactgtttctccctgtgacttgggaccattatacacaccctgtccttgagaagtgtaaggagagcccctcctctgaacaccaaatgtatcattatgttaattgtttttctgcaaaagcctgtcattaaaaaaaagagggagggccgggcgcggtggctcacgcctgtaatcccagcactttgggaggccgaggtgggcggatcacgaggtcaggagatcgagaccatcctggctaacacggtgaaaccccatctgagggatcacattagcaaagcaaacctccttcacaaaaccagggggcatgtgtggagttaaacagacctgtgcccatgtttgtgtaggagctgccttcggggcctccaagccctgggcagatgagtaaatacattaaaaaacaagtaaaggaagtccactttctctctatccctttcctgtggaggtcgcagtaatgattgtcccacagtgatgattgaaagtgcatgaaactggacaactgtccagtctaactgcctgtcagaagaggcatttacatcattaaatgggctgcccaccatgacactcgccaggccaggaatggagcatctccctgggtgtcacactgtgctggaggccctaagaggagaacctgcaggaataaaatgggtcttcccttgtaggcccaccagctgcctgaggaaacagaatccagtttccctttatggacttcagtgtacagtaaatcctgaatgttccagaaactcaaaggtttctggaaacctgtgactttaagcaaaatgatgtataagaaaccagttttaccctatgccaattgatgtaaaccagagttcagttcctaccatgtatttctgatcatgagaacatcaccaaacttttgaataaaggcccagaacacttctaatattaaacattgaaatatgagcgatgcatacatttaagaaagattctggctactaagtgggataaagaaagatcataaaaaccagtaagataatgattcacccacttattccagttcagggtcagaggtggctggagcatgtcctggcagctgaagtccagggtgggaacaagccctgaacaggaccccgtcccactgtgggacgcagtcacacccacgtccacactcagtcgcagtggggcctttgagacacagcagttagccgaacgtgcacagctttgggatgtgggggaaaccggagtgcccagagaaaacccaggtggactccacacagacagggaccctgcctgggaattgatttttttcttaacattataacaaaatgctgttattcgagggcctgttgtgcctacaggtggagatgaaaactcatggcactgttgagggaacccactgagaccacgtatctcacacacaagtcagccagcaccgcagtgagctcagtgcacgggttagcgctgtgtggacggggagcatgtgccgggggacgttgaggcacccgccttaacctaggccctgtagagcgggcagaactggagccggagcaggagggaggcagtgtgataaaagtgccagagcacaagttcaccaggtgcccctggaagtccttcctgggctgtgaagcatgctgcctgctcaggtggaacgggcaccctggggcgtgatttcctctccagctgcaccagccagcctcacgctgcggcgtgtccaggagccacatgcacccaaggacaagcagatttgaggcctggcagacgctggcaagagacctctgcccactcagttccgtctgggtgctgtgggagtaatggcttctcatcttaggctggcccatcttcaagggaccccagggtagacaggatctctactccctgcctccagtggcatgtccagggagctcaggctccccttctggggggccagttgttccacggggatttagggcaggtacagaaaagtcaacaactgctccagcagccatggccccttgccatagtcagctgagtgagagagcggaggtcaggagggaaccgtgcggggactccagctcgaaggggagcagccgcatttgtcctcagattgtaggcagtgctgtgttacaaatggatgcaactgatctgcccctgcctggctcttgcctgattctcaagattcaaagagtccctgggcagtgaccctcaaccttcagaattgggattgtaaaatgcatgtactctgtgaccagtgagctgctgtttcgctctccctcttgtaagttcactgggtctttccaaggcccgggacccactgtgtgtgctgcaggtgtgttgacgcacatacgtctcatggtgctactgtgaggatgtattgtgtgcattttcgcaagtcagacttacaagtctagagagatgaaatacttattcaagttcaaagcagcagtgtgtggtgggagtgggatttgaactcaggcttctttggcccccttttgttcctgcttctgtaggctctttggatggggcggagtctgagcatgttgccacataaaggccagaaagtagaacacaaagaggactgccatttcatttcagttcatctgatagtgcctttcataccaggcatggtgcctacaaaaaagaggtcatagtccatgccccaaggagctcatgggcctgtcgggcagtgaggcaggcaggccttcatgtagagaatgttggaacagaggttggccagggctgcatggagggcaggggcagggccttcctgggggaggaggcgcagggcatgcggattggaaggacctgaataagaagggcgtggaggtgacgagggcgacagtgaggtcagatcacagaacttaggagtgaggggagggagacaaggcagagaggcgggtgggctgagagaacatggggagttgtccccctggccagttcccaggaggtcgcagtgaagaccagtgcagccgtagaaccacatggcggccactcccgctttgtgtttcggggccagcggtgcttaccagggacatggcgcaggaaccgttaacatggccttagacaaagggaggccggacggcgggtagaagcccttcatgatttgcaaggcaattacgtttggtttcaggaatgcaagaaaggactacatcacagccaagtacatcgagaggagatacgcaaggaagaagcacgcggataacgcggcgaagcttcacagtctttgcgaggccgtcaaaacgagagatatttttggattgctccaagcttatgctgatggtgtggatcttacggaaaaaatcccactggccaacggacatgtaagagtgtgggttgttgctactttaaaaaaaaaaaaaaggccggccacggtggctcatgcctgggatccagtactttacttcaggaggccaaggcggaggatcctttgagctcaggagtttgagatcagcctgggcaccatagggaggccccatctctacaaaaaaaaaaaaaaaaaaaagtaaaattggccaggcatggtggtgtacatttgtagtcccagctactcaggaggctggggtgagaggaatcggttgagcccagaaatttgaaactccagtgagccgtgattgtgccactggactccagcctggccgacagagtgagaccttgtctcaaaaaaaaaggaaaactggggcactgtggcaggtctgtggaatcagcagtactgaccaaagctgggtaattctccagaggaagacggcacggagaggggtactggggtagaataaactaggggtttttcttttcagtagaaaaataattgtatctatgttcatggggtatgctgtgatgtttttgatctatgtttacatcatggaatgattacatcaagctagctaacatatccattacctcacaggctcatccatttttaatggagagcacatttaaaatcgactcagttttgaaatagacgctatgtagtcttacctggagtcaccaggctttgtagtagatctgcaggatttattctccttgtctaaaactttgtacccacctagtggtttattcttacaccaaaaatgtaatgccagctctggaaagaaaacccatctccaggtggaggagaagacatctcagaagctaggcagcctgagagggacccctcatctgcaagcaggtttaacctgagcttcatgctaacgagagaagctctctgagaggggcggttccctggaacccacaccccactgtgctccccctcagagggaatagagtaggagcaagacccctcctttcctgggggagctgtcttgagagggtgggcatccagctggagtgggtttgcagtaacataccagcacccaagtggggtggcatgtgtccagattctggtccacaaataccctgtagatgcacatttggtcccctggaacctcctgacctcaggactgggctggctgcctatcagcaaggatgcctcacggctgcagcatctttctcttggtaacaggcatgtccgtgcaggctctgagctggtcccactctctccccatccccagaaagaactcatgcccaccaatgcagtgtggagggtgcccagcactgagctgtgctgccgccagagggcccagcaggcagggcaggcggcctgggaagcaccttcctttgccctcacctcctgtcttctgtatctgtccttctcctctggttctctcacccacccacctgctgaaacaatccttgttcatctcttctcccccacctgccaggtgtactttcagaaaaggcagtggagttggggaatccccagtatgagttggagacagtgcagttattagcattcgtagccttgtctgtaagtgtagaacgcaaaactttaagcctgcttaagaaacatatgtttctactcaaggagcaggtaaagagattggattgtaggtggcctgggggaccttcctggatcctttgaacaagattcttgcttgcaggcagggatctgccttgtggtgctgatgcagggatggggacaggtcgattgagaggacttagaaatgaaactcctgaacttctcatttatttcccatggagtcaggagaaacaggacgaatctccaaattgcacgttcccaagggcaaagagcttgtgtagagattaaagagactctatgtaagagataagtttctcgaagggaaagataaaagacttttggaagagttgtacacgatttcaccggtgttggacacagaattgaatgctcccattagaattctggaatgcctttgtttggtttttcaggagccggatgaaacggccctccaccttgcagtcagatccgtggatcgaacctctcttcacattgtagactttttagttcagaacaggtaggtgttctgaaattaagggaggcactcgttttctccttggtatttctggggaaggaatcggacgctgcctcatcgcttctgatgtgttgtcaggagaaccttcccagttctaaacatgaattaaagacagaaaaaggactgccaggtgtgaggtactccatggcaatcctttaaaaaagcactagaaactcttttgtggtaattgcagggtccaacttctagtgtctggtactcagggagacaccaagtagatatggctactgaacttggggaccccatgaccaccctctgtgcacaggggccgtcctcgcctcatcctgtgagccaggtcatcgtactgcgcaagcagtgtcctgagcagtagggaggtagcaggcaaggagggatccacacattagccatggtctgagccagagattagaaaccagagcactggattatgggtgttttgtttgggtcgagaagttgtttttatgctttgattagaaatggcctttagagatgtgcacaggcagtttaccacagatctgggagtccccgtggtttggggcatattgcttcagtcatgtgttacctgcctggcagctgaaggctggacttcaagacccctcaacgtgtattttgactccctgatcgtggtttgagccatgtgtgtactggaggaggaggaggtgctgttaaaagccacagaaattgctccaaaggaaatggaaaattccaaaatgcaaaagccatgggatagtttgcattttgtgtcctctgctttttcctcccatttctgagcagaggagtgaagaaatggccagaaagtaggggagtgtggggtggtcaaccccaagacctgcagcttcttcctgaggaggctgagttcactggactcgtggtggaagctgccctgatgccccatctctgagtgccagcccggctcctagaacgcagcaggggtttcgtaaacatttggttgatagctgcgtgatgcctctccctccatgcacattttcagggggcaggagagggaaggtcccagtttctttttttccagagtggaaggaggacaaaagtgggggagaattctgaaaatgaaacacaccccccgctccccatgcccacaatttggtgaaaaagaaactccttttttgatattgaaaatgtaattggtttccttctcatggaagcagcaggtgccacttcctgagatcgcctttctgtctccactttgtgcaggggcacaaagctcactgcccctcctcagaatgtgacagtggccatgtttgctaggattgagggcctgtcccatgtctgccaagcctgagcaccttttgtgggtgacctggtcttgtgatatgttggaagaacttttgaaaatctcaagattcccctttagcctgttttcagagggtattcccagggcaaacaggccgaggagcctggggactctgggctttgggaaagtgacttttccctttcctggagggaatatcaaataatgatagagaaaagctcagcctccgtcctcccgtgggacaggatggatgagtcacacaggcatccagaggccctgcatccagcacagctggccggcctagcacagcagcctcggcgcagccagtgggacgtgagaaggacgctgggctctaggttcaccccggtagtgcactgccccaccttggccccacatgctcagcaacaacagggatgcccccctccccttttgacctcttctgccatcatcgtgttatttccctgatgaccttctgctaaggcttccccagccatgtaggcagggacggtgccaggtcccaccaccttggcgatgatttacagaaaccgttcactcggggactgtctgcctttcctgtgcccgtagcccaggctccctgccgggcagtccctggtcgtccagcctgtgacacactatgctctctctctgttcctgttctcgggcagtgggaacctggataaacagacagggaaaggcagcacagccctgcactactgctgcctgaccgacaatgccgagtgcctcaagttgctcctgcgggggaaggcctccatcgagataggtgagtgggcccgggccccgggggtgggctcagctgcaccctggcctctgcctcctgtctgccatccaagcgctgctcttggaaacagggccaaccctgtgggctcttgttagtgccaaagagaaggagaacctaccgctaatgagaaagagcctctccctgcctgttccacgaggccgcattcaccatctgttacttagactttgggcgcgtttacaggcattttacagatcataagacaagcaaagggtgggtcttgcagctctcacggatgccaggtgaatttggacaaggttggggaattttgacctgttcacataccctgagtctactcacccccacctgaggccacacttggcccctttcttggctctgggtttagacggattacagggggagatgctgtttactgccctctcctttcatttgcaccactgcttcctccatgaagggccctggttgttacttggccccggtccctccctctctcgaggaccccgacatgccaacagccaaggcacagttgtgccttgagagcatccagctgttgtcccctcaggaggaagtatttttgaaggactgttaaataaagaggaaagaatagaaaaaagacacacatctgcctgagagccgtgcttatcattaaaaaactaataatcagacctcattgactgaggcttatttagaagaaattataggccgggtgcagtggctcacgaggtcaagagatcgagaccatctggccaacatggtgaaaccctgtctccactaaaaatacaaaaattagccgggtatggtggcgcgcacctgtaggcccagctacttgggaggctgaggcaggagaatcacttgaacccgggaggcggaggttgcagtgagctgagattgcaccattgcactccagcctggcaacagagcaagactccatctcaaaaaaaaaaaaaaaaataaagtatatactttcagggtttatagactgcttgagagaaggtttaaaagtttgttatattgcagtgcatggaaataggtgagcagtgcttttcgttagaggtttatgatgaatcgctttattcaatgagttacagtttggatgtggattttaattaggtggctgcttcaacagtttttgtttttgtttttgttttttgttttttttgaggcagagtctcgctctgtcaccaaggctagagtgcagtggcacaatctcggctcactgcaacctctgcctcccaggttcaagcgattcttctgcctcagcctcctgagtagctgggaccacaggcatgtgccaccacgcctggctaatctttatatttttagtagagacggggtttcaccatgttggccaggctggtctcgaactcctgacctcaaatgatccacccacctctgcctcccaaagtgctgggattacaggcgtgagccactgcgcctggccagttttagtttcttgattagttcaaacttcatcttttaaagttttaccttctgtatttagctgtagttctatacaattacaagatacattcagcctcgactaggtcaaactcactgtggatttcattaaccaggcccaatttaatttagtgctgcctttctgttccttttaaaaattgtcctggatgtcaggcctttgctgggttttgccttaacgcctcctttgctcgcccttgaattttagcaaacgagtcaggagagactccgctggacattgccaagcgcctcaagcacgagcactgtgaggagctggtgagtctcccaccacaaggacggggtggggcacctgtcacgggacagggagccaagcctgtcctccttgggcagggtttgctgtgaaccagtgtcctgagcagagctcagtgtttctgatgggatgagccgagaatcagcctgccttggagaaggtatgctagggagtctacagggaaacctagggggacccacccctcgcagtgagacttggggtgtgagtcagtgtttgctggttggccgtgttggtaacatcactgctgtggtgggacaactggaacagaggcccgaggccaccacaagggcctgctctctggcctccgtaagctgtttacttgctactttgcaggacatcaaggccaacctcctttctttgttcctcagccccagatcatgtgggttgctcaataccatcttttcctgttctggaagaaaagacaatgtagacagtagaaagagcccaccaggccaggcagccctggccttgccgggggctccccagcttggcttgggaaggaaactctcttaggctgtttccttatttctacagtgcagtcagttataccagtatataaggttgttgtgagaattattatcaaatgctgtaaagcagttgacacacagcgctcagtaaatagattaaggccaggcacagtgactcacgccttgtaatcccaaagctttgggaggctaaggcaggggatgatggcttgaggccaggaattcgagatcagcctggcaacatagtgagactctgtctctgcaaatgatttaaaaactagcaacgcatggtggagcatgcctgtagccccagttacccaggaggctaaggtaggaggatcactttgagaccaggagttcaaagctacagtgagccataatggtgtcactgcactccagcctgggcaacagagcaacacgccatctccacaaaaacgtttcgaattagctgggtgtggtggcacgcacctgcagtcccagctactggggaagttgaggtgggagaatggacttgagcttaggagttcaagactacagtgagccatgattatgccaatgcgcaccagcctgggggagaaaaaaaagaactattaataataaatgctatacaagtgtaagataagtaacaggtcctctttctaagcactgtacatccacgagctcatttaatcttttttttttttttttttttgagatggagtcttactctgtcacccaggctggagtgcagtgacatgatctctgttcactgcaacctccgcctcccaggtttaagcaattcttctgcctcagcctcctgagtaactcggattacaggcacctgccaccacgcccagctaatttttatatttttaatagagacggggtttcaccatattggtcaggctggtcttgaactcctgacctcaagcaatccacccgccttggcctcccaaagtgctgggattataggcgtgagccaccacacctgacctgtctcatttaatcttcatagctaccttatgacatagtttctgctgttgtcctcattttacagatgaggacacaggcacaggaaagttaagtgacttggccagggtcatgtagctactatctggttatgggggaaattaagccctgaggtcctgagacacccatagtgtgtaacgaattaacttctcttctgcacatgtagaacggaactagctatctaccttccttgagagaactgagaaaatagccacacagatcattttctacagcgtttaattctctcatcctggttgaaaaggctgggtttacagtgaatgagcacattcattctcctggggttgagctttctcccatatggagtatggatacttgcaggctgatcagcatcctttagatctcaaatatcctttgcctgttgttttggggaaaactctagccctgttttttctgtacggttacactgttgtcacaacaagcaatacagaagcagactgctgtgaccaaaggtgtggggttctcccccgaccccatacaccaattgtagtcgcctgacaggttcttcttgcctgctgcatagattaaacccaattcatgagacagtgtgattgcagcagagaaagagtttaattatggcaagctggctgagcggtgggaggacaggaattattactcaactgtgtccccacaaaggctcagaggttagggtttttcaaggatggttggatgggcaagagggctaggaaatgggtgctgctgattggttgggagtgaaatcataagagtatgagaaacagcccttgtccactgcatatcatctcgggggggccacgggactgtttgagtcatgagtcaggttcagtggagtcagttggtcaccaggatgcaaaagtctgaaaaaatatctcaaaagatcagtcttaggatatgttatctataggatcaattggggaagtcacaagtatcgtggcctctggtgcagtaaacaatttttttaaaaaaagacagtgtctctctgttgcccaggttggagtgcaatggcgtgcttgtggacagcctcaaactcctgagctcaagcgatcctctcacctcagcctcccgagtagctgagactacagatgcatgccaccacgcctggctaaaaaagtttttaaattttttgtagtgatggggtctcgctatgttgcctgggctggtctcaaactcctggctcaagcagtcctcctgcctcagcttcccaaaatgctgggattacaggtgtgagccactccactggatggtaaacaattacattaatagagaggcaagctgcacctacattttagcagaattcagacccttcccataatcctaatcttgaggcctttcattagtcttccaaaggcactttcaagttccctaacaagaacagagtcagttttcacatgcacacgtatgtttattgcggcactattcacaatagcagagagacttggaaccaacccaaatgtctgtcagtgatagactggattaagaaaatgtggcacatatacaccgtgcaatactgtgcagccataaaaaaggatgagttcatgtcctttgtagggacatgaatgaaactggaaaccatcattctgagcaaattattgcaaggacagaaaaccaaacaccgcacgttctcactcataggtgggaactgaacagtgagaacacttggacacagggcggggaacatcacaaaccggggcctgtcatggggtggggagacgggggagggatagcatcaggagatatacttaatgtaaatgatgagttaatgggtgcagcacaccaacatggcacatttgtacgtatgtaacaaatctgcacgttgtgcacatgtaccctagaacttaaagtataataaaaaaataaattaattaaaaagaaaagaacagagtcagttttagggagggactattaccatccttgattcaaacttacaccacaaactaaattcttcccatggttagcttggcctgtgcccaggaataagggaggacagccagcctgtgaggccagaagcaagatggagtcagccatgctagacttttttcactaccatgttcttgtaaaggcggtttcacaagcagcagacaccagctggctgtcctccagttcaattagacactatctacttggaggtagtgttagatcccacaggctgggggctcagtccccaagactgtcttccaccccagacaccagtcacaaatcaacctccagaacttctgaccaaccggcttcaagttggggttcccacagccccctctttgggtttgaataatttgctggagtggctcatagaactcagggagacacttgtgtttactggtttattataaaggatattgcaaagcatacagatagagaggtgcgtagggcaaggtgtgggggaggggacatgggggttccatgccctccctgggtgccaccctccaggaccctctgtgtggtttgccatcctgaagctcgagaaccagtcctctttgatttttatggaagcttcttggtgtcagcatctcttcccccagggtacagggtgagaccctctctggggagggccttaagacccacagtcagaaaagtgggggacgataagagtcctgccttggggcaggagaagttcagagagattctgtctcctgaggccttaacactccatgttataaccgaagactgtaacaagggatttgagagttacgagccgggaactgtggatgaaaactaatacagtttacaaagcctttgctgggacataccagctttgagtttcaaggttacgctgtgaagtaggcagaggggcgggggcttcacctgagacccagagatttccatgcatttgccttggactagaaggcaggcctcctgcctgcacacttcagtgggtccagatgcatggccgagtgtatgagcaacagcactgaccatccctctgttctctcagctgacccaagccttatctggaagatttaattctcacgttcacgttgaatatgaatggcgactactccacgaagacctggatgaaagtgatgacgacatggatgagaaattgcaggtctgtgccaggttgctaaccattaagagttttgatcagcttcatccagaacagtgtgggtcctaatctgtaattaaggcagaaagctgttttatagaaatgaaaatgtagcttactttatgctttcattgatctcagtaggctcttggttttacccttcccactaccatctcctgtctcccagctcctgcacccattaatttaaaggaatggctaattatgtacttataggcagccttttgctacaaaggaaaggtgtgtgtggcgggggggttgattccagtggatttagaggaaggtctcttgctatggagtcatgtcataaagagccagatttcccccagtctaggtgatcacattctcctggttgatcttataaaaacatcaactgaaatcatcagacgacctttagagctcactgggtccaaccccttcctttatcagtttgggatattgaagcctcaagagaaaagttgacttggccaaagtgaagcagctatttagaggcaggcttgggactgcacgaaggctcttgcctcctcctccagctcccttcttaccatcctcactgcttcatacgcaggggtgagccccaggaaggttgctgccttcacgcaggacttggagctgagagtcagacttaggccttgtgacccaaagccctggctcctagccgcgacccacttccatctgtccttcagcatggtgcttcgaggcatgtctggaatgtgctctgtgctgaattagtggcaaatgccacattaaacacattttcatggtttggcttttttttttttctgtaatgcattaatgttctgatgtgtattgaggatatctaattagatggatggataggtcagtaggtaaccagatggcatttctgaaacctgttggactgtctgctcatggagttaacatccatacttaactgcttcttagaatacagaataagaaattacttcactgagttagctacaaaacactgtcaaagtgagaagagttgactgatttcatacttaacctgccttaaaaaaaaaaagctggaagcagtctgccccagcctgcctcttcatcaagcggtcagatgccacattcccatttgatgagcagtgatgaagcaggttgcatagtccaaggaaaagcacaagagcaggggctggtgtggagtcctaagactcatccacgctgctcacctgattctcagcagacagcagccgtgggctttgcaatttagaaatatgtgtgaagaaccactgggtgcttagttctgcacacctgagctgggtttgaaccattggtttgtccagaacctagaaagggttggtggtcctgtgagggagaggcagggctgccacagttcatactgagcacctgctaagcacctggcattgtgctagaaaagcactcgtcatatccagtgaacagacaagaatgtggtcagcaaggttgagtcatttgctcacaatcatacctagtttaatgaagctggcatttgaaatagaagttaggtctaagttacctgagtcatcattccatgcattcacttccaagaaagcacatgaccggccgagcgcgggggctcacgcctgtaatcccagcactttgggaggctgaggcgggcggatcacgaggtcaggagattgagaccatcttggctaacacggtgaaaccccgtctctactaaaaaatacaaaaaaattagccgggcttggtggtgggggggggggcgcctgtagtcccagctactcaggaggctgaggcaggagaatggcgtaaacccgggaggcggagcttgcagtgagctgggattgcgccactgcattccagcctgggcaacagagagagactctgtctcaaaaaaaaaaaaaaccatataaccttcaggggggagcaggggtggccaaactcttaaagggccagatagtaaatattttaagctctacgggcctaaagcgtcacagtccatgttaacaattactcagctctgccaggatggctcaaaagcagccttagacagtatctaaatgacaggacatggctatgttccaataaaactttactgacaaaaaacaggtggtagtccataggccactgtttgctaaccctaatttggaggaatctcaggagctcctgttcatatgggaggaaaacatcgatctctgctgaatgagccatatagctgttggagattgagtgcagcgggctggccagagctggccaccctgtggggtagcataagaaggcatgtttgggaaggggaacttcagggaaaatgctgacttaggttgagataacttcgactcataagataaatagcttatattttaaatccatcacagaatggagaattttaacctgtaattaacagattttttggtatgtgtgtgtttactagtcagttcttacactgctgtaaagaaatacctgagactgggtagtttataaaagaaagaggtctaattcactcacacctccacatggctgggaaacatacaatcatggcagaaggggaagcaggcacctcttcacagggtggcaggagagagagcaagcgagagcagggaaaactgccttataaaaccattaggtcttgtgagaactcactatcccaagaacagcagaggggaaccgctgccatgatccagtcacctccttccctcgacaagtgaagattacaattcgaggtgagatttgggtggggacacaaagccaaaccatatcagtgtgtgtttccttcacgagacacaaggaggagtgaattttcactcttgcagctctcacgcaacttgtagctctcaggcaacagttgagagctcaaatggtaccaggcccagcagagttggtgtcagtgaggttttcacccctgtgttgaatgttatcaccaggagcagttcatatttgtctcacacgcctctgccccaatgttctcctgcagcccagtcccaaccggcgggaagaccggcccatcagcttctaccagctgggctccaaccagcttcagtctaacgctgtatctttggccagagatgctgcaaaccttgccaaggagaagcagagggctttcatgcccagcatcttgcagaatgagacttacggagccctcctgagtggcagcccacctcccgcccagcctgcagcccccagcaccaccagcgcccccccgcttcctccacggaatgttggcaaaggtatgaagctgtccgtcatccctgtgaatatatagagggtcttgttttgtggtttgggaagtttgcagctgccctgcctccaactcagtgacctttgggctcttttgttttgtagttattttctgtttgcttcctaaagggattccatcattcttatcaggccagatggtggtagagtctcttgatttgactcttattctgggcagagttgtggcatctgcctggcttgggtaacatgggaactcccccagggcagcctgaggtggccaactgggctcccggggctgggccaaaagacacactccttcaggtctcccctctgcacccttctgtttacctttctccactccttcccaggccttcattcttcctttttatttctcttctgccttcatctggtccagctcatggcccctgcgattacttcttacccatgatccccataaaagatattggggaacgatgctcggcctaattgtaaaatacaaaaccagccctgtgggcctaccagtgtcttagggcaaaaagcatgcttttcttacctcagctgtaacctggaggttttgactcaacaggtgacactttctgtttttagaaatacgcaaaccaaagctctcagaagttaagtaatttgttcattcctgaagagcagctggctacggtgcttcttgaaggcaggtccggcgagtgacccactcagctctgggctgagctccagtcgtggccatggccttcagagggtttcccacatgaaggaggctgctgagactttgatgcggggcggggggcccaggaaggacaagagtctgcacagagcatgtatccaggcattgtggccgctgtgagccgctgatggagtggagcccacgtccccaaatacatcccaaactgtccttatgtggtagctgctagctgggcaggctgggtcggtgcgtgagggtggctgaggccgggagacctggcccagggctgagcagacggctgcagctttgtgctgcacgtacactcggctgtgctgctgggcccatcttccctgccgtcctgggtgtctcacagaccctcacacggctctgcccctgtcattcagggaggcccagagaagtgacagtgaacctgtcatgtgagtcactgagtcataccccgaagaacaaacctgctgagagcagaccttcccccaggcaggcccagaagccagctgcttgctgtccccacacagcccacatcccagaccgcgtccatccctggcttgatgaggacgtccctgagcacagaaggcagctacaagatgaagccacacagtcgcatctcctccctgtcaaacccccaggctggctggtcggggcccagggtgggtgcggctttctccccgcctctcccagatcctgcaggcaggcatcaattttctacggcccacaatcaagatgattttgatcatcctccttcccagcagtggcttttgctgactgtgtgtgtcacgggaggaaagattttattttgttccactgggtcatggaggggtaaactcttaatctcctggtttcccgaagtcttggaattcaagggttttgattttttttcctttttctttttgccgttcctgtccctagcatcatttcttcttccagtaatgtaggtcataccccttacctgccatctccaccattctctgtgtagcccacatgtggtcttggatggaattctcacatgcagataaatagcaaatggagttgacagtgtcagccttgcatttggggcggacctggctccccaggggaggagctcgaaggcttcctctggacccagtggcctggcccatttctaggcctagcctttgccctacaggccgtgcacagcctccaacatggggtcacacctagcacctgggccctgtgcacctgagcttggaggtttgtgaggcagaagaagggcttgtgacctggaaaatgccatctcttgtgggtcacctgaacctgattggtgtcatctgtgtctgcttccagccagaaatatgtttgcgggagggagggagagagagcccctcctctagtgtctgatttgcactctgcccccaacctgtgccagctgggcacacggtgttcctcttcacatggtggtgactcccacagcccatgggaaggagtcggtgggagggtggagaggagcagaagttccagaagctccaagtgcagtgttcgcaagagaacattgtgactgtttatttccttcttcaaatgatactgatatttgataaataaactcaggaattttaaatttcatggattgagaaaacctgctgagaatagtccttggagcctcttcggtttcgcgagtatcagtgtctatcttccacatgccggagacaggagtaaaagcattgagggttctaggtagaagggtcatactgaccgtttcataagggggaggatcaataacgcagtgttctgtttctgtttttgttcgtgtgtgcacgtgtatgtgtgcgtgcatgcgtctgtgtgcatgcgtgtgggttcagttcagacagcctcctctgctaacaccctgtggaagacaaactctgtaagtgtggacggtggaagccggcagcgatcttcgtcagatccgccagctgtccatccaccgctgccccctcttcgcgtgacatctaccagtacgtttttttcctttttcctttcttgcccgtgggctttgtagatctggatggcggggggtgctctctggagccacacagctgccagcacagacacgtgccaagtgccccgtgttgtatggctccctgtggctcttgtgcagggctctcagctcccccagcctccttcgtcacagctgcaaacccctgcctgtccccacactgcaccaccaagtagcttcctcactcccttcctctgtcttccaaagcatttcagcaacatttcctcctttacacagtaccccagggtttctttttcctttggccatttggtgattttcaatattttggggacagtcacttggattagaatctggctttttgtttttcttttctttttctttttttttttttttttgagacagagtctcactccatcgcccaggctggatgcaatggcacaatcttggcttgctgcaacctctgcctcccgggttcaagagatcgtcctgcctcagcctcccaggtagctgggattacaggagcctgccaccatgctcagctattttttttttttttttgtatttttagtagagatggggtttcaccatgttggccagcctggtctcgaactcctgacctcaggtgatccacctgcctcagcctcccagagttctgggattacaggcatgatccatggtgcccagccttgtttttctttttaagacagggtctctctttgtcccccaggctggagtgcagtggcacaatcatggctcactgcagcctccaactcctgggttcaagggatcctcctgccttagcctcctgagtagctgggattattggtgcaagcgtattttttgtagagacagggttttgctatgttgcccaggctcgaattcctgggctcaagtgatccacccgccttgtcctcccaaagtgctgggattacaggtgtgggccaccacgcccagcctggcatgttttctttaatatcaacatgtggttgaaagtcctgaaaaccttgggtaaagaagcgggaggaggtttttaggaagaagtttttctccagtgtacagaactaaagtcttttttcactggatcagagaagcgagccctggatgctgccctgtctcctgctgcagcagccctggagtggggagtccagcatctctgggcttcattgcttccagagcatgagaattctagagccgaggtgctcgtgacttccttagagtaagttaaaattaaaagcagcccagccccagctagagtcagtgccatgtgtgcacatgccggcagcagagccgggagcagtgggtctgggagggtcttcagaggtttccaaggcgaacacaccaaaggccagaaggaaccactttcctgcctctccgtctggtggtccaggggctgcatttgtgtgctagagtcagacttttgagttttcctttaaattggaaaaaggaaacaataatgataaaaagaaagatcataagctggatcccttcatgtttccccacgccagtttcctctctgtgtagctgaaggcctcattcttcctggcttttcctggcagagggaaacccagcgccttatgtgttacccatcctgaggcccagtatgataagcccgacatttagagagggcttaatgcctatcaagggaggagagacggaggaaggagacttggactcacagcctccctccaggtcttaccagctctgccacccttgacgagagctcttcccctccgtgggcctcagcctccttgtctgtaaaacgtagacactaagaaagctcttcacccacccactccggagactgaggagccgttactaagttagtagctcccatctctcctcagatccaccctgcccagcagcccgatgaagtgggtagggcctcatccctttggccacaggtcagtcgatgtgcaaagcaggccctgcttccccgggcagagctgagggccccggcctcctgctgttgggtctttgagtggagagcaggaaactgctggctttcccccagggagttctagctgagaaaatactcactcacaggctgatagaaaaattgtcatcctaactttaggctcccagcttccttattagtttggaaaggactccctgcttcctccctgtgaatggttttctgaaaactggcaaggaaatagcagcaggtttttccttaggaaatagcaataaaaaactgaagcccttctcagaaaagcctccagtgaggaggcctgagtgggaagcctggcggctgaccctctgcacgtctctccctgtcctccgcagatcccctgacccccacgccgcccccacccgttgccaagacgcccagcgtaatggaagccttgagccagccgagcaagcctgccccgcctgggatctcacagatcaggcccccacctctgcccccacagccgcccagccgcctcccgcagaagaagcctgcgccggggtaagccacccccagccagctcggccatccgtgctcctgccctctgacctcacctgcccagggctctgcaggaatgtttgcaatccccagggctcctactccagcgtgggcgccacataactaattcatcggggctgaagggtcttaaaaataactggaggatttttagactgtaaaaatgtcttacaaatgtacattttaagtccacagaatgaattcagacaaagtgtcctcaacacacaaggcttctgggttctatttgctgctcaccccccaggtggtctctgtttctgttttctattttcccaaggttgttttgaacacatagaccctctgtggtgtgaggcgtggatttcccacaaacaaggacattgtcctacctcacacaataccacctgcaaaatcaggaaattaacacggatgtagaaacaccacccaatccttagacccaggtcaagcttagctgtttgtccaaataatgccccttgttgcagatgggtctagtttgtggcttttttttttttttttttttttgagactgagtctagctctgtcacccaggctggagtgcagtggcgtgatctcggctcactgcaagctctgcctccagggttcttgccattctcctgcctgagcctcccgagtagctgggactacaggtgcctcccaccacgcctggctaattttttgtatttctagtagagacgaggtttcgccgtgttagccaggatggtctcgatctcctgacctcgtgatccacctgcctcggcctcccaaagtgctgggattacaggcgtgagccactgcaccaggccccagttcgtggctcttaatctggatctttatggtgggaaatggttccttttagtggaaatgatatttagaggccaagttctgggggctaggtggagagtcactgctcccacacaggccctctgagctgttagaacttggaaatatacgcacatgtacatggatacatacatacaccacttatctctctattccgtatatttctgtattgaaatccatgagttcacattgacatctctgatttcagttgttctagtaacaaaccacaccagactgacagacatgaggcacagccagtttattctgctgacagattgtcaggaatttggatggtactgtggggtcttcgtcttttctccacagtgtctggagccttcgctgaaaggactcgaagcctgggggtggttggacacaggaggtgactcgttggctgggggttacggtcagagtctcttcacgccccccgtggtagctgacgctgcctgtcagccagagcctcagctgggctgtgaccagaacacctacatgtccctggcatgggcttcctcatatcacggtggctgggtccacggacaggtccccagagagaggcctggccctggaagctggcacggaatgacttccgccatacgtcactgctcagttacaagctcagacacagtcggggcagagaggactgtggagtggcacaaggaagtcatcagttccacctctcaataaagaatttggggccaggcgccatggctcacgcctgtaatcccagtactttgggagaccaaggtgggcggatcacctgaggtccagagtttgagaccagcctggccaacatggcaaaaccccacctctactaaaaatacaaaaaaattagctgggcatggtggcatgcacctgtaatcccagctactcaggaggctgaggcaggagaatcccttgaacccaggaggcggaggttgcagggagctgagatcacgtcattgtactccagcctgggcaacaagaatgaaactccatctcaaaaataaaaaaataaagaatttggagactaggcaccatggcccacatctgtaatccctgcactactgtgtttttgtttttttgttttgttttgttttgtttttcttgtgttttttttcttttttttttttttttttttttttttttttttgagatggagtcttgctctgtcgccccaggctggagtgcggtggcgcgatcttggctcactgcaagttccgcttcccaggttcacaccattctcctgcctcagcctcccaagtagctgggactacaggtgcccaccaccacgcctggccaattttttatatttttagtagagatggggtttcaccgggttagccaggatggtctcaatctcctgacctcgtgatctgccctcctcggcctcccaaagtgctgggattacaggcttgagccactgtgcccagcccatccctgaagttttttaggagtagagaaataaagttaaacttttacttagtccctctgtttttcaagatattcccaatagccgcacctggtatcccccatccagacaccgtccgttttgccctctccaagaatagaagcttcctgtccttagtaggttgggcagggcagcggctaaggctactcagagctggggcgagattccaggggttcaggagctcctcagacagatttttggctaattcttctgcatactaccttgcctttctccccttccagagggtcctgagccttctgaggacacttcaggactacagataggagcatttcagggccttcctcactgctggagtgggattccattcctgagatcaactaggttgactgtgatttatctttcactctgttgcccaggctggagtacagtggtgtgatcacggttcaccgcagcctcgacctcctgggcccaggtgatcctcccacctcagcctccgcatagctgggaccacaggcacgcaccaccatgcccggttaatttatttttatattttgtagaggtgggggtctccttatgttgcccaggctggtctcgaactcctgggctcaagcagtcctcccaccttggcctttcagagtactgggattacaggcatgaggcactgcgcctcacctcttttaggtttaatttttaaaaatccttttccttggaaagaaatggaagtaaatgtacttaaatctgccattttaaccagaagactcccaaaactttttaaatgctactttgcaagataactttctaaaatataacatgcagggctgggcacagtggctcacacctacaatcccagcactttgggaggccaaggtgggtggatcacttgaagccaagagttcaagacctgcatggccaacatggcaaaaccctatctctactaaaattacaaaaattagccgggcatgatggcacacacctgtaatcccagctactcgggaggcagaggcaggagaatcacttgaacccaggaggtggaggttgcagtgagccaagatcacaccactgcactccagcctgggcaaacagagccacgtccgtctcaaaaaaataaaaataaaatatgcatatctgtgccctcctagtcttaaacagctactgaattatgctgtaataaatgggctttccagtgctaattatttctgcctctataccaaagtggccacaggccatgcttctcttggcttctgggctctcttctgccttcccttatgactccctgggatttacgctttccatgctgctgtttttcgagagaaacaaatcacgtgttgaagtcctggctaaggagccgtcagctcccagcagttattgggactctgagaaccgtggttgtcagctgtgaggtgcaggttccttgttctcagaagcgttctagctggcgggagctggacaggtttcctctggaacacaattttacctggtttcacatctgactggcaggaaaaagggaagcagggcaagtgaggttagggctacccgggacagacggggatggacggagccatgtcgtcagcgcccagtggagttctgactgtaaaggaacacaccggtacgccctccttgtgaaggatgctatcccttccccaccaccggtgattttgtctctgggataaatgtgaattttcacacctgttctcttagggtaggagtcagcaaactatggctcacaggccacatccagcctgctgcctgttttttagggccatgagctaagaactaagaatggcttttatatttgtaattggttgggaaaaaaaaatccaaaaggatatatatatatatatatatatattttttttttttttttttctttttttgagacggagtctcgttctgtcgcccaggctggagtgcagtggctcgatctctgctcattggcaagccgctacccgggttcacgccattctcctgcctcagcctcctgagtagctgggactacaggcgcccgccaccacgcccggctaattttttgtatttttagtagagatgaggtttcagcatgttagccaagatggtctcgatctcctgacctcatgatccgcccgcctcggcctcccaaagtgctgggattacaggcgtgagccactgcgcccggcctcaaaaggatattttgtggcacatgaaaattgtgtgagattcacttcagcactcagaaaatattattggaacattagccacacactgtttttttatgtagtctggggctgctttcacaccactcagtggctagagttgggcaatcctctagagtcgaacctccagacaatgcacagctatgccactaggaatcagctaatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagaaaaaggggggggaaagacgagcgtatcaggcgaaccgaaatgggagcggtgcaggctcctggcgaaggggacaggggaagaggagggtgtaacagggaaaagacagaagtgaattgaggaaggagggttgtgagtgtggagcgcaatgcacatggggctcctgcgcccttcgccatagaacccttcctgtcctcccttctttccttcctacctagaccgagtactcctggcttcctctgctcccttaacctcctctccacctacctcccgcatctcatgccttcctcccccgccacctgccttcctccacccctcccttcccctcccctcctctcaccctcctccctgccttcctcctccctcctccctcctgccatcctccctcctccctcggcctctgagacccctgctcctgagcagctcagtcctggggcccctcacctgtcccctcctgctgacatggcaggctcactgggggacactcgctgccacacaagctctccaaggtctgcatccaagtcagaaggttccctttcccctcaacagatcggaacacctggggaaacctgctttcagacacaccctgtggcttgtacattgtttacatctcatggctgtgattgatgggatgtcttaagctgcttcatttttgccctacagtggatctctctgcaacggaagctctgggtcctctgtccaatgctatggtcctgcagccccctgcacccatgcctaggaagtcgcaggcagtaagtgacgagccccctttcctgcctctctgctctagccaggggggtgcaggtggtttcacaagggctcaggggaagcaagtcttcccctcttcccctggctggggcagggcggggctcttcttggtacctgactgcttggatctgggcagctggtgggtttggccctcctgccgcagctccacaatgggcccactcagagtaccctgccccggccgcttcgtttcccagcccttggccccttctctctgcttggtggggagctcttcccttttctctccctggctcctgagctgcactgacctgccccaccttggcatctgcaggcttctcaggcctaggtacgggactcctgagaccggggaaggcagggtgcttgagctctctgccctgagagctgaggcctgcagccacactaaccgttgttccctctcctgacccagaccaagttgaagcctaagcgggtgaaagcgctctataactgtgtggctgacaaccccgatgagctcaccttctccgagggggatgtgatcatcgtggacggggaggaggaccaggagtggtgggtgagtcaagggtgggcctgggaggttcctgggggctgagccacgtccctgcccacctggctggagagacgggcttgcaggtgaggttttctcagcctgagcagtccagatgtagttcctggtgcctccgccccttagcatcctcaggagctgcttcctccatggacacccccttctgagcaggcctgattattccccagggtggcttcctcccctgttagggtgcagtttccacagcactcatgagggcctgaaatgacactccttcattttgaggtcttgagtttctaggtcatcaccccccattgctggattagtggaatcgggtgtctggagagagctgacctagagcgcagagccccaggcctgagtctggtcctgaaacaagctgtggccgcccaggcgtccagcagggtgtgggagcaagatgagtgccggccacctaagaattcagacttggccactcaggggctggtggcttggggcaggttgcttttatctttaagcattagtgggatcatctgtgacagggaggtcacacacacacagtctggtgcaggtgatcttgtgagcacccactaagcggcagctgcagacagtgagggcggtggatgaaccggcttgaatggggcgcggacagaaagccccaggctgagcccaccacacagtagacgcaagtggcacagctccgcaactgagctcagagcagacagttcagctgggaactcacaggatttaggggaacttctttgtcgagtgcgaggagtttggacactgtctttagtcactgtccctcccagaactcccactagtgtttaaactgcatgtcttcagcctccagaggcgctgtgagctctcagggccaggcagcactgccttcatttggcagagctgggttcaccggtctttcctgtggcctcgtttgcccttaatggattgaaagtgtctgtggcctgggcgcggtggctcacgcccataatcccagcactttgggaggccgaggcaggcggaacacttgaggtcaggagttcgagaccagcctggccaacatggttctctactaaaaatacaaaaaattagctaggtgtggtggcaggcacctgtaatcccagctactcgggaaccagccagctcccacagttgcccacaacccaccatccggaaggggcgccaacctgaccacaggcttagccatgtggaaaatacctgctcatttccaaaactggaaaatagaggcataaagaagaaaacagaagttgcccataaccacagcaccccccacccactccacaaaaagcccaccattcatattttggctgtttttagccttttatttgcctacatcatttacactcttgagatcatatttggatataatttatgtatctacccaagagggaacataagtggatagagtgaagccttccacaagtacttaactcattgaaatggggccaacttatacctttgccactttaggtgacgttgcagctcacaaacttgtgacactcagttcattcattcattcattcattgaaaaatggcaagtgggaagtagtggtcagacagctgacctgtgtgcctcccaagaacaggtgggggtggccatccccacgagcgaacatctgggacatggctgggaagagctccttacacgggagaggcctgcactatttgaaatgtggtgaggaaaaacggacaaaaatcatttggatgttttacctaagtaattccttgtcggaagagtcttctgaaccaatcttgcttttcttcaccaaacgctctatgtaatgctcttcaaagtttccaccaacatttggaattttaataacaacctacacttttctccatttcagattggccacattgatggagatcctggtcgcaaaggcgcattcccggtgtcatttgtgcactttatcgctgactgaattgctactgaacaaaagcattaacagttatgttcctgtttcgttattggtaccaaaactcttgccagataaccagtttcatgaactgtttgtatggcagcccatgttctctaatgccactgctctgttttaaaaactcagaggcaatttttacatatcagtaattgtttttataatttgtggttttcatgaaacattgctatgcatttattaggaaaaactgaatttcccaacaggtgaactgaaaagttattttaactattatacataatcaagatcctgcctctacggaattagctaaacctaaaaatgtttgcattaatgaataaattcttcctgcattccttggcccagttctggagttggtgacctttatcacaattattattttaggcggccagtgaactgctgcttcagaagtccatagcccagctctgaactttctcgataaaatgccatcagttcacctttaaagacacacattcctttgaaatccacccagtgtttaaaaagcaacttggaaatttacacattagcattgtactttctagccctaatttgtgaggttgcagctatcattatattctgcatgtatgtataacctgttgtgaacaatcatacttaacaaaactactgatggtttatgacaacgtagggtaactacagttcattctgttccaggttatataaaactgcatttcctgaatttggttaaaaactaaggatgatggattgcaaaacagttcttttaaattagtttatatgctttaggtgttttggaatttgccttcttgaacttcctgagtcacacagaaagcaactgtacacagtagaattctgtggcgcagaccatgctgtattaacacatcacttgctgtttcctactgagtgtaccactgccttcccttctagcccaggagaatgtttactcagtttagtgtcttgtatttctataatactccaacaggaatggtagtcacactgtcttgaaattgaatctgtccatctgtttataatcaagaacatatcagaaatatataggtcccaggtaatactcccaaacatcccactttttactgtttcaggccatcatatcattcttaagctacttggggtggtagtagaggattaggttgtctattataaaaccaaaactcattcgtttaatgaacttgactgtcatacctctatttagtaattgcgagggtaagattcatagtaggaatattggaaattttggcactctgagaataaataggcatatgatacccacttggacttttaacaaaagtaaaggaataaatttgcatataggcttggaaagtgaggcagcaatgctgttaactgcatttgttgtgatggtgcatttgattgaagcagcttgtctttattatgcaagactgtgtagagttttttttttttttggcattgtactttttgtttttgttataaaggaagacagaacaaactggaatgttttatgatgttgtatagcaatcgctttttacctttcaaagttccgggtaaaaatgtgttatatctgtagttttttgtttttgtttttttttaaagcactacatctgttttcactaattgttaatttctgtttgaacccttcatttaattttctcatagatttaagtaaacagatgtattttgcacagtgcacttatgtctattttaacaatcctcctgcatctgtattttatagtcagccttttgaccacctggtgccagctatataaggaataaagttgattcatatcaacattagaactccagtcccaaactaatctgtcaggttcactggtacataaatacctaggaaatatttttccagtctacaatttggtgctattgtgcagtaactaatagtactcttaccagaggagaaattatattaacgaccctgctaatatcctttcttagttatttgctccttgcaaattaaaaaagcaactaagagaaagaaaaacattgtagatatctatttatatttaaagtttatgtttcatgaactgcagctgcaggattctggcattttgcatgccattctccatcagatctgggatgatggctcagaacatgtacacagactaagagtaactgtgtgatctgttaaggggtggataacataatatgcagcttaggatgctattttgagatgtatgatattcagttcattcacctgattactttggttgcagcacaactgtatatattgtataaccgaaattgattattttcattgtccttaatgcagtgatttataattagagcatgtttaataagtttactcttcttgttaactagtcatttgactggaaaaaaataaaatacttttaaatggacatggttttatttttaatgtttttaatctttaaagttttgtatattgacagtcctttaaaaaaagtacactatcatactgtacatgggatctttacatacttttagcatgagcggtaatcttttaaggttctcttaactctaggaattgtggttggccagcatgttatcttgaccagacacttctgaaaatctgctttgtgtgtcttaagttggcaatgtcattgttccagaccagcatgaatcctggtctccagtccacacctctgccggacagaggtccatgccagtgataccatgactgggaagccaccactgagcccatgtcctcagtcttcctcaggccttcagtgtgtgtcactgagtggacctctgtgacatctagtcttcctcaggccttcagtgtgtgtttgtcactgagtggacctctgtgacatctcgtcttcctcaggccttcagtgtgtgtttgtcactgagtggacctctgtgacatctcgtcttcctcaggccttcagtgtgtgtttgtcactgagtggacctctgtgacatctcgtcttcctcaggccttcagtgtgtgtttgtcactgagtggacctctgtgacatctcgtcttcctcaggccttcagtgtgtgtttgtcactgagtggacctctgtgacatctagtcttcctcaggccttcagtgtgtgtttgtcactgagtggacctctgtgacatctcgtcttcctcaggccttcagtgtgtgtttgtcactgagtggacctctgtgacacctaggcttctgtgacacttaggttaagcttattagaagttgaaaaagacaaatgaagttttttagcccagaaaatagatgacttcattgagagttaactcactgtgtaataggacacattttaataaacaaatgatcagcattttacacaatccattttcttcagaaaatctagagcaagggataacttcattatttgcataacatttcagcattgcagtttgaaaacagctgaactttcagatgaagttgacttctacttgattgcaggattcagggtttctcagatgttaatacagagtcaaaagcggtggataaaaccttgcaaatggcttgtgcttgttcctacattacatgaaagatagagtaagagcaacattcatctgtctcttcgtgaacttaatttggctagcagaggcacacacctgaccctcttaagacctctcctaagcaagccgaccacacatgcctgcctgggtcagtggaacccatactatgagcttccctgcacgtgggccctttctgccctccttcagaggaaagcaaacagcgactgcagcctgcaaaggctgatcacgcagtctaggagggcaacaacgttcggaaatggaagaagccttcggcccctggaggatacatttttcctcagctgctttgtttaccttttaaatcccggcacaagcgagtgctgccactggccctaacaaatatttcacaaacctgcactgtcttgccagccggctgacctccggcctaatattcattcactatccccaggccaagatattccatatataatggattgtatttcttcagccttcaaaaacagtagtccctgggtgttgcgacttgatgggcaagcagctaaccaaagtaacgaagtctcaccaggctgttgcactgataaacccacaggctgtattcctcattgcttgcatctgtggtcttcagagccagtaagctttttcccgcccccagaccgtcatcgtaacacaccatccggattattaagtagagagcatgcctgtgcaaaacatcctgcagaagtcaggaaagattccgagagatcaggactctcaaatgtttgtcagtcctgatgacacaccctcccaggcagagtgaggcttgaaacagcatatccataggtttctcaccccaagggatgtcctgtatgctcagtctcgggcaatgccttcagatcccagcaagccaggagtgcagtgatctaa

SEQ ID NO: 648 - DNA, 23109 bp, Human
ttgagcccaggaatttgagaccagcctgagcaacatagtgagaccctatctttaaagaaaaaaatctgatcatgctaagacctgctgaggggagtgtaaatgggcatgtgcattttggataataagacggcaatatttaacaatgcagtgtaattactgagctagagtgttggaagactttcagctcccctgcaacattgtttataatcaggaaaaactgaaaagaagcataaatggctaggtatgagatctggcagaggacacatagtgggtctcaaaagaccatcctggctaacacggtgaaaccccgtctaaaaatacacacacaaaaaaattagtcgggcgtggtggcgggctcctgtagtcccagctactcgggaggctgaggcaggagaatggcgtgaacccgggaggcggagcttgcagtaagctcagatcacggccactgcactccagcctgggagacagatcgagactccgtctcaaaaaaaaaaaaaaaaaaaaaaaaagagggtctcgaaaatgttagtactgttttatttctcaagaataaattgtatacagatgtgttcaattccatattttctatacttattttgtatgcttaacattttcacaattaaaaaattaatttggtgaggctgctggagaaaaggtactcacacaagctggcgggactgtcaattgatataactacttccaagagcagattagaactggtggtatagtgatgccactctttttaacctcttggatggacaaagatagaaaggttggataacagtttgtgttggcaaacaggcactctctttgcagatgggaatatagattgaagacacctccttgcaggtaattttttggcaatatttgacaaaattggaaactccccttcacctagcacaatttccttgaggtatttattctaagaaaataagcaattttagagcaaagatttatctacactgaagtttcccatagcaatcacagtattgtttctaatattagtaatacaaaaagaaacaacctgtatgtctaacactaatcgattctaatttatggtgcaactgaacaatggaccaaaatgatgctgttggaagtttttaatgatgtggaaccgcttgcaaattattaagctaaaagaaagtaggttacaagatagcaggaagaataaaccattaaaaataccaatctgtgcactgacaaatgttataaatattttacgttatgttatgttataaacattttataatataaaaaaatgttaactgaagttacttcctggatgaattacaggtgatttcattgtcttctagaattttcttttccaaaaatgttgtgtatgcgtgtaattattattttaataggagacactctcctttggtgatataatttaaacaggacggtactgactgataacctcccggggaaggcagggagccaagtactacagacttgtatgtttccatggaaatctaacgcgcctttgattatcacagattctggagaagagtgaggacttgggttcaccagtgcgttcccaaggacaggctgggcttctgaggaagttgcccaccctctcggaatctggtttggcctccgtaaaatgggcagatcccgctcggatggcccggttcccggcttccttttgcgggtcaacggcagcgtcacgcgcgcgagcgcggtctgcaaagcccccagcgctgggcgtcacgcggggattgctgtcgccgctgccagccgcagcagcgacgcgaactcggggcgcccggcccgggcgcgcgggggcggggacgcgcacgcggcgagggcggcgggtgcgacgggggcggggacgggggcggggacgggggcgaagggggcggggacgggggcgccccggcctaagcgggactaggagggcgcgccacccgcttccgctgcccgccggggaatcccccgggctggcgcgcagggaagttcccgaacgcgcgggcataaaagggcagccggcgcccgcgcgccacagctctgcagctcgtggcagcggcgcagcgctccagccatgtcgcgcggcctccagcttctgctcctgagctgcggtagggctcgcgagcgcctgtctcgcctgtcgccccccgcccctccacgacaccccctcccgtcggtcgcttgctcacgacgcgctctctctttcttgtagcctacagcctggctcccgcgacgccggaggtgaaggtggcttgctccgaagatgtggacttgccctgcaccgccccctgggatccgcaggttccctacacggtctcctgggtcaaggtaggtgctgcgatacccacgggctggggtttggtgggctcatttgaagacagcaggaaccatctcccctaggctggcgaccctctgtggctgccaggtgggggcgaggggcgtctcccgcagctgaacttggagtacccagcctcccgtcgcgcctcccccaccccatccgcatccaggtacagggccgaattaggttttgctctccgcagacctcaatccccttcctgtcactgaaggtggcctgagatgaatgatccacttaagatgttttggaagggcagagactctctcatttggattaattctggaggccacctgtggttgtgggccagcaggtcaggaagaaagcaacagggacctagatttgggcattggacagggggaatgtctccagacttctgatttcttgtgttttgtgactgtgatgcccatgatacatgggagggggagggggcaatttgaaaggaaaggctaagacacagaagtgacttaggccatttcatccatggtagttatcagtggtcatctcctttgtgggatacccttggcttcctcccctagccctcctcctccttcctctggcagccttgagagcatcaggtggatgcatgagccggagcccgcatgtgtaagaacaggccttgctgctcctactgtaagtggactgagtgacaaggaggctttttcaaggtttcctcttgactgaaacattctcagattctaagatggcaatgatggtgtcattccaaagccaagcagctactgtttgatatcactggtccttctttaagtcaggccactgctaccacagcacctccattttaacccaaatgaatatgatattacaaccttactctgtagctctcactgatttgctgtcttaccacgggggcaaatctctgcacttgtagctttccccaaaatgcagggcgttcttctgcccaccataaaagatactataagaaactgtacgtctttggccacttaacagtacaaggcatcattgcggtgatctctttgtgtgtgtgtctcctaactggatggtcagttccctggggggcagtggctgtatccatacttctgtgtattcttcacggcacctaatttttgccctataaattgcaaaggtgctctgtgaattcagcccagcacttcatgagttatgcatgacggggatggtgctgctgcctcagagcattgtattgtgtataaaagtaaggtgttaaatattcctacttcattggtaccttacttactgtgggatcagagaacacaacaattccgaaattgttctcatagtcaaaacaatagtatttttaaaaatattgtaaaaacaatttttgaatgctcaccacgtgccaagctccaaggtaaatatttacatacattatccatttccatccatcggaagaatggacttagggattagtactgttactattcctactttacaggtgaggaaactgagccttagggagggaaataacttgtccacttttgcacagctagctaaatggtggagttgggatttgaacgaagcagtctgattccaaatcctgagttgttagaggtctatcttgatctctgttttctcccttaataacttaagataaagaaaatcaaagtgcccctgggctaaccaggcagggacttagttatctcaaagaacggggaaaaacatgaaaccactatcccttccagagagtaactatttaataaagaaaacattattaatacccccaggggagtaattaaaaagtactcatgaaacaagtagatgaaatttcaggctgtgaagttcaaacagttctggagtgaaagcttcttgcacagggtcatttggaatggtccactaaaccatagcaattaaccttggacttctccttggatgtcagctggtgacgtaactcggtaacgcatgagcttgtttattggacagaattcttgcgagatttacccccaaggtctttgaaagctctgtcaagaaaaaaagggacagcagtctctaggcgttctttttttcctgttgatccatggaatagtgccaatgaaaagtcataccgtagttattttttgagaagtaaatggtgattgagattcgtgggtaggagagttatgctataccaataaacgaatcaggtgcctcgaaagtgacatatattgttcctttaagcattttttttaaaacagctctcagcatgttctgtagatacttattattttccagcccaataattatactttttcattgattatgcttatacaacaaaaatggatagagtgttctggagacaaggccagtggtgaaatgccaaaatacttcattttacagaatgttaagcatctggtcatttttctataagtttcttgtaaaatgtttcatcaaagtggaggggtagccacaaagggaggaatttcattttggtaaccagaaccagcttatcccatcctactcacttcatcatcactaccctggctttgtaaaacctgttttgccagcttaggagggggcttcatactgggcaaggaaagcagagtcccttgcagtgggttttcaccatccaccagattgaagcacattctgcaggctgtctgcatatcataagtatggttataatgactcacaatttaaaattctattcaccactcaatcctccggcaccatgtagcatcttgcctttgtccatttggcactgatacttgtaattaacaaaaggacccatgtaaaccatgtgttttttatcatatgcctttgaccagaaaactcaaaacagacagcatccaatctgtttgcaacattagggttgggaaggaagagtgttcattctgttctctctgtttcaaagatgcagtgagatgggctagaggggacttaatagacacatgtgcaagaggctaaaggtgaagccaaaagtggacagagatatcccaattcctgttggcccagctcttctcttctatggaccatgtcctcttaactgggatccaacaaagggtcctcttctcatcccttcctcccttatactttttaaggcataatgggtgattgagaagaaatagaaaagttaatacattatattcattaggatagtagctcaatttagctttatgtttattttttgagacagagtgtcaccctgtttcccaagctggagtacagtggcatgaagatggctcactgcagcctcgacttcctgggctcgagtaatcctcccacctcagcctcccaagtagctgagactacaagggcgtaccaccacacctggctaatttttatgtttttaattttttgtagggacaagatttcaatacattgcccaggctggtctccaactcctgagctcaagccatcctcccacttcagcctcccaaagtgctaggattacaggcatgagccaatcgatttatcttttaaagttgtaatagactgggtgtggtggctgaggcttatgcctgtaatcccagcattttgggaggcgaagatgggaggatcacttgagcccaggagtttgaggccagcctgggcaatgcagtgagacctgtctctaccaaaaaaaaaaaaaaaaaaaaaaaagttgtaatagatgtggttctttgaggaggtattttgagaaaatatgcaaatagactttgatccatgacttttcttccactggccatgacctgtgattaaattccagcataaaagggcatagcacaatatcatgtctgtgaggagtaaagccatgcattaaagggctgcatgtggacttcatgaaaagcgtcgctgtgtctacactctctttaatgtaggtttggagagagaggatgactttggttggagtactttgggcctggttgataatcactaaagatagtaatgagtgatcatttatcccagagttgcaatgccttcttgtatcatgctaggagccctgacagcctatgggtgatgcaaaacgaaagaggatatatggtgtcatctctgggtgatgctgcgggggtgaggagagtgaagcatcacaagacaagtgcccttttcagatgatttccaaaggaagggagaaaagggaagtaagagtgtgacttcatataaaagtctactataaatagactttataatattgagaagagccccagctggggcagatcatgggccatccatggagtgttctgcttctgacattaacactaaggaaactgttggagagcaggttaatggcttgcgtgaggccacttcaaaagttcaaggctgtcttccgtgtatgttgctaaacttctttttggtggagttatgttttctgtctctaccatcttgtgtgataatgagctacaaaaccagggatactgaggagagcagagtgccttaggagggcctagagttgataagcggttggggcagatgtaatctgtacagccagagaccttcatagcccatggaaggagccagtactgaacacttactgtgcttccttgattccagaatgattctgttgtaaggtggatttaagaacatgttttaggacaaaaaggaaacatttctacattaaatgtagaaccattgaattatgaaaacaatgtatgttagaattaaaaaaaaaaaatcgtactgtccccattggcacctatagtacttgacctggttgaatcacttttatgggctcctccctaggtcaaaccatgaaagatgtaaagttgcttttcagatgtctctcatatttacactttcattgtttagtagatacttctaagtcccaaatgtgtgccccatcctgggcctggcattggccatctcaggatcaatgtagaacttttgccagaggaccatcttgagcaaaggcctgggaatccactaagactttttgggaaccattgaggtaaccagtgatgtagaagggagacttaaacagcagatatggctgagagataacattagaaagtaggctagagacagattgtgaggggccttgaatgcccagcaacaatgacttgacctttatccttttggcagtaaggagccattgaaggattttttgtttgtttgtttgtttttgttttttttttttttgagacagagttttgctcttgtcgcccaggctggaatactgtggtgtgatctcagctcactgcaaccccctcttccaaggttcaagcgattcccctgccttagcctcctgagtagctgggattacaggtgcccaccaccatgcccggctacttttttgtatttttagtagagacagggtttcaccatgttggccaggctggtctcgagctcctgacctcaggtgatccacctgcctcagcctcccaaagtgctgggattacaggcgtaagccaccacgcccggcctcactgaaggattttaagcaaagacaatggcataatgcaaaatatgcctaaagcaaagcatatttctcctggtgttggatagaatatgattcatcttagaagatgagtctcagagggagacttcattcttttccttcttttcctcttggtcaccagtcctgtccatgtagttctgcggaggagtgggcaaggaagaatgaggccgcctctgagtggctatagaagaagtctcatctagatgagaatggtggatcactgagatttttggacaatagtggaacagagcacaagttgccaaaatcttttagcttgataatggggagggaggaagaaagcagctgagagttaaattgaaaaaaaaaaaaaaaaaaagctaaacaaaaaaaccaacttgttttccattaataaaagggggaacctgagtcacatgaggactggattgtcttagctacgtacttggcaatgtcactacacaaagaagaggaagtttggagaaggtctcagtgacataagggaaagttttatgtagggcaagactaaaagcagattgattacctaaaaaaagtttcctccctctaaagatgtttccgtaatcccttcctggctactcctggaataaccctaaattttgtatcaacaatcattagctcaaaatagagctgggcagaaaatacttccctaagattcttttatactcataagcatgtttttgtttttcattttgttttgttttgcactgaggtgtatttgggtaaaatttccgtgtgtgtcatgtgggactagtacagacttgggagcccaaggcttgttaatatcacttgatgctttcttggaggaccagtctactgcatatcccaaattgggacaatttggagaagtgttccagttcttagcttccagtggttgccagcagtcctcggggttaccgattagaatcggtattaccgatagaattgaggttaccgattctagaagagctggtagctgcctaggattatgggtccacatagggaaaacctttaggaaaagaaggatgctggtttccataaacagttcataatcaccttggaccagcagttctggagaacagaggttctgattcaaatcaggccttgaggtctcattccccaaggagtgggaggcatgtaagcccaggggacaaagcaggactggcctcgaggctggagccatgtgccaatagccccctacgtaccaaccttatttacatggtggtgcggggtgccttatcattaggagtctttcagttgtgagggattgtaaatccaatcaaaactagcctaaagagaaggaaatatattggcttatatataattggaatgggaaaaaattgaaaaatcaaaatacagttcacatttcagttatggatggcgttgtggcttgaattgtgccccccccaaaagatcagaagttctaatttctgatgcttgtgattgtgactttattttgaaatagagtctttgcaaatgtaatcaaattgagatgaggtgctacctgactagggtgggccctacttcagtatgaatgatgtcctgataggagaaaacacacactgacacagacaacagggagaaagctatttgaagacagacacagggattggagtgatgtgtctacaagccaagcaacgccgaggactgctggcaaccactagaagctaagagaaaggcacagaacagattctcccctaaagccttcagagagcttggccctggcaacaccttgattttggacttctggcctcctgaactgtgagagaatacatttctattgtttcagccacccagtttgtggtgctctgcagccctggcaaatgaatatagctaggcttagaggttcatgaatgtccccaggacttggtgactttccatctgtcaactctgccttcctttacattggttctgtgtccaacctctacatagcagccagatcacagccagtaactacagagttggacaagttgcacatcctttatctgaaatgcctgggagcagaagtgtttcagatttttggattagggatgctcaacctgtatatccttccagaagcaagtgcaaaggagaaggttgtgtttctcttcaaatatctcaacttatgtctgattattctcaagggactttgactgggtcacgtgcctatcagagccagtctccatgatcgtggggtaccaggcctgagttaagttgcctcctctagaacctaggtgtggagttcttcagaggacatgaactcagagcttgtaatggtacctcttccaggtccagcaggccccacgggatgctaatagaagagagatgattggcatgaacaatgaagggtccaacattgccttcaaatctcagttccaaaggggttttgatacattattatgatggtgctttaaaaaatacagaatgttgtggatattttgaagacatcatatgtggaaaaaacagtttctccctagagcagagattgggacttctaggacaactttcccagaggagacgggaagtgtcagtggtaaggaaatgacagagtgggtggatggtgtggaaagctatcacagacaagaataatttctattaccagcattaccaattatacagcacttttcttgttttctcacttgattttataataaccccatgagcaagtaagggagctccagatcacgaaatggggctcagaggtgaagtgacatatggaagatgacccagctaacacatggagaaactgggattgacttcagacctttgattccaaagctagtgctcttgtaactttctcactctttctaaaattcacgcattcattcagtaaatactttttcaatacgtcttatattcagggaactatttagtatgcagaatgaaaccttggttataaaaaaaaggagagagagagagtagtaacatcttcagggctttctgtgtgatcgatatgatgcttagggtctgtatacatcatcataagtatcttcacgccagctcagtgagatgtgatcacccccagattccagtggagctatccaagcctgagagtggttcagtcagttggccaagagcagaggtagccgtgggagggctggggtttggttccagctcagtccaatgccaatgcctgtgctcttaattatgttgcctctgctatactcataactctgttaacagccataaatccagctctgtctgttagacccagtaaatttcaaagtagaaaatcatttttctaataaaactacgcatagaaaaaaagatattaatgctcatacattctaccctcattatgacatcaacctctgagccaaactattttgcacattataaagagctgtttttatgatgaatgggaattatattggcactttaattgagttagaaaccaaggtacatgaatgttagtgcacaagaaatgcgataaaaaaagctgctcaatgtggttggaatacatcagattaatttaataccaactttaaatccttacaatctatacccttaaatatgttttatcaaattattagatgaaatttttatactgtttttttttcttttaggtaggtacctattgcacattccccccacccctgcttttatttttttatttttttttaagacggagtcatgctctgtcacccaggctggagcgcaatggcacaatcttggctcactgcaaccttcgcctcctgggttcaagcgattctcctgcctcagcctcccaagtagctggaattacagatgtccactaccacgcccagctaatattttgtatttgtggtggagatgtggtttcaccatgttggcaaggctggtcttgaactcctgacctcatgtgatccacctgcctcagcctcccaaagtgctgggattacaggcatgagccaccgtgcctggccctgcattcttaacaaatctgctatatgataaatttagatttcaattttgtgatcaaaactctttttttgctataaaatgaaactattgccctcttagcttcaaatatggtaatgtaggaggttggcatatatttggataaaattatgtaaacttaaaaaaaaacactttccacaataggatgttttaatattggttcagtttcagccataattaatgatttattttatgtcttttgttttagttcaaattagttcatcattaaaaaaaaaaaactgactccattcacgtgcccatacaattagtacttgtgtttgcttgatttagcattctgcaaatgaaagagagtttgttttaatttagggcctgtgctttccttaaggtcaaatctccatttgagagaaagaatatggtatttaaataatttagtcaaattggaggccttgagacaagtcagagtccccaggctttctgaaaatgagatgtcccacgtttgcacttttccagcccaaccaaaaatgatagagttgtcagcataaaagttaatgtacaacatgtggatttttaaaacatgattgggatgagtgttttgagtaattaatttgctgaaattgtgttgtgctttagcgcactgtactacaatattagcattgtgaagggtgcattaaatagttcctgtcaattatggttggctgtgaatgaatctgagggttccttttgttataaattactatttcctaaaatggttttgcagagaagcaatggaacacttttagatttggaatgtttaaagagctgttcttgccagtggttgattttgagtgagctccaatgtttatgagaactcataaaacaaagcaaagtggggatggcccatttgctgttactccgttttcctcccactgaaatttccctccagtttttggtggtgcctctgccacagttagctcatctgataaagcagggtgatagctgcctggccacgtatctgatgataatgatatgagcttttgcatacggtcccttgatcctgctagggccccacccccattctgagcatgcaacattaacataaaaactaccacgccttttgcagctgtggataaaccccaaattccacagctgggggtcacaagagaaagtttagctgaaaatgtatatacctaaaactggaagttagagggagggttatgaaatatttccaggtgcaatgtatgaatttacagggaattctttttgctgtagttagttattaggcaaacagcgctgttcattggtttggcaagagttcctaggttttgcggatagttctctgggtcatttaggaaaaggggtgtttggaagatgaccctgtgagagttgagatattttgccatgatcccactggtggcagcacatcagaattctgcaggtcgctttgaggttctttgttttgccttctcccttgattcttccttctgttcttatggctcaccctgcctttgttttgccatttaaaaataactagcggcccactgacggttttgccagaggcccttggaaatctaaccgtcaaataaattttattggtgttgctgctgatttttaaaatgaattctctgcaaataggcagaagttactgccagccagttttgatcaccagcacctttttgcttcaacagttcccagcagctaacacaataatggggccatctttatgtaaatagacacaatagtttatgtttctaccagctccagaggggttcacagtgttgatcttgactttcagatgggcctttctgagctgagggaggggttgctggatgggagaggagcttcccaggagaaaaccatgggtgaataatctcaaaacggttgttgcagctacactcgcatttggaggttaatttagaaaaagaaaagcaagattggacatcggaatggggactgcagggactgggccgagctaattatttcaaactggcctttcaggccatcctagacacagattggccctggatgggcctcggtctctggtctcttgaaagcccttgcctggtaggaagaagccgctctgccaggcagcggaagggagaggcaagcagtgtgagcccatgacgaggcttcagtttatggtttacttaggcttgaaaagggaaaaatggtgctaaattagatgtgttctggaatcagatggacactgttagtttcctctaaatttccttggccccacctcctttttgtgctttatttttgcacacctatgggccccagtcttttagcttcctcccatagattcttgattatttaggaaggaatctttccacacaaaaaggaccatcaagaaatgggatttatgtccgcagactcggcctgagaagagccgttcatctcagctcagggctgggagggagctgagcaggttttcttgcaggagcgatcaatctgccaccagatgtctctgtagcccactctacaggaatgctcacaaacaccagggctggagcctgagctttccggtgaccttgtggtatatgctctgaattaataaatgaagcagaaatgactgtgtgtgtgtgtgtgtgtgtgtgtgtgtgtatacgagtgcacacgtgcccatgtgtatgtattttctttcctgagttgcttctcagagtattcccctaactccttggttatctctttccctacactgagttccttcctaaaagtcagagaagagttgtagggtgctcccagaacgggagattcatcattgataggtgcaagcaaagacagtggcagtgggccctgataatctctgtctccttccctaaggtggctcttgggtgcagttatcatgctagggacaggtaaggaatgtcacttaatcctgggctccctgctggtccccagccaaccagcaaagggaaactcaggtgctgctaggggatgtcattgttgaagggctgcccaggaaggctgaaaacaaggatttgctttactgcatgtgtacattcattttagaagctttaaagtatttcaatggaggagcaacttagcaagttaattaggcaaattaaaaatatgtctaggaaagagagaattaatggtgaatgtggtatgagcctaatctatgcagtgggagatgctgtggacactccaccagtttgatcacaaagaattcacagaaagcaagccgcgcacggtggctcacgcctgtaatcccagaactttgggaggccgaggcgggcggatcgcttgagtctgggagttcaagaccagcttgggcaacagagcaagacactgcctctaaaaaaacaaacaaataaaaattagccaggtgtggtggcacaggcttctagtcctagctactggagaggctgaggtgggagtaccagaaggttgactcaggaggccaagggtgcagtgagccatgatcaagccagttctctccagcctgggtgatagagcgagaccctgtctcaaaaaagaaaaaaagaaagccagccagataaaatgtctggctaaattgggcatctccccaagtccggctggtctgtcctgagtacagtgaagtcagctgttactgcccttccatgtggagtttgatatgagcagcaaatgatctgacacatacactctctataaagcatgcttctcagctgtctcactgccatagtacagagaaaaggtgtggcacattcggcgacgtcaggcatgaccacacagagacacagcccttgaggaacaaggtgactgttcgcaggaggcgttgctcatctgcttatctgattttagttgaattgtctggcaaggatcataacagatttaggaatttttccaaataaaaggctgggatacaaaaataggaatcattcagtgggtgagttggtatctgaagaaaacaagagaacatttaatacagaacagtcctatctatacatgtatacatagacacaaaatataatccagcaagattcacacacagcatatcactgtcatcaacagtgactctctctccctaatatagggtggaaattgggatacttatgatagaatcatgagatgtagtcctgatatattccgaagatgtagccttgggaattttcatagatctttcctcccccagaggtcacacacacacaaaagcatcacgtcttgttttacaaacataagttgaggctggatcttctgaaaacaaaatggaaacattggtgtcgagttggagtgcttgcagtggaccgtgatgcgctctgattccttcttcacagttattggagggtggtgaagagaggatggagacaccccaggaagaccacctcaggggacagcactatcatcagaaggggcaaaatggttctttcgacgcccccaatgaaaggccctattccctgaagatccgaaacactaccagctgcaactcggggacatacaggtgcactctgcaggacccggatgggcagagaaacctaagtggcaaggtgatcttgagagtgacaggtgaggtgacctgctgcacttgttttcttcttgaacaatgcatgtgtacttcctttaggtcctaaaatcgttcctctcttttggagtgtagctctagagctttggatcacatctgtggctgaaagtggaaatccgctgcaagcatgtcaccattttctctttctgtggcttaaatgatgccttttgtttgacttttgcccaacacttgttaggggctgagggtggaaatgataaaaatgtggtcacagagcccctgattccgtacaaccgttgatttctccttctgtcagggatctgaaaggaattggacttcgggtaatattattacacctgcaagagtacagtccctgtttaagggggcagtgtgtgctttttgcttagtgttgtatgcacacacctcccttaggccctcctggatctccagcccttcatcctggtttctttgtttcctggtacttagtacaactggcatgttatgtatggattgatttactgtctgtctccccaagagaacaagaacctctgcgttttcttctctgatgtatctgggcacatagtaggccctcaatgaatattcacctgaatgagaggaaccttgcagaggagagtggagagggcaggcatgtcctgcagggagtggagagaaaatgaagagaatagctgattttctctccttttcctcttccatggcgatattgcctacaacttaaggggtcagagtctacagtcacttagatctggctcaaatattaactctgccttttgttagtgtgtgaccttgagcaaatcacggattgacactaagcctcagttctctaatctctaaaatggaagtaacgtctacaacataggcttgttgtgaaggttaaatgagaagttgcgttaaaatgctgagtgtagtgcccgggatagactgaatgaccaatacatattagggaccatgaggacaatggctctcattacccacggctgtgagaatccatccctcgactgctgcacaaaatgtcgaatccattttcaggggttgacatctctggagatctagccattggctccaatggcagaaccccctccgctcacttgcactccacctgctcctgcctggggcatcaagcagattctgtttgcaagcacactatagccaaagctcaacttgcttccccaaacagcacattgggtgttgcacctgagtggggagaggcacctcccttcatgtctgtccctgggctaaaggcctcgctgctcttaccctcccttcgtgctgcaccaaaccctttaacagccctgagggagttgttcttccacccaaccatgctggcacccttgccgaaagagcttgaatgattctagaaaaatctgttgacgtatttggcaatatcagggcagctcccctgcttcctttcatagtccctgaaacctcctgaggtgaggacacaccacagtctacccaacagtgatgaagttaagataatttctggattaacaagtggtggttcatctggtaggaggacaaaataagccaggaaaggcttgacatccgaagtgcaggcagacaggccgcaggataagcctggaccagctgtctggctcagccgccttggtccttggtccttgaccctctctgagcctcggctctttcatctgtaaaatgggactactcaggcctgttctgaagattcggaaagatgccatgtgagagtcgcatgcagccagacacagagcgacagtgcgcgccggctgctgctgtcaccttcactgtcactgttactgtcgttcatcctgatggtgggaagaggagacaagcaggactccaggaccaaggaacaaagcattcttagctttttttcatggtagaaaaatcctgttaaaatggcttcacatgtcgcttacttttttaaaggatgccctgcacagcgtaaagaagagacttttaagaaatacagagcggagattgtcctgctgctggctctggttattttctacttaacactcatcattttcacttgtgtaagtatcttcttaaaacatcttctcttattaaaagattacccagggcaccaatccaagtatctcttgcagatagtgcgaatcatttaataatggtgagagagattattctttgaaccctggactttttgaggcccctagactgggagaatcattacaggaagctccctgaaatatttccagcttttgtctagtggctacgtttagagcattgtggaaaaaaaaaacaaagtaagatataggaaggacgtttgggaaatgacaaggggttctatgcaagagcagaggccctgtaggcgcagtgctagaagttgcagcgctgagggtcccccatcccagagcagaggccccgctcttcctgtgggtgagggagtgggccccactgccccagggatgccaggggatagatcagcctcctttggctgccttcaaactatttctcgtgggggttctccccttctatttttggtatttctgcccatgccttaagaattaatcccaagaagccagagcagtgaggcacagtgggaggcttccggggtgcaggatggctggccggtgctcaggcaccctaagacatgcccatgagctgttggttgcaggttccggctcaaagccctcagagattctttctgcatggctgctcacctgtgttgatgatggttgtgggagagtagggccacatgtgtgtctgacccctctaggaagtgatctgccccctttgtctccatccaccaggcagggctggctacctaggggccaggacagacttcacccaggagctaccccaggactggttcttgccactcactgtgtccctctattcacttacttgcctctctggctgtgcactcatctctctggtttctattttagataccagtcaatcagagactccagtgagcacctactatgttcaaggcattatgctaggcactgtacagggcataaaaaggtgtaagacattgttcctgccctcaaggagcttacagttaggatgttagggttatttgcgtataagaagataattagagttaccaggcagtatgttttaaacatgaatgactttagcttcttgttggaaaatgcctgcttctgtgggcattgactttccatacagagacctaacagtagggggtcgaaatggccacaatcagtgaatctcctggtccaagtttagagacgccagtgaaatggttggtacaaatcccttgtggagcgagtgaggcagtgagtatgagagcttccagaatgggttgtctagccagctcttagtgaatagagtttaaaaggaggtgacaactgctgaatttttccaattattcacttcacatttctttcatttctttttagaagtttgcacggctacagagtatcttcccagatttttctaaagctggcatggaacgagcttttctcccagttacctccccaaataagcatttagggctagtgactcctcacaagacagaactggtatgagcaggatttctgcaggttcttcttcctgaagctgaggctcaggggtgtgcctgtctgttacactggaggagagaagaatgagcctacgctgaagatggcatcctgtgaagtccttcacctcactgaaaacatctggaaggggatcccaccccattttctgtgggcaggcctcgaaaaccatcacatgaccacatagcatgaggccactgctgcttctccatggccaccttttcagcgatgtatgcagctatctggtcaacctcctggacattttttcagtcatataaaagctatggtgagatgcagctggaaaagggtcttgggaaatatgaatgcccccagctggcccgtgacagactcctgaggacagctgtcctcttctgcatcttggggacatctctttgaattttctgtgttttgctgtaccagcccagatgttttacgtctgggagaaattgacagatcaagctgtgagacagtgggaaatatttagcaaataatttcctggtgtgaaggtcctgctattactaaggagtaatctgtgtacaaagaaataacaagtcgatgaactattccccagcagggtcttttcatctgggaaagacatccataaagaagcaataaagaagagtgccacatttatttttatatctatatgtacttgtcaaagaaggtttgtgtttttctgcttttgaaatctgtatctgtagtgagatagcattgtgaactgacaggcagcctggacatagagagggagaagaagtcagagagggtgacaagatagagagctatttaatggccggctggaaatgctgggctgacggtgcagtctgggtgctcgcccacttgtcccactatctgggtgcatgatcttgagcaagttccttctggtgtctgctttctccattgtaaaccacaaggctgttgcatgggctaatgaagatcatatacgtgaaaattctttgaaaacatataaagcactatacagattcgaaactccattgagtcattatccttgctatgatgatggtgttttggggatgagagggtgctatccatttctcatgttttccattgtttgaaacaaagaaggttaccaagaagcctttcctgtagccttctgtaggaattcttttggggaagtgaggaagccaggtccacggtctgttcttgaagcagtagcctaacacactccaagatatggacacacgggagccgctggcagaagggacttcacgaagtgttgcatggatgttttagccattgttggctttcccttatcaaacttgggcccttcccttcttggtttccaaaggcattttattgcttgagttatatgttcactgtccccctaatattagggagtaaaacggataccaagttgatttagtgtttttacctctgtcttggctttcatgttattaaacgtatgcatgtgaagaaagggtgtttttctgttttatattcaactcataagactttgggataggaaaaatgagtaatggttactaggcttaatacctgggtgattacataatctgtacaacgaacccccatgatgtaagtttacctatgtaacaaacctgcacttatacccatgaacttaaaatgaaagttaaaaataaaaaacatatacaaataaaaaaatcccgactttgggatgagtgctaggatgttgtaaaccagtttgagaatcagaatccaaaatgagagctgaaagattggctgagtctttctcggagggagggcatgctggcagacagagctttgtaaacagcatcctccttcccagagatgcttctgcttccatcctggggccacgttgctacccagtacatgagcagctcatactaacatgcacggtcatgggtgggcgggatggagggagggtttctgcttcagaaagatgtgtaacatcaggggctttgtgcctggattcatgggtttcactcaagattctcaaataggtcccttccccccaaaatgttaagaacgatgtggtctaagtagttgtaatagttataaaagcatcaggccaggcacggtgactcatgcctgtaatcccagcactttgggaggccgaggcaggcggataacgaggtcaggagatcgagaccatcctggctgacacggtgaaaccccgtgtctactaaaaatacaaaaaattagccgggcgtggtggcgggtgcctgtagtcccagctactcaggaggctgagacaggagaatggcatgaaccctggaggcagagcttgcagtgagccgtgattgtgccactgcactgcagcctgggcgacagagcaagactccgtctcaaaaaaaaaaaaagcatcataagtggaagtctctttacaaagatgaatacacataaaatgtctctaaaagctgtggaatcactttcaatggaatcaagtctgttctcaaatgctttaccaaaagtgccagggcatggtaattgagagttcacagagctcctagtcacctgagtgtgtagcccagcttcaagatttggaagttatatttccttgggcagaggacttacccctctaagccttagctggccaatctttaaaataagaatagtatctgcctaataggtttattgtgaggattaaataagataatatatagaagcagtaagcctagtgtgtagcaaaaggtaagcctttgattgatattagaacaagaaaggagaaaaaggtagcagagaaagtatcagtaaccataaatctttgacaaagtggttttgttaaaaggaatgaattggcttggtgaaggagtcatgctgctttcagaggattaatactcagtgtactaaaattcttcgtggccattagaattacagtacaggacacaccaggaagaagggttgccctttgtcagtttggactgaattaagctggaaacatgatggaaatttgagagcaggcggactcaatgtttcagacctagtctttggtataagaaaaagtttgtgtgtggcggggcacggtggctcacatctgtaatcccagcactttgggaggccaaggcgggcggataatgaggtcaggagtttgagagtagcctggccagtatagtgaaacctgtctctactaaaaacacaaaaattggccaggcgtggcggcgtgtgcctgtggtcccagctacttgggaggctgaggcaggagaatcacttgaacccgggaggcggaggttgcagtgagccgagatcgcaccactgcactccagcctgggcaacagagtgagactccatcttaaaaaaaaaaaaatgtgtgtgtgtgaggcagagagagagagagagagagagaagggggtgtagaagagaatggagggcagaatttgtcaaggagagtggactggtctcaactgcctcgattgaggcctacgaagatgtttcagaggaaggcagatgatcatggaccatatttattcttcatctccattgccagggaaagctttgtattcaaggctgtcccttgtctatgaaattagttctagagttataataattttgccttgggatgtcccagggcacaaatacagatgtgactatcagctccacattcttccaaaagaaagcctgtggttttttcgtatttataataatacttaggaggtttcctcgtagaaaatactga

SEQ ID NO: 649 - DNA, 38611 bp, Human
tccatcttgaccttccctcctgcctaccaattttccccaccccctataggtgccccactgattgttgacacattgcattgtgattatctgatttaagtggaagcttcctgagaactctagcactagcgtagtattagtctaggttcagggccaactgttgcatttagatactcctctgccatccttgatacctgggttcacatcggtgtaactgcccattagcgtaactgcccaacaggtttctccttgcctgctgcccagatagaacagacttatcaagacaggagaattgcaatagagaaagagtttaattcacacagaaccagctaaatgggaaaccagagttttattactcaaatcagtctccccggaaattcagagactggagttagtaaggataatttggcaggccagggagtggggagtgctgattggtcaggtaggagatgaaatcacaggggatcaaagggggttcttgcagtcttccgttcctaagtgggatcaaagaactggtggaaccagatcaccagcctggatggtgtcagctggtgcatcaggatgcagggtctgaaaaataccttgagcaccaatttaggttttacaatagtgatgttatccctaggaacagttggggaggttggaattgtgtggcctctggctgcatgactcctaaaccataatttctaatgttgtggctaatttgttagtcttactagggaagtctgctccccaggcaagaagggggtttgtttccagaaagggctgttatcctctttgtttcaaaattaaactaagctaaattcctcccaaagttagtttggcctacaaccaggaattaacaagggcagcttggaagttagaagcaagatggagatggtgaggtcagatccctttcactgtcataactttctcactgttacaatttttgcaaaggcagtttcacagggcagatgaagatttacttaaatgtctcatgatggtgatgatggtagctaatattcattgagcagttactatgtaccagatattgttctaagtgctttaaataaattagcttgaaactatcattctcagcaaactatctcaagaacaaaaaaccaaacactgcatgttctcactcataggtgggaattgaacagtgagaacacttggacacaggaaggggaacatcacacaccggggcctgtcatagggtcgggggaagggggagggaaagcattaggagatatacctaatgtaaatgacgagttaatgggtgcagcacaccaacatggcacatgtatacatatgtaacaaatttgcacgttgtgcacatgtaccctagaacttaaagtataataataataaaaaaaagtaaaatacaaaaaaaaagaaataaaaaaataattaaaaaattagctcatttggcattcacagtaatcttacagggtacctactattagtatcctcattttagcaatgagggttaggaaaagttaattaagttttctaagattgcacagttactaaaactagaatctgcatgcaaacccaggcagcctgactctagagcctgtaaccttcagcaccacctcatgtcgccccaagttcatgtttttcaggggccttctcccatttctcagtcatttcctctctcaagagaggaggagaaggaagggccaagaagacaacattgctggtgccttttttatttattcagtttacctaaattctctcatcattaccaaatgacacatactgtgagccaggttgagacccatcttttcttagttttatcgatatctgtttacttaaccacaaagataacttttttactcccaaatttgagtgattagtaaagagctacataatgtaaccagttttgcttttcacaagacatctctatttctcagtgggctgaaaaccacacttttgcttcctctttactttgcagtgagagcacagcatttgtcactcaacctctgaatgttagtgacactattgggacgaaaaaggactgtgctggcccaaatggcaggcatctcatatgtggcatctttctttctccttctgagtaagtttcataatcctttatgtttctcttgtcacaggagttcatcaactcagggtgctgagtgatggaacaggacaatttggtctctacaggaacaactatgccatatatttctgatgttagcaataatttttgacttactaatgacagttcttggcttacctagacatccttgagttccagggagtcacaatgcttggttgagtcccatgcacaagattccattggttttaacatttgtgtgtgttgccagatctgtcagttttgcttggccctggctttactcatcttcctgggccgatcatcccaagagacagtaaaaaagctttgtgtcccaaactgagaggagaccttaaggtttgcctgatattaaggcttgatgggataactatgccttgcagatatgactggatggaaagaaaggttatgaaagtacttagtagttttagactatgctaaaagaaggttctagatttcacctgcgagtggaagtggaaattgactactgagagactgagaaatgaacaggaagattcacttggctctactgagggccatgcagaggggcttgcctgatctaggggcatttatctatgtttgaataggatggaagaagagaaaatttggaggtagaagggagagtcagatgagttgagcaggtaatggaatagtttcaaaccagatagcaggtactttttatgctacagttttcattaacatctggtaaagagaatagactccatctcagaataatgtttaaaatgcataaaataaaatgcatagaattacagaggaaatcagtcacattgaaatacaggtatcaaaatattttaaataaattataatgcagtaatttatttgcttcttatttatgcattacataacaaaatctacaggtaggtcttttaaccaccaaacttcaaagtaatgatgagtataaataacatttcaatatatcttaagtagttgtaatgtgatatgaagatatctgtggttgtctacatacataactgaagaaaatactaaatttccattagaggcaaaaatgaaaataaagatgtaagattatttttcaccctagtttatggaccctttaatcctacatgtggacccagttaagaactcttgctttatagctgggcatggtggcacatacctgtggccctagctacttgggaggctgaggtgggagaatcgcttgaacctgggaggtggaggttgcagtgagccaagattgagccactgcactccagcctgggtgacagagtgagattccatctaaaaaaacaaacaaacaaacaaaactcttgctttagagagactggatggagccagtgcagggacccgaatggctgggatgattggggaactaaaccaagctgcatttggtgtgaccaggactatggctgaagaattaaaagaaaagaatacagcattcagcacaaagaggttgcttaataaacattgattgagttgaattgtgctcatgtctctaggtacatatgatagtgtgaggttaagagtcagacctagggcctgcaggggaagttactgggaccacttgctgggtgacggatgcctgccagactggcttggcgggtgttgatggataggtgcactggtgggatcctttgggggctggtgtgtttttgttgtttggttaagttgtctgagtgtgattctcaagtgtatgtgctttgtgtatttgaattctatgtttgctatgtatataggaggaaactgggtttacattgtgcaataattcatagaattgcaaattctgtctctttttttggtaagcaggctagaagccctgggggaaggaaagtagtaatcaaggctcaaaaaggggaagctggaagcttttccttaacccatttaaacaattacctaaactgggttatacatttacttcttctaaattctgactcatctgaagcactaattttgtgtagaagcacagtttttatgtgaagaatacataaatcaggaagttactggaaaaagctttagaagtctgctgtttgtccttacaaatatagaggggaattgaaataaattatttaaataacgatctattgatcaattacattggttagcaaatttacactttgtcccaattttttttcagtaaatataaggactgaacaatcctgatagaaaatggtgccatatgagattaatgtcatgggtaaatgagttctcggatttagcagttagctttgtctgcttgatctatttcccccacccaaactagctgccctacaaataatggccattaatatggcagggtttgggggaagggctattgtctgtcttactgagtttgcattcatgaaaaataaaaaagattccacttagtatggatggaagctatctcagcctccaagcatatagggtttttgaatgtgaaaagagaaagaagctgcttgttatgttggctattcctgaggtaggttttgtataaggtagcattatttgaaactgctgtttttttggtataaaaagtgctcaagtatggaccattttatacagttcaacctaatcgttttcattcaaataatactgcagtggtaaatttgacaattccagtgatatttttaaagaaagtcaataccatcgaggaatttttggtgttttgaaagcatgattctaatgttagtatgtcagtgccaagctttgtactcatcagccaacaagaatatgagctactattcaaaagtagctaaccctctacccattaaaagagagagcaagagggcagtcctcacaggtgtttttcggagggtggatgatatgtacttgaaaaaacccagagagaatatatttatagtaagatgcttaagcttatggccccagtgcatagccatttgagttgatctctgccagtcatgccttctacctgaaaaatacctttgaaatctccacactatttctttcacttttctcagaaagtagtatgtcttagactgtttggcgtgttgtagcaaaagtaccataaactggggcgggtgggggaggggggcttataaacaacagaaatttagttttggaggctgggaagtctaagatcaaggcactggcagtttggtgtcagtgagggcctgttcctcatagcaccttctaactgtgtcctcacgtggcagaaggggctagcgagcttcctggactcttttacaagggcattaatcccattcatgagagcacagccctcatgacctaattgcttcctaaatgccccatctcctaataccatcaccttggaaattaggtttctgcgtgtgagttttaggaagacacagacgttgagactataacacagcaccctccctgtcatccctctactaggacattacttcattcatcctccttgctggcttcacccattctccatcccaccccttcctaccgctcctcacctagctactctttctagctgccatcctaatcttcatttttccttctccatgaaactcctggaagtaggttccacttcctgcagtcacttcttaccctgaaaactgctgcttccactctattgaaatcccttttacaaagatcttcatggacatcctcctcatcgagctaacaggagtctcctctgccttcagagtccccaacctcttggcagcctttggcagtgctgacaagccctttcctcttagaatgttcttcccttgatttccagccgctgtgtcctagttgccctccatctaactcttccctctgtaagttttgttccttatcccatcccctaaagagagaaattccctagtaatctctccttagtcctcttccttctgttccccaatacttcccaacacttgtatgtaactgacctaatctacatctaacagttcagaactctccctagttacaaacagacatttacaggagccaacaagaaacaatggggacagccatggatttggcatttgcagatctattaatatgttcaagtctggctcaaatcctaggagtttttacataactaaatatgggaatatcacagggtttttgaaaggattcgattacaaatattttcaaagggttaaagtctatttaaccctttgaaaatatgtataatttatatgtaaatataaatatctatatttaaatatttcaaaatgtttgctggatatccttcctgtctattccatggtcttcaaatttagtatttctaaaattaaatgcattatattttcactcacccttatacacacaacagtaactcttcctaatatctgtatttctagtcagagtatcaatattctcccaggcagccttatcaaacctatgatctttgatttcttcctacctctcatctcgccatttaaccctgctactcccaagcatccaacgcactgaaaactacagattttgtctccacagtagctcagttatagtacctttacttttatccctattgcttttgtcacctctgtcctgagctcctacaattacctgattgtctatttctaacttccatcattctgcacacaaactgtgaggttcattttcctaaaacctcctaaacactttcagtggattccccattgccaatgaatcaagtccaaacttttaaatgtgatagtcaagtcctttctgctctggacccaaaaattgctgtccagttttacctctttctattaatctttatgcagccctcccccatccagttgattactctttaattttgagtaagtcttttgattcctactcagagtcttgccatgaaatctccttcacctaaaatgctctgtctccccacttaccttgtcataatcttcccaattctccaaaatccatttctaatgccatctcttatgccatctccataaacctatttccctcccctcaaaatgtagtccctcttcaaaatttttgaagcacttttattatatgttttccatagagaggtgactactatccacttgattggattatgaaatccagaagtcagaatctagcctaaattcatcttcatatcttagtccctcaagcatgagaaatactataagtagttgaataaatatttattgaattggcaaataaagcagtagaaaaagaagtgcgtgttttcacaataaaaattttcaaacgtggtacccatcttgctgaaaagtgatgggaaacgttcgagaagtgttgcctagccaccaaaaataacattgtttgtagaaacatgccttgatatatgtgggttagtggtacctcaaaagccacattaagaaaatatttttattgtgaaatacaacataagaaaatttttattatttgtttaaaataattttaaaataaatttaaaatttgttaaacaaattttcagtttaacaaataagcacaaagtaaaatctgtataatgtctacccaggtcaagaaatagaatatcgccaagaccctagaagcacccacccagcccgcagtgtgccccatcagatcacaaacaccatgcaatcactttcctgactttcatgataaccacttcctagtttgcttttttttttttctttttgagatggagttgcccgggctggagtacagtgacgcaatctcggctcactgcaacctctacctcctgagttcaagcgattttcttgcctcagcctctggaatagctaggattacaggcaccttgccaccatgcctggctaattttgtatttttagtagagacagggtttcaccatgttggccaggctggtcttaaactcctgccctcaagtgatctgcccaccttggcctcccaaagtgctaggattacaggcatgagccacctcgcctggtcatttcctgcctttttgctaatgatttcagccctttatgtgtgcatcactaaataatacagtgtggtttcacctgtttttaaactttataaacagtacgatcattctgtatatagtcacaaggattcagaagtgtttttgtatcttgctttgaacatagtcattcatgttattgcaaatagttgtaattgttgatttttgtttctatataacattccactttatgactgtaccacagtttatccagcctactgttgatggacatatgggttgtctcttgtttgaagctttaatgagcagtgtagctgtgcatattctttcacacatagcttggtgcacacatttctctaagacggcattactgaaaagtgtcttaaactgccactgtagtataacttgttggtaagtaataatttacatttttctaaggtggtctaacttgtattcctagattcttattacaaaaaaagcatgatataaatatgtcacattaatttggacttatgaataaattagtgtattctaaattattatagaggctgagcgcagtggctcacacctgtaattccagcactttgggaggctgaggcaagcagatcacttgaggtcaggagttcgagaccagcctggccaacatggtgaaaccccgtctctactaaaaatataaaacttatccaggcgtggtggcccatgcctgtaatcctagctactcaggaggctgaggcaagagaatcacttgaacctgggaggcagaggttgcagtgagccaagattgcaccacaacactccagcctgggtgacagagcaagaccgtgtcaaaaaaaaaaaaattattactagaaatgtgtgtggttggctgactagttggttgggcattggttggtttcccagttttagactgaacatacatatatgaaatatatgcacttgactgcatcaggtgaccacttaccttttctgtgcttttgcccttttttgtagttccctcctatcccttagaattattttcatttcatcccagattcctatactcagccttatcatgttctctgtaatgtcctttttcctttccctcactttttttttccactctggtctccttactctttgtccctgtggagtcacaaaatgcagcagaggctctgcttcttactcatcttcgtatgaactctgttcggttaactccataaggccagcaatctctccctgtctggcccttctggtgtcttccaaccctgtcttcccttttacagtaccctgggcccctagtggaagaactgaccactcttgtggcatgtctttgttctttctgcaacacaaaatgaactagcctttaatatcaatcatagtaagtaaagatatgctttttgatttctgaaaaatgcttgatttaaaaaatttgtcaaatgaaatattaccatttaatcatgctttttcctttagacctaatacttcagatttgttctaatagaaaacattccctagtggtcccaatggaaaacttttggtaagaaaaaagctaaaataaattctaatcccagaacctgctggattttctagccatctattaggaggcttttcagtaaagctatagtggctctttaagaaatgacaaaacaaaaccaaaaaaacctccacagaatagaaaggaagtgctgctgcctcgtcagatgctaatgttggctagtcttgcaacagacctggctaggagctacaaatagttccaaccaaccagctagaaaaatcatggcaccaagggcagagccctagactttgcgtctccagcaactacttctctgggaactgcccgatggcaggcaccctggaatttgagacttgaggaagtatatgccaaattttctcagaaaataatgtaaagttaccatacatttatttgctttaaaataagtacacttcgataagcagatgttttatagaagtggtcgtgttacattgatgaagctaaatttttttaagagactgaagattactatggaagttaaagttataaaagaacaattaactcatcaagcaattccactgctgctcagcctgaagaagatgttgaacatttgagtcaattatagctaataacttgcgatctcatttaccagaattgtaatacagggaaatacataacgtggtacactgggaactggaacactaatctctttttattcccctttctttctcctacttacaagctaagctcagcattggccagagagaagtaacagttcagaaaggaccactgtttagagctgaaggttacccagtcagcattggctgcaatgtaactggccaccagggaccttctgagcagcatttccagtggtctgtttacctgccgacaaacccgacccaggaagtccagatcattagcaccaaggatgctgccttctcttacgcagtatatacgcagcgggtgcgaagcggagacgtctacgtggagagggtccagggcaactcagtcttgttgcacatctcaaaactccagatgaaggatgctggcgagtatgagtgtcacacaccaaacactgatgagaaatactatggaagttacagtgcaaagactaatctaattggtaagttgcttgtccacttctgctagccagcccctgagaagccagagtctccaccatgacaatatcttgcaatatgacatggctttatattgttccattttctttgggaaaagagcccatgtacccctgtggatattttggagatatgtcacaagtgggtatctcatattctctaaaattatctgtttctttttctcaattatctttgccataaatatttagatggtgtgtggttttcccaaggccttgtccgcagctctccataggttgctagtagcaacagcattcaacaaagctgtgagagttctccctgtgttgtctctgcttgcaggcagaacagtaatttgacaagaaagctggtaccataggtgataagtcattaacttagaaatgataattctcaaactaccattctctagcatatttacacattgggaaagggtgatagtccttgcaattgtcactttgtccctttgtctggaatatctatcacccccttttcagcttaacaaactcctacatatacttcaggacccagtttagatattacctcttctgtggaactcatcttgactgcttgggcagaattcccacttttgtttcctttagattgttcataccactgctctcagcatgtatccagttacatggtaattggctatttgtatgcctctttcccaccacatcctcagcttctactcagtggctagcaccgagtagacgctcagtcacattcattgattaaatctaagtgttgctttcatataagcttaggctgtgtgatttcattttaggaaaacaagaatggtagggtagtaagatggttaccaaaactttagtaaagattgcatttgggctctaaatgatacattttaacagccattattacattattagattattacacagccttatagaggagcaggttaaggcccagggaggtgaagtgacatgcccaagtccacgtagtagggatggatttaggatcagaatctaaggtttctctgtcccagtgctttctccctttaaatacatgctttgtgtctgagtagctaaattggttatagcctatgttaataaagcaaagtgagggtcaacacattgatgaggcatttactttgcccagttccgtagactgtacctagatgccaatgttcccaatggcaatagagaaagcatatggataggaaagcatatggcaagtggaaaaccaactcaaagtctgtgtgctttacatagggtagctcagggcgccatctaaggaggcccactggacaagcactgggccagtcacattattatcattcctttgtttccagttattccagataccctctctgccaccatgagttctcagactctcggtaaggaggaaggtgagccattagccctcacctgtgaggcatccaaagccacagcccaacatactcacctctctgtcacctggtacctaacacaggatggaggaggaagccaagccactgagattatttctctctccaaagattttatattggtccctgggcccttgtatacagagcggtttgcagccagtgacgtacagctcaacaaactgggacccactacattcaggctgtccatagagaggctccagtcctcagatcagggtcagctgttctgtgaggcaacggaatggattcaggatccagatgaaacttggatgttcatcaccaaaaagcagaccgatcaaaccactctgaggatccagccagcaggtaattatcttcctacgaaattcattaatacactagtattaggtagtgggtatttatgaggtatgttttaatttttgttctaatcttttgttggctctaaaaaattggctagaaagtttgatttaattttgtatttttgtcatctgagaagcataactaagagggagcacattcagttctggctctgcccacggattctttatgggataaggtctactgagtggctagatcgattccacaagccagtcatggaagtagttttgttaccatttttgccagtctctgttcacacattatctacattatctaatttagtcgtaaccaccaccctatgaggcaagtagttgagtctccattttaaaaatgaggactctgaacttcagacatgctagatgcgctgcctaagcccacccagctggtgagagtggggctggcattcaaagggaggcctgtctctctccaaagcccactcagcacagacagctgggcctcaaagtagctccagtttccaacatgaagccttgtcttcgtcagtgctggggtttccttccacctgccccctttcccaacttggaatgcagtgactttgcttttttattatttttttaatttttaaatttttttaaggacaggatcttgctatgttccccaggctggccttgaactccggggctcaagcaatcctcctgccttggcctcccaaagggctgggatttcaggcgtgagccaccgcacccagcctgctgttacttttcataatcttttggcatttttgtcaaagcaagtataaaggccttgtctgtgattcctggtctctataggcttttgtccaacaggaagtggttgctaaaccatatactgtatatgcattgctaaaagcaatgatccaatagtggatcattaaagttttttctttattaaaaacagtattattgtgttccactaaaaattgtcctgttggcctcaagtatccaagttatactcatgagtcctatggagcgatatcacatgtgctttttaacttcagaaaattctgctggatattcttagccaaaaaagagagtaagaaatcacaatttacagcaatttagtgtaaaatatttaatatatatatttaattcagtatacaatattttattttttaatttaaaaagcatacattactatatgtgtcatacatttgtgcatacatcttgcttactaagagtgcattcagaaaaccatgtgtactgtcctttctgggtgatttaaggaagagtcatgagcgttttttactctaaggattttgttttttttgggtttacctaccactatagaattgaactcccacataaaatgtgatccctgtgacatccttacagagggtgtcatctctctctggtactgaaaggacagaggctgtgggctctctaaatacctgccttgcttttgtttcccagtgaaagattttcaagtcaacattacagctgacagcttgtttgctgaagggaaacccttagaactggtttgcctggttgtaagcagtggccgtgacccacagcttcaaggcatttggttcttcaatgggactgaaattgctcacattgatgctggtggagtcctgggcctgaagaatgactacaaagagagagcaagtcaaggagagctccaggtttcaaagttaggccccaaggctttctctctcaagatcttctctctgggcccagaggatgaaggcgcctacagatgtgtggtagcagaggtcatgaaaacacgcacaggttcctggcaggtgcttcagagaaagcagtcaccagacagccacgtgcacctgaggaagccagcaggtacgtaaagtcaaggccaggcatgcattgggctgctttcagatgcccccttgtcagtggaagaccccttcgtggatacaatggggatcttcatgaagagcaggtttcaatcagatcacattggaggtggagtggagtggagtaaaggaaggcacccaaactagctgaagacccgagtcctattcctgagtcattaagtagtctgtgaccatgaacacaccactttacgtctctaagtctcagctccttcatctgtaaaatgatggcacacaactagatggtctttaagttccttcttgctatcttagagtctatttattttttgttctaatttttatgtattagatatttcttaaagcagagaacatgtgtattaatgaagccctctgcctttgtgtgtgtgtgtgtgtgtgtgtgtgtgtgtgtgtgtgtgtgtgagatatgaataggttaagagtaaaaagctacactttgtcctccttcctgaggaatgaacacccgtgttatcctaccttgagaccctgccggcatttttcagttgccttctgttagtctcctactatgttgacctggtgtgggaaatagtacttagtcataattctgactcacagtaagaaatgaagaggtaattgatagtgggcagactccatcctctgcattttgctgtgatgtggtgagacgccggtccaaatggttctgaatgtctgcatgcacggaactgaggaagccactcagctcacctttactttatgaaggttgggtgaccttaaacatgtttgaataatcagtgccttttgtgaagaaaaacagacatatctacaactaatataaggattcactaggctgggtttaaattcaaagtccagaaagattaattgcccaaaaaaaattttttttaatgttttaaatttttaaaaactgagctaaaaataaaggtgtccttgttgcactggctcattggagacatctccaaagatagataaattttcctttcatgttctccaatatgccatttactaggaatgaagatgcaccgatttggccttgagtggcaggccaggaagtgtgttggtgttcgttttcacactaaacatttggtctgactttctagaattaaggaaaaacaatataggtgagttcacatatttatgcagagataagtttctgctttatgcatctcagccttctctggaacatatctgcaggcttttgtaaacctggtatgtgggaatttcacctgaaggggaacttcagggtacacagctgataatcctatcaatagggtcatcttctaaaactaaaaatagttctttgtataggctggagtctacactgggcttactatgtagacacagaaaaagttattagcaaatttattaaggatcctgtttagcattctgttttgaaagtcaaacgttacttgaagtattagcaacattttatcatttatgaatattttaatcactcattaccattgtgaatgtgtaacttgcacacatttcataagtttattacttcttaccaaaaggcagtaatggccacaatgaactaaggaaacatcatttaaaaaaaaaatcattagtttaaactaatcatcatggttatgttaaagtggtgagattatgagtaataatttcccctccaattttgaaacttcagttatgagtctatttttaacttgaaaaaaactaaatttgaaagcagatttgctctttttaaaaacatatttatggacattaaccctcattctctctttgttacttatgtatatgtatgcataaaacagtcaaagattgaactccttcctccgcagggaagaacaatttgcaaattcatttagatcctatttagatttctaatgccagttctattttattttcctcttttgctttgaattacctctgcttttgccagagcctatcattaaacactaatgctagcagctaacctttactaagtactttccctagccatccaggctaagctctttgttcagtcttcatgtgccatttgttcagtcttctcaacaatgcagcaaggtgagcactattattatcttcatttttacagaaaagaaaactgtggtcaaatatgttgcccagggcaattctgactccaggagccgtggccttaaattagtgttgggctgcctagaatgtacaatctcctgctgtatctctacattgctcacaaagcaaccaggaaagaccttgcagaattcatgtttgttgaataaatgcgtttgttgaatgatgacttgaatttcccatctgggagccagatttacatttatggttttacactgtagtttagacataagaagcctctctgtttacaacaacgtgtgttgtcgtacaccttgttgtacacgttgttgtacaacaacgtgtgttgtaaacagacacacatttatatatatatatatttatttatatatatatataaaatgtatatgtatatatacacgtattttcccgccaagtaattgtttttcatggtaatattgtgaacagagatataattaacaatgatgtttcttcctcattcaaaacacttactaaaccaatcagattgattagggaaagataagaaagaggaagattgtcttgaactctgaaggtccgaattctaaaaaactaaaaatttaaataaacacagctttattagtttcaggctcttatatctaccctaattaatatactaaaacattaccagatgttttgccaactagatattcttaaggaagagttgatttaacaaacaaataagaaatatgtgcaagtgataaattgtttaagtaagctgggtgcagtggctcatgcctgtaatcccagccctttgggaggctgagacaggaggatcgcttgaggccagaagttcaacaccagcctaggtaacaaagagagaccgtatctctacagaaaatttaaaaattagccagcatgttggcacgtgcctgtagtcccagctactgaggcacgaggcaggagaattgcttgagccaaggagtttgaggttgcagtgagttaagatcacagtgctgtgttctagcctgcacaacagagcaagacccagtctttagaaataaataaattgtttaagggtgaatacatcctccgatattctttctgctatcttgtttccactatttaaggtttggcaaatcttttgcctgagggtggtgcaagaggaaacagcccaatttgacttgtcacaaactagtcaagtcctaattaatgaaatttcactgtattttagaacatttcttatttacctaaaacagttttgttcttctataatctgtaactcacagcaagaagtgtggtcgtgtctaccaagaacaagcagcaagttgtgtgggaaggagagacactcgcctttctctgtaaggctggtggagctgaaagtcccctgtctgtgagctggtggcacatcccacgggaccagacacagcccgagtttgtggctggcatggggcaggatggcattgtgcagctgggtgcctcctatggggtacccagttaccatggcaacacaaggctggagaaaatggactgggccaccttccagctggagatcaccttcactgccatcacagacagtggcacatatgagtgcagagtatctgagaagtctcggaaccaggccagagatctgagctggactcagaagatttcagttactgtaaagtctctgggtaagtgtcaaaggaagtccttttctgcacctgtatatcactcaattcattctgcagtggaactggattgcgtgttatcctgaatcccccagtgatggtatgtgtaccctaggacacagagctagtctctggctaccctctctgtcaattaatctttaaagattcttcatttttgtaaagatcatctttagagtgcaacttgtaaattgttgttcaaggttaaaaacaaaatcctatggatcagcttatagacgagtatagctgagcctcttaccttctggcttttgacagctgtggccctgggattgcagagcccattgaagcatgtgcaaaagggttctgatactgaacccacgcatgggggtaagggaaggaggccagacgactagggtggggagtgctccacccactcagcagcagctgtctaagtagcagattggagaaacgctgcctatttgttgtggctgctgggaacagtcttagaaaaggatcaactttgcaaaattgaggtcacagttcaggacagactgtactgggaatcaatttctactctataaaataggaaactccaaatgtacaaatgcatggtcctagtcaaagaggtggcaactagaaaaacttgaaagtgctatattttaatctggtaaatatattagaaattctgtttcatttttctgtctagagtcaagtttacaagttagtctgatgagccgtcagccgcaggtgatgttaaccaacacctttgacctgtcctgtgtcgtgagggccggttactctgacctcaaggtgccactcactgtgacgtggcagttccagccagctagctctcacatattccaccagcttattcgaatcacccacaatggcactattgaatgggggaatttcctatcccggttccaaaagaagacgaaagtgtcgcagtctttatttcgttcacaactcctagtccatgatgccactgaggaagagacaggagtgtatcagtgtgaagtagaagtttatgacagaaattccctatacaacaaccgccccccgagggcttctgccatctctcacccactgaggatagccgtcactttaccaggtaagtgtgacttgaaattaatccctgttttaaaaacaaacaaatagcaatcctcccattttgggtaagttataacaataaaacataaaatactttctcccatatttgttctatctaagtaagcaccacatgatgaatgatacccaggttaacattgagttagtatgcatgggttggccatactggttgttaaaacattgaaataccttccatgctggctaattgctgctctctacccattccccattttcccctaagttcccaccacccagcaactaaagggtaccacgtggcacagcagggggcctctaggacctggctagaggggagaagaaatgttttggattagtcactgtccaggccttaccagttagtaaacatttgcagtgtctctgctagtggtagggataaggtaaattccactggaatacatccacctacttctttgtaaggtgttaatgtataagagtcagagaatttattattacaatcaaatataatccatctcatcaactgataatagagcataggagttaaaagtgagatactacctaggcaaagttctgctgtgtcatgtatcttctctcttatagtttgcattctcttaggaagagtgatggagagacgttggagtcatttagatctgacagtcactggatagcagaacagctttggatgagccacttaatctgctgaagccttagttacctgatctgtaaattgttaatgtgcaatttaaatatggtgacatatataacatgccgagtacctgacacaccaagatgacgctcaaacgtggtcactgtcattattctctctgctgctgtgcaacatttttggtaatagtaatgatccccttgttcatgaattcatgcttaattaatttgtcctctctgtggtatttgcaattgctgccccaatctgtcttcttgaaacttcttttttccttggcaccatgacacaagattttcattttctcctccactgatttattctttaaagaaaacagtttctctggattctattcttagctttgttctcttttcattctatacgctctcctgcagtggactcgtccctacccatggatacaagctgtatgttcacaactcccacattcattatcttgaccaatttctcttctgatctccagactcgtatatccagctgtctccaagacatgcctgcactcattatgtcaaaacataaacccaccattatcatccaaagctctttcttctgcattgccccttatgtccccactccccaccagtgacccaagttgaaaacctgagtcatcacaactcttatgttcaccttgtatctaaactcccacagtgtgacatgcaaggtcctttatcatctggtacatttgtgtctttccagcatcatctccttcaactttccatcgtgaatttgagcttcagccacactgaattactggcagctcctcaattgtccatgttccctctcactctcaaagtctttgatctagttgcatcttttgtgtggcaatccttaacctcttctccatcggaataattcctataaacccttaagactcagctcagaattatctcctccaggaagtctcccctcactcctgtatttgggctaggagaccctgctgtgtgctcagataggcacttctatatacctctgtcttacatgagggacatgaggaacaaaaattttacactgaggccaggtgtggtggctcacacctgtaatcccacactttgggaggccaaggcgggcagatcacctgaagtcaggagtttgagaccagcctggccaacatagtgaaaccccgtctctactgaaaatgcacagattagccaggcatggtggcgtgcacctgtagtcccagctactcaggaggctgaggcacaaggatcgcttgagcacaggaagtggaggttgcagtgagccaagatcatgccactgcactccagcctgggcgacagagcaagactccatctcaaacaaaacaaaacaaccaaaaatctcacacttgagaaaggtttctcaagagttatttcagctgcacattctaaatgtggaagacagtgatcagggcaaatatcactgtgctgtggtagaatggctctttgtctacaaatggcacttggcaccatctctaagcctctgtccctgcacttgtctccctctagagtgtgagccactgagggaagatatccacagggcctggaattgtctggcacataatatagtgtgtgcttcataaatatttgttgaaggaagagtaaagggacctatgggcaacatcaataagcagttaaaaaagtagagtgggtgatgtcagcaagatgctagaagaagatttgggaacaaggattgtcactcatctttctgacaaagcagaaaagctgctggggccaaagattagttggctccatatctatacaatgttcccacagttaagtgactgcaaagacacacacagttttaatcactcatgtacaacttccttttgtttacccacgtttgaaggcagatacaactagagtttggaaattgtgaatccagaagtactctgcatagtaaacacacaaacacagcattaatagggccactttctcccaatctgatacatgaaatatgacagaagagatgcttgtgcttaaataccgaagcagtatcatgtggaagagagatactgggcttgtctgtgtgacactccctctgccacaccacccctaccaagcacaggtagcactaggactagtggatggaagttatgaagagataaagttcaacttgatatcagaaagcattctggaggggcagagctgtccagagatgaaatgggctgccttgtcagctagtgatgctgttcaaaagctgtatgagcagtgagtggggctactgtagagggagttcacccatatgatggcgggaggatgcagtgtcatacttgacctctaatgtctctactaccttaactttctatttcatagcaaagtaactgtttcatttttttaaatttagagagcaagctaaaagtgaattcaaggagtcaagtccaagagctctccatcaactccaacactgatatagaatgtagcatcttgtcccggtccaatggaaaccttcagttagccattatttggtatttttctcctgtttccactaatgcctcttggctaaagatcctggagatggaccaaaccaatgttataaaaactggggatgagtttcacaccccacagagaaaacaaaaatttcatactgagaaggtttcccaagacttatttcagctgcacattctgaatgtggaagacagcgatcggggcaaatatcactgtgctgtggaggaatggctcctgtctacaaatggcacttggcacaagcttggagaaaagaagtcaggactaacagaattgaaactcaagcccacaggtaaaccttgcgagtgtatcctcacaatgtctgtctgtctgacggctgttttctcttgggcagctgttctatggagtgattatgtggaagtaaaaatatgacctaaagtcataggaacagtatctacctacacatgactgcaagaccgagtagtccaccaaaggaggggaggtcacttaaggcaatccaatctgaggttttggggagctgaggtaggagcaatatccctttgattggtttgcttctcaacctggcagcctggtctgtgcagctacccagggtatcgtatctccagatctctatcataacaagctgtgtcattccagtggggctctactgtaatttggcagagaaagagtaatacgaagcatatttctcccactgtgaacagaaactgtacaactctatggggatgtgtggagaaattgcttctcaacatttagctgcctaaacataaggcaaataagagtagttaactgttggaatggcttactgagggagtctcctcttcctcaggagatctttaaaaatgtaatggaagttccgcactggtctaagagtgccactgtctaaatgtgggcagggttgattaggtctctcagcataggttaggtcacttccagtgttgattaaaattaaatgaatgtcacagccaaggttcaggaactggccaagatcctacagcacaatgcagagaagttgatctaatttggtgcttgaaatactattttcaaggtaacgctaaaaaaaaattagatgataattgagcattactatgtgttaggcagtggaatacaaagataaagaaggcacagccctggcccttaaggagctcccagtctggtgggacaacaagggcagaacagcagcttggtttggggtctcttcctgccctctggcttcccttctgtatgttcttcaagccccttcttctccctgctaaatgtgtgtgttcctcagggatagatcctgggcctgttttgcttcttattctctgctttcctcagaatttcttaaacactgccctggtttcaactaccaccttctagatgataactctgagattttgtgcttagccctgatctcctgagctccaagccttcatacccaactgcctgctgtacatttctacttggatgcccccatactcagcatgccctaaattgcacttagcatctctgccatctcaccatgctcatttgcacttctgcatttcccatctgtgtgattggcattctgtctcccagtcatccacaccaaactcttgaccacatgtgcatggccgtcttcaggaggcagccactgcttagctcaagtgcttcccatgtagaaatgtgggctccgtgttgtcagatctttttgcatatctagagatgcctaaaatcttttttggtgacatctcccagtttgagaatgtccacaactaattcacttcttctttttctttttttttagacggagtcttgctctgttgctcaggctggagtcagtggtatgatcttagctcactgcaacctcctcctcctgggttcaagcaattctcctgcctcagcctccagagtagctgggactacaggtgtgtgccaccatgcctggctaatttttgtaattttagtagagacagggttttaccatgttgctcaggctggtcttgaactcctgacctcaggtgatccacctgccttggcctcccaaagtgctgggattacaggcgtgagccactgcgcccagcccagttctcttaaaatactgcaagtgtcaagcagaacatacctgtgggcttggtgtggctgtggacttccggttgtgcacgtcatttagggaacaagttaaccaagaggccccagaaagatgctgagaatgactggtcagagttgtaagggggatattttctctgaggttggaagaaaagaagtcaatttcaaggagaaattggactccagtaacaaaaaccacatagaggacagaaaaggactagagggtcccttgaactgggaaattgggccctggccaagtaaagtgatgggattggaagccagatcacaataaagtaggaagtaatttgagacaaggaaacagcaacagtattccatgtgctaatattccacgtgctactccatgaaggaaaggggagagtaaaaatggtaactaagaaagagtccaagatcagacagaattattctcttaaagacagattaataaatgtgtttgagtcaggcacagtggctcatgcctataatcccagcactttgggaggccaaggtgggcggatcacctgaggtcaggagttcgagaccagcctggccaacatggtgaaaccctgtctctactaaaaataaaaaagttagccaggcatggtggcccatgcctgtaatcccaactgctcgggaggctgaggcaggataatcgcttgaacccgggaggcagaggttgcggtgagccgagatcgtgccactgcactctagcctgggcgacagagcgagactccgtctcaaaaaataaataaaataaaaataaataaataaataaataaataaatgtgtttgtagtggaattgaaaatgtaatgcacactataatttctttattttgtttgtaactactttggctgttattctaaatcctcacctgctggttagcaaggggaaaaaaagtaaatgtcaaaatctctttaaaactcagtctaatccaatcatctaaatagctcccatggatggccttctaacacttgcatcaaaatgttcagtctcttggatggcgtcctctctctctgcgtttacacccaagataatatctgggtgtatgggaggagagtaatttgctaagaatgaggggtactggtggaatacatggcttgagggagctgctaaaagttgtgaatgaccactttgggaagtagaggaggagtgaatcaaggataagtaaaagcagcaggcagagggccctgcagaagctgtgtagttttcaatggcagggtccagcaggcaagcagttgggctaaagaaggaaagaggctggtttgattcctagcagagaatgtcctggcaaatgtgagagaaaaacagggaccaaggacaagaattaaaatgaatgtggctggacgtggtggctcatgcctgtaatcccaacactttgggaggctgaggtgggcagatcacttgaagccaggagctcaagagcaatctggccaacatggtgaaaccccgtctctactaaaaatacaaaaatcagctgggcatggtggcacacgcctgtaatcccagccacttgggaggctgaggcaggagaattgcttgaacccaggaggcagtggttgcagtgagctgagatcatgccactgcactctggcctgggtgacagagcaagactctgtctcaaaaaataaaaataataaaaaaaataaaatgaatgcactgatgtctaaagaatataagatcttcccagtgagaactagatttttcagaggtggtatccaaatctgaaagtctgcattctctaatttactgccattttattttctaggaagtaaggtacgtgtctccaaagtgtactggaccgaaaatgtgactgagcacagagaagtggccatccgctgcagcctggagagtgtaggcagctcagccactctgtactctgtgatgtggtactggaacagagaaaactctggaagtaaattgctggtgcacttgcaacatgatggcttgctggagtatggggaagaggggctcaggaggcacctgcactgttaccgttcatcctctacagactttgtcctgaagcttcatcaggtggagatggaggatgcaggaatgtactggtgtagggtggcagagtggcagctccatggacacccaagcaagtggattaatcaagcatccgatgagtcacagcggatggtgctcacggtgctgccttcaggtaaccaggggtttatctaccgcgagctcatggtcaggagaatacatggctctcctcttatcctctccctctcacctatcttttgctccttctgaagacaattttcagactgaagacaattttcaggttccctaaagaagatgactttgctgtctctctcaatagtaactcatttgaacaaacaaggtccacatgagattttggcatagacacttaaatatcgggagcatctgacaggtccatgtctttctgctggggttcagggagaaggtgggaggtgagcaataagctaagcttactgagggaaagggccattggagaagtaggggtgtggtcttggtgccagacaccaggaagcacaaagggaaaatcatcaataaaggtaacaatcctaagagaccagctagctttagtgacactgcttaggagggacagaatgctgttgagaacatatgggaacatctaagaagtagggataggtgcatcccagcgcagcagggcttccagaggggaagtcgaagctatccgatttgttccttgaggtggtccatcattgtttttccctgttcattcctcagcagaagttttctcctgagtgccaggccaaaatgttttttctatcagcctttttcttctttccaacaattacaggaagtcccatactcatgagcacattccgtacatgttttcccagtggaattaataggctctgtagaatcggcagtttttgcagtagaataaatagataagaactgtaaaaagtatacagtctgtgatgaaaagcgtatcttctctgaggcagatgggatccttcatagcatacatattgttaatctttgtgagatccttgtaaaacaggtatatggtttttaaaagataaacctggaaagaaaacattaaaaattgagtggccttcgtattcttcagaaaacctttgtcatgacaaactgagggttttgagggtaattaatgttgaggatttccaaggaaatccctgtaatgtaccttctgggctcctccacctggctgttccttcctggtagtcagggaggcagtgtggggtgataaaaaatcccaggggctggaatcagaccagcctaggctcaaatcacagctctactaccaataccagctatgaaatcatacgctggttacttgctgtgagcctcagctttctataaaatgaagatcacaatataaatatgtataaagtatccagtacagtgcttggcacattgtcagtgctcagcaaatgtaatctccttttccccttatgcctccaaacccgctgcacatacatatacacacaggtacacacatacctacatgtgtacatctatgtgacaaaataatgacacttgtttaataaataactatatcaggttctgaggccacaaaagtgtacatgacagagtctgttcccaccgagcttggaatccagtgggagaaatcaagtccaacataacaggtgtcatcaaagaagtatttccagtagactaggggaacaacagaggcagggctggggtgaagtgctaggtagggagatgatctgggaaggttccccagagtctggggctcatgaaaaggaagaaacatattttaggaacatgaaagagtatgcaagatgataataagatgtaaaatttcatgttatattcggggaactcctggtcattgagaatggcaggaactgcagtctctatggtacagtggcaagagatgagaccagtgaggagggaaaggaacagatgatagatcccaaatgtgtctagagtatgaagctaagaaggaagaactttatcatgacagtgatggagtgtcattgaaaaagtttaagcaggggagtgacatgatcagattttccttttagaaagttcccacattaaaatgaattggaggtcgggcacagtggctcgtgcctgtaatcccagcactttaggaggccaaggcgggcgggtcacctgatgttgggagtttgagaccagcctgaccaacatggagaaaccctgtgtgtactaaaaatcctaaaaattagccgggcatggtggcccatgcctgtaatcccagctactcgggaggctgaggcaggagaatcgcttgaacccaggaggggaaggttgcggtgagccgagatcacgccattgcactccagcctgggcaacaagagcaaaactctgtctcaaaataaataaataaataaataaaataaaataaaataaatgaattggaggggaggtccacagtacagtgcaggtagtatatgaaattgtggaaacccaactggggaaagatgaaggcctgagctaaggcggtacccatgacgactaagaaaagaacaggcattaggtattaggaggtgtaatcttcaggatttagaggctgattcattgtatatagagggcaaaggagcagaaggagagaattaaggattaacatttggactctagcttagatggatagtcgggtcatttaccaagcaaggtaatatatgagagggatttggaggggaagattagttcagttttgaataagttgggctggaactgagttcagagtaactgtgagttattgataaaggtctgtccaatagacatcaagactgccaaatgggatctgcaccagagttgtagattacaagtcatccataggtagccagtaatgatgcccaagggtggagctctgggataaattgccatttctcagggagtggagagcctgtgaaggagactgataggagtgatggagagctgggaagggaatcaggatttggtggtaccacagacactaaaggcagagagggcatcaagagggtgaggagagtcgacagactcagctcttgcaaagaggttgattaagataacagtgggaaagtatccattggatttgacattatgggacaattacagaaaagttatcagggaagtcagactgcagcaagttgaggggagagtgggcacatcaatgcagattgctctttcaagagctttgatgtcaaggggaagagagaagacaataaaatggcaaaagttgtcaaaaaaaagtgaaagtattttagttttgcttttttgctgttttggtttgaagatgatacagatttgagcacatttatgttttagaggggagaaagccagcagaaagaaaagaaagaaagagagagagagagaaaggaaggaaggaaggaaggtaggttaatagaagagtagatacaactgacagtccaacatcagaaagaaagaaagaaagaaagaaagaaagaaagaaagaaagaaagaaagaaagaaagaaagaaagaaagaaagaaaaagaaagaaaagaaagaaaagaaagaaagaaagaaagaaagaaagaaagaaagaaagagtagatacggttgacagtccaacatctgaaagaaagaaagaagaaagaaagaaagaaggaatgaaggaaggaagaaaaagattaatagaagagtagatacgactgtcagtccaacatctcaccatgcatgcaccatctccttcctggaatgctcctccatgccatctttccctggtcaacactctcatccttcatccagcaacttaactgccactgcctcagagacttcccttattcttttagcccccacacctgcagttacctgtttaacatctgtcacactgctagactatactataggcaaagataatgagtgtctcattagtagcactagcacagtgcctggcacataggggatgcttaaatgtttactgaatcactgtgtaattgcactcctgttgagtaccaggtctatgtgttatcaagatccagttcaaatataatatgctacctatggtcacttaacagatggttttccatgctctctatctggctatcccagcttgggctggttttagggccacacaataggactgtagagcatgtggctcaagtgaaggcaggaaagttaagagacattttctcggagaatggaccttgccttttcttctctatcttatttccttatcagtgactaagctatggcagagacaacagcttcctcagtctttttaccttacccttagaccctagacattaaatgtcttattctagagaattgtctgtgattaattgataggccaggctataaggcttcctgggaactggattatctgtagtagtgtggtacttgttactatttcccagcttttatttgggtaaaggtctatttagaaattagatccttgggccagatgtgatggctcccatctgtaatcccagcactttgggaggctgaggtgggaggattacttgagcccaggagtttgagacccctgtctctacaaaaaatttaaaaattagacacatggttgatgcacgcctgtagtacttgctactcaaaaggctgagatgggaggattgcttgagtttggaggtcaaggctgcagtaagccatgatcatgccactttgctccagtctggatgacagagcaagacactgtcaaaacaaacaaacaaacaaacaaacaaagagagagagagagaaagagacagagaaagaaagaaagagaaagaaagaaaagaaagaaaaaaagagagagagaaagagaaagagagaaagggaaaggggagaagggaagataaggaagtggattcttgaaggagctgtgtgtctttaccacactgaagtatttggagatgccaagctacttacctgtgcttcccagtacctccagcaaggcctagcacatggcattcaacaaatgcttaatgaaagaatgagcaggcacgtcttcagttgggttgaaacaggatgctgtcagtgattcacttattctgggatgcacttgttatcaggttaccttaccctacttttatttcttggcaagagccaactcccacatggctgcatgtttggggttgggtagtggggaagagttggcagccccctctttatctcacacctcttttcttctgaagtcagtgtctctgaggaaatatcaaaaaggagtgctccttttgctgtgcttggctgtgggtggaagcacgttctaaactaagcctcatgatgaagtgctctcattacatttttggctttgttttgaagaccttgtactttgagcattgggcacttacttagattgatcaaaatgccaaaccttaatggtttgaatgtcactaattctaatccagatatgggtgagaggcagatggtgggaaatggtgactgtgggatgcagagcaaacactggcctcccaggagaggtgatttaacagcacaggcactaacagttgctagctgttggccacttcagcatggtaaggggcacaccttgccatcctttgatggcagattgcactaagctgggcagcctcttccccaccaagatagccaagccctctggctgttccttcatgctgaaaagcagagtagcagatttatttccacctcctgtgtagtggccccatctcgccatcattaccccaccattctagcaactgtaatacctggtgctgtggactctaacctcacaattctctgcctcccatgagtagaaaaggaagccagggcctcctaagtaatcatttcagtctttgctgaatgtcacccaggtctgaggacagggggactagagatgtaagggagagagagcctgtggaggaagatggccaagcctggggtccctgtgggagagatatctgtaggctccagccctgttctctgtctgttctcttgggagaaggtttcctgtgattttcttagctttctcagtagcattctagctaatatttattgcttgctgactccacaaatgctttaggcacttcgttagatgctttattatacattatctcatcacaactctagaaattgttatccctatttggttgatgaggaaactaatgattaagagaggataagtaacttatccaatgtcaataacagcacattgaagattgaggatttgaactcagctctctttgaaacacagtaggtgctcattcactactctgcacaaatgctcacagccagtgcttataatacctggactccatggctccattcacttgcatcattgcagtctatgcttccttctagccacgggccttcaaatgtactcagataagaccgggggagaataactgtagtcaagcagggtcattggaagaggggtcagataggatgtggagcagagggatggtaaagaattcaaaacctaactttatcattgctcaccatttcaaaaaacaaaactaaatttaggatgaaggatacaaatgagatcagagaaaatccaggccatgaacctctgctgctctttgccagccccattcagagctgccagcctaatgttcagtgatgatctgtactttgtatagcatgatggcagccatccctgggttcccatgtgtggaatgtactcatgcaattgattcattcatcaggctccattgagaccctgtgaacaaagagttgaggaagataaaaagacacacaagacacaggccctaccctcaaggagctcacagtgcaggaggtgagcgaatgtctagattctttcttgactatcatcaaagagatgttctttaacatgtaggattcgtcggcaatgccaaaaatggaattcttgcagcaggaggttggtcaaaatgacctctaaacctctttcatctctaagcatccataatcccatgaatcctgtagcttaacctttgaagaagaaattgcttatgtcattacaattttccagtaaaagcacagctacagttagcattgaatatttcagaacagccctgatttcagatatcatgtcataaataaatgtaattggaagactacatttagtaattggtctctttaagcatgtgtctttctgcttcaatagactgtttcctgaaacctgtggtgtttgcagtcctctgggcctttgctttcctggccgtgtggccaggagccactttggggctgcttgtgcgtgctctgcgtgtgtatctgctgattgatagtgcttcccggcggactgcagctgcgggatgatcatatgcttcagcatgcctttatatagtatcttttgcccatgtggttgcagtcaatccaatttaattcagatcagcaaaagttactgagcacatgtgctaggcactgtaggggatatagaaacaaatggcactatcagacatactcaagtaactatagtgaacaaaggagacgagtaaaagggaattaaagaggcctaaacaaagggctgagtgagaacgggatggaagagaagaactgtgcctgcagcaaggtaggaagagctgagagagtaggaagtgtgatggagctaggccagaaggacctagaggctcagatgcatggagcatgtcaggtggtggccacagccagagcaacacaggaaaggagtgggagggagggggccggggaaggaggagacccacagggagggccaggcttgggtcagcgggggtaggggcttcttattgtgggtgtgattgttttataaggacagtgcagagtgcagggcagagtgtgtgtgtatgtgtgtgtgagaaagagtgtgtgcctgtgtgttggaggagcagcagtgggaataactcagttaaaaattcaggactggcaacactgttgagaacgagggttgaattatagatatcttttctgaagaaagaagattaaaggagaggttttcttttttgttttgtttttcattttggctgttagttttaagtaggtcattggaacctccagtggttggaaatcgcagggcaaggggctgttgcattagaagagcctgttccaggagctctcttcccccagtgctctgtcctgtgctcctcatgatttcaggggcccactgctatttggccccattatttttacatatacttgcctataacaataaatcccaggagtgtttgtaattgactagtacaaataagttggagatgaattactctcttgtttctcccttcgttgcagagcccacgcttccttccaggatctgctcctcggcccctttactctatttcctgttcatctgtcccttcgtcctgctcctccttctgctcatctccctcctctgcttatactggaaggccaggaagttgtcaacactgcgttccaacacacggaaagaaaaagctctctgggtggacttgaaagaggctggaggtgtgaccacaaataggagggaagacgaggaggaagatgaaggcaactgaatcccaagaggcacctgcagccaggaaggaaaggtgggggctttttaattgggctaaccagggtgtgaatgaatcctggttctgtcctcaactatgtctgcggccttgggcaagttacctaggaatcagagggagcattcactgagtgcttattggttctacgcactgttaggtgttcctttgtgtcttacctcatccacctctcgcatccccccttggaacaagatagcatcattaccctacatctcttgaaggttcaggtccctgggctgcaaggagataagaggctccctcacacagcctctggagggctaaatgagatcctacagcaatgccctggtggggcttctctctccctcttatgtcacttgtcacacctgctctaggtaatcattttcctccagatgagaggtgtaggaaaggacctgatgccagcaaggaaaaaggaattggtaacatgctctttgtttacctaaaatctgtccccacaacaagaatgtaacttccttcgaggcagaaattcaattttcttctcccagcccacctacaaaggcccactcaagagcaagttctgtgtaaaggtgcttaactaatacaggttctttgacaaaatgataaaacatttgtaacctgagtttggggctttttgtttattgtttgataagactttttattaagtaattgctgagcaaaaactttgtaaaaactcatgtaacagtactccagtcagccccccaaggcctcgtacccctgcttccccctacacctccatatccccaccaaaaggtccatctggctcctggtgctcagccagtgccttattttctttgacctgacagcactgggtggtagggaaggtattgtctggaggagcagggttgacagtgccaccgttccctcatacgcctgcagggctggggtttggggcagcagtaggtcaagtctggttcctcaaggtctcctattctcagtagcaaaaagcagccggtgggggtggggtgtaatggcttaaagctttcaacagctgtccccactgggcctacagtcccctcatctttgtttcaaaagccgctcaggccctgttgtagccagaattggaaatcaatcagtgccacctaaagacttgagaaaacacatctatttattatctatgtgaccaaccgagttgctttaacactcgttaatttgcatttccaaggagagcaatttagttttaattatttgatcaggcacacacgtcctctccaaacataattagttccttcctaaggggattattggtggctatgagcactcctactatggacctaccagttccttaaactcatgtcccttcatagcctgatttaaaatactccaaatctttccttaaacatgtcagcacatttgtttcttgtcatccaggtaagggagcatatttttacaaacaacaaagctgaaatgaagactttttttttttttttttgagatgaagtctcgctctgtcgcccgggctggagtgcagtggtgtgacctgggctcactgcaagctccgcctcccgggttcacgccatcctcctgcctcagcctcccaagtagctgggactacaggcacccgccaccatgcctggctaatttttttttgtatttttagtagagacggggtttcaccgtgttagccaggatggtctcgatctcctgacttcatgatccacccgcctcggcctcccaaagtgctgggattacaggcgtgagccaccacgcccggcagaagactcttagaaagtgtgatgaccccctgcccctattttttagaaacctgtattttaattcaaagggaaagagagcagaagtgagcctgggcagagaatcttggatggactctgctgcagccctctgtgggagcactcttcaccccatccctcctctctgctcacatggacacctccttcaagcttctagctcaaacacctcttccccttttgaatccagcacagagatagcacagaggagatgtaagcagacagggagggtctcctgggaaagcagacatttaaccaacttgagcaatcagcttgttttacagcttcctgccttgctgcctgtttcttcccaagccccgtgtggaatgtggtgacctagtcacctggaaccagctcctgacagaccccggcaacttctagatgaacccaagtgaactttcctcattaccatcctgaagtcactaccccagggggagctatagcttcatgaccgtaacatgtgacctgtgtgctggcaggacgactcactgcggctgcgccactgggacccctcccctacatgcaccaatgcactctctcccctctccatcaccccataaaaccctcctgtcactttccttcagagacaccgctttggagagtattcccagcgctctccttgcttgtgacaagtaaaaaaaaaaaaaaactccttttcatcaaaactcatgttcttgtggagagttatttgttactcgccaggcaaacaaacgctggtttttttcagggaacagagaccctcaaatatgaaacggttccggccagagcacagcatgggaagtgtgagttcccagtgggtacctgctgcatgtcaggccctgtgctaggagcaaggggccctgtggtgactcagacacagccccatgcccctgggatgctcaccttgtttgtcctggatgctctgctttcattaatgggacttagagcacctttgatagtctaagcagccacatggcactctttgtcccataggcaactaaaatcctccaaaactaaaacacccccacagtattttcttctttttaaatttacagaataaaatttgccctgatccagttcagcagacattttatgtgaaacctcttctctctccaattacatactgtttacctttggtttttgaaacttagtggagagctttacttttacttattgatttcagcttttccatttcatgccaccacctggttttacttttggctttttgtgttataaatcttccttggcaaaaggacaagcctctgtctcaggagttgaccaaccagggcctatgggccaaatgcagcccaccatctgtttgttttttaaaatacaatatactggaatatggtcactcccattcgcttacatactgtctgtggctgctttcacgataaaaatggcaaagttgtgtagttgccacagagaccataggacctacattgcctaaaatgtttattattctggccctttacagaaaacatttgccagccctgctgtcctttaatgttctgtctctcttagccatgtattatgtccctgggaaactgatttgacctcttatatctgaatctcttctatatctgattaatctaataaataatcttaggttttcaggattggcatctagtcccagccattctgaagtttgactccgctgtaccggcctcacactatagatgggaagtttatcaccctgcaacgtttcacgccatcatactgagtacctactctgtgcaagataagatgacacagggatgattaaggcatggttgctgttaattatttttattgtattgagatgtatagaaaaaaccgatttatggcagaagatgaatgcaatggtataaagtcatgtgccataataatttcttacaatcgtacaggatttttttcattatctcagaattttacagcatctctatacaaaaggaattgttattcctgtcctacaggtaaggaattatagctcagagaggttgggatttatccaggatcacccagccatatgcagaagagtaaaagctcaaacttaggtctgctgacaagtcctggactctttccacaataaacactctttccacaataaacacaaaaaatatgctcaaatccattgctatgggggaaaatctggatataataatagccactttgagtggttgttatggtgatcaaatcagatacatcaatggagataagttttaaaaccacatcaagtcataaatgaatgtcagcattaacccaagtttttctaggacttaacctgtccgtgtacataaataaaatgtaatcaatagtaataatccaaattctacaggctttccctcccagaatatttacacagggtcttggccatctacagtgtcctttagctatttctgggggatttcccaaaactggaaatttttttttaaagagatgaggtctcactagattgctcaagctggcattgagctcctgagctcaagtaatcctcctgcaagagcctcccaagtagctgggtctacaagtacacaccaccacatctggcccggattctgtgaattcacatgagc

SEQ ID NO: 650 - DNA, 60595 bp, Human
cccttccttccttaatgtatgtcaaaatcaattccagatgaatcaaagatataagcctttaaaaattaagccattaaaagaacttggaggaacacttatgcaagaagatttaagcatcttaatgcagaaatggtttttctaagcaagtcaaaaataaaagactgatatatttgaatacatcagagctaatactttcttcacatatataccctcaaaacaaacaaagacaaaagataacaaactggggaaaaataattgttacacttcatgaaggcctagattttattataaataaagtgttttacaaacaaataatgaaaatactaataactcaaaagaaaaataaagaccacaaacaagcaaaccacagaaaaaaatacacaaatggctttaaagaaatgggatatacaatttccaggatatcaaatgaaagaaatgtaaatttaataaaacaccatgtttttatctttgaagttggcagaaatgacaaagtttgacaatatttagtgttagccaatatgtagggaaaatcacactggtatattcatatagtgggagtgaaattttcatttttttaaagtaagcctcatggatcagctggtctttaagagtggtccagcattttatgtcagtgtggaggacaacttggcaacagctatcagaattttcagtgcacatagtctttagccagcaactctattctaagattttattctacagataagaaagcacaacaaagatgtgtatgagatattcatgcaaaagatcaaaaacaatctaaatgaccttcaacggtagactgatgaaataaggtttggttcatatccataacagttgactacatggccactgaaaaagaaatgtgccagtgtcaaatatctctttagtatatgaaatatacactatactaagtgaaataagcaaggcacaaaaagacaaatatcacatgttctcccttataacaaatatcacatgttctcccttaaatgtgggagctaaaaaattgatcacatgaaggtagagagtggatagatggagaaaagagactggaaagggtgagttgtgggggaagaggagaagtgggttaaagggtacaaacacacactaagatggaaggaataaattcagtgttggatagtagagtacggtggctgtactcaacagaaatctattgtactcaggcaaacactctcaatatcctgacttgatcactactcattatatgcatgtaacaaaatgtcttatgtaccacataagtttgtacaaataaaaaaagaaacatgttgtaataatctcagaaaaaaaaaggaaagacaagaaatatgcaaggcatggaacagaatacattgtacaaacccatttggtgaggaagaaaagacaagttggatcaagataaacagagaggtaggtaactagacagacagaccgacggacatagctgaatatgcatggaccacttcaggaaggactcacggaaaacctctgggggaaggaaaaaggaagtcagtaggccgacttttcacaggacctttatgtattattagaaacaaatttaccatctgcacatattactttttaaattcaaaactcagtaaaattttttaaatgatctagtgtaatgcaatgtagccttcgaaaaattctctgtaataataataacaatgttagtaaaaaatagtaatatttttctatttggttaatgctttcattactaaaaggcataatattttaaatgaacaccagaatatgaaagaataactcaacaattcagaagtgaggcaggtttagtcttttaggtgggaagaagctattcaactttaaaagcctaaactttatttattaagaagtatattattttaaaaacatgggtaccaaggaaacctgggcagtctaagtttatctgtagctagagccactccctacccatccccaacaatgtattcaaattcagtgccaaaagttacttattaaacacaagagatattatgtccgggggaaaactgttgtaaactttgcctgtaggaggactgatctcttaatgaaatacagaaaaaccatctcagaaaaaggaaaatgggcaatcgtcatgtaagtactcattgcctttgggaattggttttaattttggttagcatgtggaagaatttaaactataaaatcatgactgatacttgtatactttatcactatggttaccctttaatattggttttagcaacagcataccatgcttttaaaatgcattgaggccgggtgcggtggctcacacctgtactcccagcactttgcaaggccagagtgggcggattacttgaggtcaggagtttgaggtcagcctggccaacatggtgaaacactgtctctactaaaaaaattaaaaaaaaaaaaaaagttagctaggtgtggtggaacatgcctgtagtcccagctactcaggaggctgaggcaggagaatcatttgaacctgggaggcggaggttgcaataagccgagattgcaccactgcactccagcctggactacaagagtgaaactccgtcccaaaaaaaaaaaaaaaaaaagcactggggatatattattcccttattggccaaaaatctcttaagaggggctaaagagaaagaagtatgtaaaataaggcagtaaatagtgccttgcagagagcaaatggttaatatgtatctgtagaatgtataactaaagctgttagtttgtagcaaatttgtataaaacttcataaactaagcccattcagagttatgtgggaaagataggttcatgttgcaaatattaatagaccaaggtaaatactcatgtaagtccacacaacttggattgcaaggtgaaaatattccattattatttctaaacatccacatatttgcaaatatccatggaatggacttaataatttacatttcttttgaaatgtttaggctcctgaatagtgtgtctataaatagttaatgactaaaaactgactaaaacactaccttttggaaccaactacacacaggacagatcagagttgaatcttgaatattttttacattgaagtatatctaaagctattccaatacaaatcttaataaggttttgtgtacctgctgtaaatttccacagcaagaatgatatatttcatgcacactatgagcagagaataaaactccaaaactttctgtaaactgttactttgtctataaggtttttccttcgctatatattcaagctgcactcagatgtttacaaacttacaaatatattcttaggaaaggcattgtttttcaaatcatctacaaatagcattttcataccagcagagattatgagccatccgttcagtgtatctttcagagaaactgaagcctatttttcaaatatttctgatagatgcagaggaccccaggaataatcaatggaccctgcattcacagcttaggaggataattttgtcttttgaaagtcaacctagggagcagctggcctttaggagtggaccagcatttttatgtatttttttttaatcctcagagccagtcgtacaccctctcagaaggcagtcaacagttgcctaaaggggactcccaaccctcgacagtcgtgcagcctctcagccacccatcacggaatggagagccagaggccccacagcctgtaagcactttattttccccccaaatcataggtatgacccctgctctgtcatggggccaatatgagcccccagtgatctgtcatgttggaccctccaccagccaccagccatcatcaggtgtgacttccaagcagggaaatctttccctgcaaaaagtttgttactgtatttacaggtaatgtaaaaatgaactcttctaggggcttagtttctgttcccaacagtgtctcattaacaactccttgaaatcaagcacatgaggctacaccaggaccactatgacatttcagaaaatagtaaaggaactcaacatgtgcacaaagaatgaatacatgtaaaaaagtaaatacaaaatctttttaaagaacaaaaaactatcccagtaatggcttaacttatttgcattagaaagttacttgaatatgtacaaacaaaactagaatgctggtggttttgaaacagctacacaaccaaaacaaatatataaattaaatgataatgttataagtcaatgctgtttaaatgtatgtcatcaacatagtgtaatagacaatgttattttgttgagattcaatagctgtgctcaacatgaaatggtcccaatggctataatgctgggtttgttttttttttttttttgagttttacttggtttttgttttggtttggtttgttttctgaatctcagcaaatctaaaatatgatgtggtatgtgacttctgagttcttttatcatatttctctattgaacctactgagacacttttgtttgtaagcctccttgtaatgccgtgggaccttctctcggcttacacacatggtgtttctattaaatctccctctgttcactcttctttcatcattagcctgcaattattgaagtatggctgtttggcatataaacaatcgtaaatacaaacacaaatgcagacatttaaatcatgagccaggacttggtcatcttgatgatctaggatgctttatattaatttttaagttattatcagcatgaaatgcaaaagactcctagaaaagtttttattcccccaagaatatgtccacagaccagggcccatagataattgacaactattattgcagagccagtagaatattggccaggaaattgcatttttcaaggtactatcatctgaaatcctaaccaatcctgaaacgaaaattacttttgtgctatcctcaattcttttgccactattaatgatttttttgaaccaaagacctagtgtttgtaactaacctatgtggagcagcagtaaccaagatactgggtcattatcatccgccaaatcacacaatgttcaaagaatttccttatcctggaggacatgtccttgtgtccagtgagctttgcaggtagagtgtacacagagagaaagatcagatcagtggaaaaatctgcttaggtttagctagatgactcttctattgtctgggttttcacaagaatcactatctagggaaaaatacagaagtgagatcaatattaagattactttaccacgggagtgtggctataggatatgtgcagaatgacagagggagggagacctagtagagccattgataaatgtggaaataatcacaaactcaaatggactcatgatttctgggaaattacttgcaaggctaatgaacaggcaatagaaaggactacagccctgctactcaaagtatggtccctggatttgtagcagcatccacattgcgtgggcacttgttaggaatgcagatgctcagcccactcagatctattgaatcatagtctgcattttaacagactcttcaagtgattttcaggcacattaaaatcttagaagcactggactatggaacgcgttgtcaaacttgcctgcattgagatcacctgaggagttctaaaagccaccgatgcctgggtcccagccctagagtctgaattaattggtctggtggttgtcctgcgcatcagggtttgtaagtgctccccaggtggctctaatgtgcagcagagtttgagaaacactggactgtagaatatggctaacctttcaagaagagctctgcacactggggacaaaggcagatggtcattgcacatgctcctaactgaaaaccgatttgtaaatgttagaacatctgttcagtggtctgccacgttgtttgtgaacatgccaagtttatgacttgcttgtgccaatatttagccaacataaatattgtctccagtggagaacagtttgggacttgtggcaggtgaacaccaggcaaggtgaacactcagatgaacgtggacaaagaacatctgaaagctgcatgacaagtggggaaatagatccagattcctgagaaaagaagacaggctctggaggcaggtgaaatatggctgagaatttgaaattaaaataagtatggtcttaaccaagggtgtgcattaaactgtgatcccaaatccagaagacccatgatcaagccctagcagaaagcagtctagatcatttcaaaagacttaaataaataaataagatccttatttatttatttatttaagatcatcttaaataaataagattaggaaatattacttttttttgagacagggtcttgctctgttgcccaggctggagtgcagtggcacaattatggctcactgcagcctcaacctccctggttcaagcaatccttttacctcagacctccaagtaggtgggactacaggcatgtgccatcatgcccagctaatttttttaaagacgggtcatcctatgttgcccaggctggtcccaaactcctgggctcaagcgatcctcccacctcagcctcccaaagttctgggattacaggtgtgagccactgcacttgacctcaggaaatctattatcccagaaagttagtccttcagaatgccactgcaaaagtgtaggaggaagtgaaaagggcctttgatgtcaaagcatgacatgcaccaatgcataccttcttcatttaaagacaagtctctgaagggtagctacattttaggtacaattatgcaatcttggccttttggatattttgtctatggtggatacaaaaaaaaaaaaaaaaccagccattgtaaggaggtggtaagaagtcggcagaggacagatacactgatagaaggaagaacatgttaaatgaaacctcaacacaagaattctagagccgcgggagtctggagccacttggtgcaggggagagaatcctgcatgtcccagcagcgtgagcccacctcccagtgctacagccacagcaacaggaaccaaaactaaaactcccagtggtgatggttttaactggaagtttaaacgagaccttctgaaatgttaatgatagtaactgacatttataaagtgcttactagactgtgagctgttttgagggtgtgaacagtgaccctggaagtttgagtccttcacgccaccaagcacttcacatgtgttacgtcatttggtcttcacaacaatcctatcagggagatactattattagtccccttttaaatatggggaaagtaaggcaaagagagtttaggtaaattgttcctagttggacagctagtaagaggtcaagcacagatttggatttaggcacaaatttttaacactatgccttgggttcaataaagcttctttttacgccaaatagaagattaacctattgggatttctgaaactgttgaactgaatcatcacctcgtcatctctttagccccttccctgagctttctccatcccctgccccccaagctggattggatgctcttccttaaggcttccatagttctctctgcataactattactccactcccatgtggttttagaaccatctgggttttttgtttttgttttgtgttttgagacaggatctcgctctatggcaaaggctggagtgcagtgtcacaatcactgctcactgcagcctcagcctctcggggttctcctacctcagcacccccatacccccaagtagctgggaccacaggcgagcatgacaacgcccagctactttttaattttttgtagagatggggggtcttcctatgttgctcaggctggtctagaactccggggctcaggaatcctccaacctcagcctcccaaagtgctgggattgattacaggtgcgagccactgtgcccaacagaaccacctgttttgtatacctgcctcacactggactgatggtttcctgaaggtagaattgtattttgttcacctatatatccccatcaccaacacaatgcctgcagcatggtagatgcttaataaaatttggataaattcatcaatgcattcattgcattttctaaataaatcttaaacaaatcagtgttttgcccagttggagttcaaattcttatatctatttacattcccagaccaattcatgcgcaaggccctggcgtctgtatatttttaaactccccaaatgattctaatgtatccaaagttgagagccacgagtctaacgtcaggtattctagtgcagtagttttcaaatgaggtctcccaggcccgcatcattggtataatccaggatcttgttaggaatgcaaattctggagccccaccccagatctacagaatcaaaaactctggagatgggatccagcaatctgcatctgaacaagccttccatgtgaaactgatatgtgctcaagtttgagaatgacagttgaagcataagcctttcccatgcccaggctggggctgtgcctcagcattgactatggggaactcccaccattcaacctacagagatgcccagatgatggcattgaaacccgggttagcaccacacctgcctcctcaggcttctcacccggaatgcagcccggagaactcccccattctgctcatttccccaccccacccagggttccctctctccctgctgccatgtaagatgtgactttgctcctccttcaccttctgccacaactgtgaagcctccccaaccatgtggaactgtgagtccatgaaacttctttcctttataaattacccagtctggggtatgtctttattagcagcttgaaaatgagctaatacagacagcaataattggatttaggaaatactctaaatccaggatgatttcattttgagatccttaactaattacatctacaaagactctctttccaaataaggtgaattctgcggctgtgagtagacatgagttgggtgagggggtgggggtgatactgttcaacctacgacactaaggaaattagattttatttccttaggccagcagtgattttaaacttcagcacattagagttccttggaaggctttcttaaatggagagttgggtccaacccccagaatgttgattcagtaaatctaaggtggagcccgagagtctgcatttctgagttccctggtgatgttggtactgctggtctaggaactacactttgagaactgctgccttaggcatagggaagcccaagtcagaatcagacaagggagtaacaacttgagtgctgcttttagctagaccatgctggaagctagtggagaagggcttggagagaaacatgactagaggcaagtcaagcacttcggaagcagtggccctggagagaaatgaagaccctctgccaccctccaccctcatcggctaaaatagcaacaatggaactggggagaaggtagatctgagtcaaacgaacataacttgctaagtggatgtgggaggtgagggaaaggaagacgacagagtgactccaggtgtcttgtctagtttgtgtgcacaggtggatggtggcacatcccagggatgtaaggcagtgacagattgaatttggtttggggatctatagagtttgagatatctttgcgaagtatgagttcacagttgtttttgtttgtttgttggacaattagtatgtgtttgatcgaaagtagcacaccacaggactcactttggcttaaataacaaagacatttaattgtcaattctaacaggagctctgaattaagctgattccagtgttggttcagcagttcagtacatcattagggacccaagctatgtctgcctttctgtcagacatactctggatgtattagcaatgtctccccacctaggtgcaagataactgtcatgtgttcaagttaatgatctctcaagatagtcacaagcaagaaggaagcagatagagggaaaaagtaccttcttccttatgtacatctcccctatcagggaggaaaatctttctgcaaagctccaagcagcagacatccctttctatctcactggccagaactggtcaaaagcccaacccaagactggcaaagaggaagaggagagccttgaatcataattcatccctgaggctgaacaaatcatcttctcagttctctctctcttctttctatgtgttggcctctttctctcctactgaaaataagctttttgttttcctcgtatgggaagcaaaaggggctggtgagagggaggcatggccatagatagttcaggcaccaagagaactccatggcctcacatagctccagattagcagcctcaaggaaaatctcttctttctctaagtatctgtaagatgtcagggaagaattccagttggcttgggtcatggacctaccctgtgaataatcatagtaagtaaggttggccttatctttatcatcaccgctttcttataactattatatttattaatatactactgctattactactaccactactgatactaatactactagatggactgaaatagaaggaggatgcaaacttgaaaatcagatagaaagggagaaaataattctctttccaaataatggggacttggatggttgtagtaggaatgaaaaggaagataaaatgttaaagataattttaaagaaataatagactaaaaattaattaattaactaaaagaattaatttttttggatccaatgcataaactcttctaccaagggaaagaataacattcattgttttgatactgattgagacagaaatttgctcaaagcaaatttagctattttaccttgtttccttttcagcaaatcagaacttgtccacatactgttgactgcatcctgctacacagcacatttgatgccatgaaggccccgctcagcccccaatattctcacttttcaattccatctgcccacttatcattgactcttgaggattccagagtacacttgctaccttttttcctgcaagtaatgaatcccatgttcatactctcattgaattggcaaaagacgacctttggcaatataagaaggaaatggatcattcttttctaatgagaaacgtgcttcatttttcataactcctgaaagcatggttcctttcacggttgagaaatatccatcatctccacacaaccactttatcctccaagttctcttttgttgatgcaatacagtggtaattggatatctggaagtttagcactcttcagaggtctccaattccccaaacaatctgtggacaacctcaaagcagacagtcattttccccaggacacaaaatcttgtttccacataatgaatgttattctgcctctactagaaactccaagttctccagcccaacacagcactcaagggcccctaagaatgagtcaacagagagatgtcacttgggcacgttgccctgccggtataggctgggatgttcacaacaatcttgatgcagacaaagaagcaggaggtgacaacaggtttctcactttgaactgatctcagctcacaccttcctcctagttaccttatctcagcactcatctttcagatttgtcatctgggtttctttgcaaaaaaattaaagaatgtaagacatcatggtccatttctattcttcccttttaagttaccacagcaatttgcccttggtgactggaggccttgctttagtcagcacctgtgtgccgtttaccaccagaggcttggccttctccacactttttaaagagacccgttgacagaatcgttacaaccattcagccagggttgtggacccttggcacattcgtccttggcactgctgacatttgggcccaggtaattatttgtgtgtgtgtgggcggggggaggggggctgtctgttctgtgcattactgaaggatgtttagcagaatcctggcctctatcactagatattccagtaatactcccctactcgtgccaactgaaaatgtctccagacattgccaattgtctcctgggagacaaaaatcgctcctggtttattgagaaccaccgcttaaatgggaaaacaaggctccagggcagatgtcctcagaatgtctttatgtcactggatctccaccagaaatcaccattcctgcccttctggcccaggcatgtccctacactgatttcttctcttataacagagaaaagtcagcttctcctgaagattgacccttatcctcctgttgatgacagcagcagccaagaggcagcagtttttctcaaaactgttagcccatgagtaacaacttcttcttttttaaaaattctttatttctgtaggttttgggggaacaggtggtatttggttacatgagtaagttcttcagtggtcatttgtgagattttggtgcacccatcacccgagcagtatacactgaaccctatttgtagttttttattccttaccctctcccacccttttccccaagtcccaaaaatccattgtatcattcttatgcctttccgtcctcatagcttagctcccacttatgagtgagaacatatgatgtttggttttctgttcctgagttacttcacttagaatagtattctccgatcccatccaggttgctgcaaatgccattaattcattcctttttatggatgagtagtagtctattgtatatatataccacagcttctttatccactcattgattgatgggcatttgggttggttccacacttttacaatcgcaaattgtgctgctattaatatgcatgtgcaagtatctttttcatataatgactccttttcctctaggtagatacccagtagtgagattgctggatcaaatagtagttcttataccagagtgagaagggtttcactgcagaaaccctcagtaaaaaggctgctgggctgctggatttcctgcctagatgagcagtgctcccctggaaagacacaggctggaaccttcaggagctgattggctcacctctcctctgtttgggtgtagcccccaaaaaggctaccccacttggactccctataccacagctcagtgcatggcaggatgcccacattgtttacactcctgaggataccatcagtaccttcaggtacaatggtgcccaccagtttaaggcacaacatattgaagggccttcaagtcaggtctcctaactcctacccagccctgcagtcacctttgataagtaaatatcacatcaacacgtgtaacccagatggcatagcctaaggaagcttgtctttctggaaaatgacctaactataccaatcttcattaaaaggtgctgaaatgccaacatggaagcaatcccaaatgtaatagaaaggtcatgttttaatctaaagaactgaactcatttttcagaacatacagtcaacatatgcaagcaaatcatgttgagctgtgatccaaatggatgtttttctagttttagttttagttgttaaatgatacaaatatttctgcccctttagagtgatagccaaacacttagtcatcatgtaagtcactgtaatactgcatcttggaaaggaggtatcaacagcaatgaacaactctgtaacattccagcaccctactaaggtgggcagagctcaagtttcctaacacactttcccaacagctctctgatcaacccctgcagattaataaacttctaatgtgggaagaggttctaggcatgaaggaattggcttgcttttagtcggtgtgagatcctggagaatcctaatgaaaacagcaataactacatgatgaaataccaaatattcgtattcaaactgtgcttaaatatacccaacagggtatactgccaaatatatttttttctgttgggtagttttacgacttaatgaaaccaatatgtcactaatcacccaagattcatgcttcagatgtgaatggcccctctattttgtttcaaattgctcatcaatctctactaaccatgtctgtggaaatgtcaccaggatattttctggctctgaattcatgaatgttaaaagtacaataatttgcattcatactaactggcttcaaagtgcaaatgagtaaccggttagaggtaaaagaacattgttctgagagagataggagatggatgtttccataaggtgaccctgagcaggtgacttaacaaccaggcttcagtttctttatttgtaaatgatgggattggatacattcaatgtctcccaaacttcagatttaagtacaaccttcatgattgttgccaaatatatgggttacctcttctactaattattctattaattatttttaaatacgcactttttaatataaattaatcttaaaaggaaattttatactgataccataaatggaaaattaatgtcagttgacataaatatagataactaaatgaaagcaaaaagaatgtattaaattctaactaaatttgatgttgccagctgaagggtaaggtcctatcctctgactaaaaaaggacctgtttacatggtccacatgggatacagtgggagtccacaaagtaaataatgaggctttgtgggccacagaacctctggtgcaagtaggtaactactctgccattgtagcgtgaaagaagccataggccaaatgtaaatgaatgggttggctgtgttccaataaaactttatttacaaaaataagtaatgggccagatatggtcctcagtctgcagtttgccaacccctggattagacgagtgtgaaagatccactatcactaagcaaagacttaatcagaagagttgggagagaattttaaaaggagttcctttcctagctggaggtccaatggctttaatgctttcagtgttccatgtcacccatttggaaaaacctgggttcaattttcactttaagatttcatgctaaacctcttccctttatctttagcatcttggataaggtcaaggatttctttcttgtgtaaaccttcagcacatttctaagttgtcttcctcctttaccgggatatcaacagcggaagtttctaatttttctcagactaacggttctcaaccctggctgcttgttagaattgtctggggagttttagaaatatttatacctgatatatccctgtacctcagagattctgatttcataggatcagactgggatcccaaatgattttgagtgcaatccgggttgaaaggctactaatctatatcttggcaaggtcactttcctcagagtccattattttctccatttggtattaaattctaagagccccaaactctatttagctcaaactgtttcacacccgaaggtcttaggacttcactttcatttgtgattcctgttatttctccaactgaggtctgattgagccctcccagacaccttggttaaatttactgttcctcttttcattctctctgcttcatcattttggaaagcttgacactattctcagctcaagatttctatccagataagtttcctgttccattcttctgtccctactactgccactgactctgacattaatacaaactgggagcaagaccaggacgcaaagaaaaggcattcagtgtattctgtaacatacaaaggaagaagattcttcctcccatggaaaagaagataacatttaccaagtacctacaatgtgtcaagcattgtgctaggtgctggggatatgagagtgaacatgacataacctagcctccaaaagtcttacagtctagggaaggaaatagactaataaaaaagtatgataatgtatctgttaaaagatctgatagaagactctagagtggagggtagaacaaaagagtcagtggtgtgctagaatatgtctcaccaccagctctccaggagaaaacaaaagcctaatttgtggtgcttgccaatttccgtggtgtaaatactttcactgtgactgatttcaggttaccagcatgatctcgccaagcagagttgggaggagatcacacaatttgttcttgccagcttgcaaagtcagctccagctagcagggccaaccatcctggtttacctggaactgtcccagttttagcacttaaagacccacattccagggaacccctatgtcctgggcaatcaaacagtttagcttcagcacaccactggaagaattcgattcttcccaagaggatcaggaatggtttcagaaaggggaggcttcagcttatttgcttaagtagaaacattctccactgttgccaatggaatcaatggctctgtgctgtcaatctcaagtttctttggtcctccgaggactcaggaagttgcagggaggaatccacttgcagcattccccctttttcctccccctgcctcccactgatgggccccttgggaatcaaacaactcagcaatccatttgcatagattctgtcaagcagggagaagtgatattttacctataaatatatttggcaatttatccagctggaaagcaggcacccatcagaagaaagcatattggaaaccttggccatcccactggcttcgtgtcttttcagtcttcaaaatgtgtctgctaaaattcagccccctcgtacactgtagtcttttagctatgatccctcctctacttgaagggaaagatactttaggaaagggagaactggaagattgggtgtgaaatgaggagggaaggagaaggaagaagcttcctaacagcctttgaagggcagaagggccacttcctcccctgccagccctgagtcatcataatgaaacctccctgtccagcgctgtgacattgtcttatttaatcttcctgagattcttcagggtgggcaggtattagtcccattttacaaatgagaggcagaaaacatgattctattagcatcagaaggaatattgggagcagaatttgacaatagtgcctctcctacatacacactttgctcactgggagatggctgtctgttttgccttgcaaatagcagtgacttcatttttcattttactttctattttctcatcatcgagaatatttattgatcctacagctatgcaaggggttcttggcttctctggtcaccggacaagtctcaggtctcatttagtgtttctgtaaaagactatcattctaagagttgaactgagcttttctttctttctttctttctttctttctttcttttcttttctttctttttctttctttctttttgagacagggtctcactctgtcacccaggctggagtgtagtagtgcaaccacggctcactgcaacctcaacttcctggcctcaagtgattctcctgcttcagcctcagcctcccaagtagctgggactactggcacacaccaccatgccaagctaaatgtttaaaattttttgtagagacagggtctcattatgttgcccaggctggtcttgaactcctggtctcaagcaatcctcccaccttggcctcccaaagtgctggaattactggcatgagccaccctacctggcccagcttttctattattaaattaaaaataataactattatttagacaataaccccaaaaacccattaatgagaagtcaatagtagagtttctgaatccagactgcatgggtttgaatccctatctcatcatacttgtgtgtcttggtttttctcatctgcaaaataggaggtaataatacctaccccatagggttgttgggagaattaaatgagttgctatttgtaaacggtctggacccatgcccggcacatatgaagtgctccatattttgctgtcattctcaattttgagttttcctcctatacatctctcttagaactttagcccctgctactctttttctatgagtacaaagtgatttctaatttaggacaagcttttgtaaacagtcattttgagcttcctatagtaaacttccaattttaaaggcactacacaaagcaccatgcaaagggctcactcaacactcagcaggaatcaggtcaagatggaagaaaggaataaaaataacactcagcactcaccacgtgttgaatatcctgccaagcgctcttgatacatattctcctaacaacccatacgaggtgggtactattattaccatctttcagatgggaaaacagccttggaaaagatacggaggaaaaaacagcctcgtgcctggttcaaaggtagatgtctgtgagagaggaggcagaacttatgtgacctcaaagaagaaccttccccaaactggactcagtttccttaaatctgtagtattcttaagatctatacaaggcaagtttacaatggaatattattcagcctcaaaaaagaaggaaattctgccatttgtgacaacttgaacaaacctggggaacattatgctaagtgaagtaagggagaaaaataaatactgcatgattctacttacatgaggtacctaaaatagtcaaactcatagaagtaaagaatagaactgtacttaccagggaccagagggaggggaaatgaagcactgttcaactggtacaaagttttggttacgcaagatgaattcgttctagagatctggagtacagcaaactgtaccctatactttattacacacttaaaaaattgttaaggtcaattgttaaggtcaagtgcagtggctcatgcctgtaatcctaatacttatggaggccaagactgaaggatcacatgaggcgggaggattgcttgagcccaggagttcaagaccagcctgggcaacatagtgagtccctcttgctacaaaaatttttaaatataaagtattatttgtttaatgggttgatgtcaagttaaatgttcttaactcacacacacacacacacacacacacacacacacacacacacggggacacaggaaacgttcatagctgatgaaatacttattaccttgatggtggtgatgatattatgagtgtatgcctatgtccaaattcaccaaattgtataattaaatatacaatatattttacagcaattatacctcagtaaagatgtttaaaatatttttcaggaattttgaaaaaaaaactatacaaggcaagcttaatcagaatcaccaatattggcgcaaggtgccattaaccaacagtggcaatggtaacagcctaaaccgaggagaatcaggtgtgtctgaggctctctccagcacacccttcacctgcctccattttgctcctgcttaacaagcccaggcaaaactacctggttctaatcttggccctggtatttaatctcatttcatgccagctcaaacagcagttctctgtagatcagtgtacagttagccctctgccctctgctccctggctcttcccgggcgcccctcctggctcacagcccagatactaagcaaccattgtcaaatgtttactgagcagagtgcagccagccaaggcttctgaggaactgcactggaaatattaaacagtccaaatgccactcccattgcattttgataatactttcagagtttacaaatgacccttacatcctatgtcacccagcatcccacctcctacgtgccaccacctgagtgcttaccgtaatccagcaccgtgctactacatcccaaacacgaatgcatctacaccgcacaccaccccatgcacaggtgcatctccactttaaagatgagacaactaaggctcagagacgtgaatcagcttgcccaaggtggtacaaccagcaaagggcaaaacagcaattgaacagagtaggtctgactcccaagtccacactatgtggactattatgtcatgattagatgcaatcatgttagcacattgataggtcatagtaagcacgcaagtacacagactcccaaagcatcaggctgtggtctctccctggcatgtctttcttctacctcccctctctcttttatttaattgcttgtctaattcctaccgccctttgagaaccagcacaaatgtcaactcctccttaaaaattcctttctcctctcagctatttgtacccaaaagtgcttactgtatcataatgcaattgtcatgtgtcatttacatgtttatttccctgggaacagggactatgcttcataaatcatggagtcaacttcaactggggtagtgcttaacatacaatagattttcagtacttgtttgttcaaggaagataagggaggaaaaataaggagaagaaagaagaagaaaaagagaaagagaaagagagggaaaaataattcagagtctaatttgcctgtaacatatttcttaattaattcacatgcctctcatgaaacaatctattcttattgtccagccttgaagctattcaagtagaaaatcaggacacaaggactgacaagtatgaatgtacttaagtgagtgtatttctggctgtgttctggaagatgctggttactatataatacttagagcaaccaatttgcaaatcatatccctcagcaaactccttcacacattccatccccagagtttgctgcaacctggaagatgttcctagaatgttccatttctattataagagttaagacttccttgaattggactgggacagaaggcatttgatcaggcgtctgtttttccattctggttcttctggctgagggtatcagaatcttgattcaaaagagctgacctccctcctgggcaatctgctctgttgcagcaggaacatccctgagtcatttctcaacgtaggtgttttctgcattctttctgccaaggtgacaccgcttcctaggatcagagcatctcgtttattttctatgcttcctcctttgagaaaaatggatcattcatgtccttgttttagaggaggaaacacaggaacgtaaatacacagagaaggacatgtagacctactagaaggaagaaaaaaccaaagtggaagtccccccagcaccagtgctgccttgttcatgcaccaggcagtgcctttcatagagctgacagcacttgcttccattttggacctgaggtccaggcatgatggccagcacctcaacagaaaggtatcccagggagagtctcacaccccatgaggtgtgaattttcacactcgtcaaatgagacagttaacaaggtgtgatgttgggacatcatgccaggccacctggactccgcagtgtgactgcccggtgtaaaatatatgtctggaacttcagatccaagctgcaggtgaccaatgagaaattgatctttagagtgccatttacaaggtgaaaactcctcaagcaggaaaggggtttgaaatattctggaaagtttattgctgatttgccttcaacaaatatcaatagtttgcatttacaaagtccatgctgtcagccaggcttgttttagatgcttggcatgaataactttaattcctccaggaaccttacgtggtaggaactattattatccccatttaccatagttagtttctaagtgagatccgaaaaaagtcggtggggtggcgggcagctggaaaaacactcgaggaatcgcagggagtttcaacatggctttactctttctctgggcgcaagcgagcctgggtgcgagtctgggcgtgagccccaagccagaggtacagcgttagcagcgtaattgtaccttttacagacaacagtggctccaagccaagcacgagcgcatctgagtggttacttaatgcgcctcacgtggcgtggttacgtaaggtgtggacttgtgcatctgcactccaaacctgctgagacacgccccgtcagaaagtcgcctcggcctactccctactagagtgcagccatctcccttacaaccatgaagaaagtacagcacagagaggttctctaacttgcccgaagtcacacggctaataagcagttgtgctgggactcaaattcactctgacaataaagccacattcttcaactttactattatattttcagtggccacctattataaatatgatgttgcttgggcattataagataaatatttgacaagtatggaagatatctatccatctgggatcaacatatgtgaattagaaacctatatatctacatatggtacatatgtttgtgtatgtatcttcatatacataccttccaaacctgttaaatctaaatatgtagaattgaaatctgcttggatatcacttttatgaaatcttatcacaaggcaaaaagccaagaaatgacccaaagagacaggggaaggactaacatttatctagctccctgttttctggcatttgaaaagttatttcacgtaaacctcaagccttgcaacacagagactgctcccattttacagatgaggaaatggtagcttagaggttaatggcccaagttcacacagctgctaagaggcagatcctcattcaaaccaggattcctgtgggctcaaagcgcagacctccaaaatcattattattgacgtttaatatcttgtgctgtttttatctgtctcctgagtgtcagtgcaagcactgtcaaaaaataaacaaattgaaagaaaacaaaacaaggaatgttgccctggctctacaatgtctcctagttgaaaacaaatggaatatccgtgtggtctcctaaagcctcacaagcttgtcagaccccatcctggagtaccccgcagcccattctgtatctgacttgcattctcactgtatgcagaagttctgctcagttgcttcaggtttcaaaaactaaatctctggatagggaaacaggcctgaggcccatcgtcagctgtctatcctattaacaatgaacaatggacgtggaatgtccgctccatctacattcccgagaagaagttcggtacccagctcctgggaacaagccataggacacccgttccatcagcactgagcatcgctgatgaatacagccattgtggaggcagcccccaccacaatgaggggacaacgccaaaccgactgtttttctttttcttttaaaatcacatcacatgattctttcacttcgacatcaaatatcctgctgttacaaggaacaagcctgaattatcttctcaagcagattaggaaagataaccaacgtggctaacagtggttcctacagggagtcaggccactgggacctcaacctgccctgctgatggtggcgcctctgatagagagtcctaccccacattatttgttaaggtggctcacgcctgtaatcctagcatgttgggaggccgaggtgggtggatcgcttgagctcaggagtttgagaccagcctgggcaacgggtgagaccccatctctaccaaaaatacaaaaattagccaggcgtggtggcacatgcctgtaatcccagctacttgggtggctgaggcaggagaatcgcttgaacccgggaggcagaggctgcagggaaccgaaactgcaacactacactctaccttgggcaacagagtgagaccctgtctcaaaaaatttttttgaaaaaggaaaaaaggaaaaattaagtcccaatattatcttcattcatagcacatgactcaacactctcctgctgcacctcccagatatcagagttacttgggatcaaatgacacttatttactaggttttttggtcttgggcatgttgagagcattcttttgtctcacccctcagctcctacaactctgtgatatttgtatcatggaatggcctccctaaaacgggaaggggatgaggggcaggcatgtcatttagatctgtcagaatcagaaaatctggttctagccttggctcccactcaaccgctgcctggccaggtgatcttagacaagtctccacacggtctctgcaagccctcacagcttctttgtgcaaatgagaaaaaggtgacccttgaggggaagcagtcctgccagcaccaggcttggcaagcatgcccccagctcagttctgccccagcccctcagccagggcctcaggcagggcataacccacacagccatttgcagagccctgcatctctgtttcagcgcattagttgtcaagtgggacagatcatgtgtcccacaaaattctctgcactgatgaggctaacaggacatagagaacagctcatgaattagccgagtgataggagatttctgttgccctgattcaattctacctcacttcctgggcactccataatacttcggatgaaaagcaaagaagccattactatttcgaagttgccacttccacacttagaggaccagctccttcagaatttgatcaaaagtagggtggcctttataagtgtgcagcctctgcaactgcatagggccccatgctcagaagggccctgtgcttggcttaatactctgatgttaccatattgaaattcttggtaatttttgaggaaggagccctgcactttcattttgtactaagcccagcaaattatgtagctggtcctgccaacaagcctacaaaagcaccaaatagctttcttacatctcacaaaagatttggataaggaaaacaggaggtatcattctgcaactccagagtcatccgacccctctgttggatgatggaagctctagttatagaatgtgaggcagtattgtgcgctgcacagagcacaggctttaggaggcaaattgagctgggttcagtcctgcatcctgccagacctcaaacaaattatctaacctgcctgaacccaggtttccttacctggaaggcagactagtaatgcccactcttccctatgcataatgaagaaaggtctataaactgcctggcacacagcaggtgtacaacaatgtcagtcccctttctggcttgtttcaggaacagatgctgcgagatggggcatgccctcatgttccaaaaggcagggaggttataggtggccctgatgttcctttcggctctaggagtctatgattctccattaactaaagcctcaagccaactcaccttcagcccacagatgttagccaggacactttggatcgcaaggatggaaacccaactcatattaacttagaccaaggaagtttgctagctaatgaaacggggaagcccaaggacacaggcgctgctgtgtctgaggatttgtacaatgtgattctttctctctctccctttatgtagtggacaaaatgggcactaagagccctagactcacgcactttcactgtagcagactcagcaggaggcagacgtgtatctctctcagtatctatgtatccaccaagggaaagactctaattgactctaatcctgcttggattacatcttcactcctgaaccaatcctgattgccagagtcacaggacacgtgcctacattggtgaccaagggcaggacaaaggggctcaagcctcatgactgacagccccagtgaggccacacaatgggggaaggggaaataaggagaataaggatgccatgcagagaaaggcaacatacccactgagctgcatgtggttgactgttcacttccactgggtgccaaaggatatgaaagcagggagagttgaactgcggtgctactgccagtagcacttaaaccagccttcactgaaggatggaaaatatatggacatgccgggcgccgtggctcacacctgtaatcccagcactttgggaggccaaggcaggcagattgcctgagctcaggagttcaagaccagcctgggaaacatggcaaaaccccatctctactaaaaatacaaaaaattagccaggcatggtggcgtgcacctataatcccagctatggggaggctgaggcatgaaaatcacttgaacccaggaggtggaggttgtagtgagctgagatcgcaccacttcactccagcctggttgacagagagagactgtgtctcaaaaaagaaaagaaaatatatggacacatatcacttaggaaaagctccatgagaaaaggcaaagacaggaaactcagggtgtgttcctagctaccagctgcataactacaattaacctcacaggttaattgcagtttttaatagttatgtgtttatatttatggttaccttccatttatgcaagcaatactgggtttccatttttgtgctcacaaaaatttcctttttaagataactttaagtaaaaacaaatgtcaatttaaaagaaaataataagcaaataataattataagcaaacaataatttccttattatttagacataggtaactgtggatgcaatagtgcatgtattgtgccaatgactgaagtatgggaaacagctcaatacactatataaacaggactttaccttcccaaggagcactaaaaccaaaactgtgcttttactggttcctacagtatctccaacaaaccaaatatgtatctctcattgtatggatggcaaagatccaagtcaccatatgaacctgtaataaggtcctagaaccctcagcctctgacctattccttagacatagctgtgtctcatgacaaagggggagaacaagcactccagtacaatggcttacagtattattctttgtttcagaggcagacacacaaaggtggggttgatatgaaaatctctcattgcagagctggccaggatgattgtccttgagaacagaggggcccattctcctggtcatccaaggccagctggccccaaggagtaccagccacctctctggggccagagtctccccagctgatttccgcatgtaccagtgtgtgaagtgacagctggtccctggttaggatgactatttggtcctccagtttgctaccgattttagccagagatcatttaggaatgcgtatattgtcatctcaccttttcaattattttctccaggctaaagcgagcagtcctcagggttttgatgtggatcgagatgccaaaaagctgaacaaagcctgcaaaggaatgggtatgagagatattttgttgctaatttgcttctgaagttgattaaacttggtctcatgtccaacttccccatgatgttaggaagctgacatctcactatcttgtgtattccgagctaacgcaagtcaatcacttccactaacctctttattaaagttcgcaaaattacagtaggatcctattacttttcaggattctatataacagctaggagttggatattgtgacgtttaatttgaacttgaggtgagagaaacttcatgagaagtgcagttcatgcaatcctggtgtattagtctgttctcacactgctaataaagacatacccgaggtggggtaatttataaagaaaaagagtttaatggactcacagttccacatggctgaggaggcctcacaagcatggcagaagacaaaggaagagcagagggacttcttatatggcagcaggaaagagagaatgagaaccaagtgaaaggagtttccccttataaaatcatctgatctcgtgagactcattcactaccgtgagaacggtatgggggaaactgcccctgtgagtcaattatctcccaccaagtccctcccacaacatgtgggaattatgggagctatgattcaagatgagatttgggtgaggacacagccaaaccagccaaacctggtatgatctaaacccctctgatcccttccctaggagatggtggggaattgagtctgatgagagccggattagggacctggaagcagcatgtagaagtagatcggccgggcacagtggctcacgcctgtaatcccaatactttgggaggccgaagcaggcggatcacgaggtcaagagatggaaaccatcctggccaacatggtgaaaccccatctccactaaaaatacaaaaattagctgagggtattggcatgtgccggtaatcctagctactcaggaggctgaagcaggagaatcgcttgaaccagggagtcggaggttgcagtgagccgagattgcgccactacactccagcctgggtgacagagagagactccatctcaaaaaaaaaaaaaagaaaaaagaactaaatcaagtgagtaactggccaagatcaaccatcaagggttgaaaatggagaagctgtttacatcctaagggtcagtgcatggccaagagtgggggactctgcaggaagtcaaaacaaaggtagaccagggaccagggtgggatgagggagacagcatctaggtctagggccatgaagagaggccctgggatccaaggaagccactcatgacacaaggtctagtcccagaagcctggaagagggtgacatccaaagcacagatggaaggatttcccttgaacaggacagggagggaaggtactgagactgacagctggagtagatgccttcataggtgttgttggggcagaaattgaaggcatccatgcctggtaacctgacattgctcagtgagtggtaggtgaggttgtctgctaaagagaagggtttgacaatggagtatggggcttgagtggtggcttgaaatagcccttgagtagcagagaagggggagacgaccaacagaagactgctgatacacactaagggccccactgagtagggagatcatggtttctcatggctccagcccacatggttgtgtgattttcccctgtatccttggaggtaggacgggaaaaattgattgactctgggcttgctgatcaggagttccagaacaacaagcaagtgaaatcattgaaggagacagaggggtcaaggggcaaagtggattaatttcctagattttcttttttacatttattgagaaacggttaaactttcaggcattggactaagcactttatatacaaaatctcatcaagttcttacaaaaatccattttccagctgaggaaactgatgacctgacattttaagtaagacagccaaagtcaccaagccagtaagtggggaacactgtgattgaacatattcttgtcactcactccaaatgccaccaatttagagacatcctagctagggcacctcagccacatggctgcagtcctggagggggtggggacagactgagaagacattgctcagtgtcattaacaataggtaggagccatgtcagtccacagaatgttttattaaactaattttttgcttatcgagatataatttgcataccataaaattcacccttttgcagcatgcagttcagagttttagtatattcacaggattttgcgaccatctccacttattccagaacatttcatcaccccagaaagaaacctcacacccattagcagccccttcctcccttcacctccaggcaatcactaatcagctttctgtctccacagatttgcttattctggacatttcacataaatagaatcatatgatatgtggcttcttttacttggcataatgttttacaaaaacaagtgataggttttttacatagaagtggattagtagagatttactttcctagaatgggtgtcatggtagaataaatatggccacaaattttttgtatggctccagaggaataaaacttggatccatggtagaagttccaaggaaacatattttgctttaatataagaaacttggctgggcgcagtggctcacacctgtaatctcagcactttgggaggccaaggcaggtggatcacctgaggtcaggagtttgagaccagcctggccaacatggtgaaaccccgtctctactaaaaatataaaaattggccgggtgtggtggtgcacacccgtagtcccagctactcgggaggctgaggcaggagaatcgcttcaacctgggaggtggagattgcagttgagctgagatggcaccactgcactccagcctgggtgacaaagagagacaccatctcaaatatatacacacatacatatatgaaacttatctagccatagaatggtagccttgcccaagaaatattgagaagtctgcaggagttgggattgggaagatctggtaggaaagtagtacaagctatggctacatattaaaacccatttatgcctagtgttccattattgggacactaagcatgtgggagttatttatatcctactgctcaaggtcattgccaaggtctgattgcaaaaattcaaaaaactgcaacctcaggcatcaatgcgttaagaattcttgaataaatcagagctagagaatggggggaggaagacagagaaggagggaggaaaagaaagaagatagggagagagaagagaaagagagaagagagagggagggagagagtgaaggagagaaagaagagaaggaggaagagagagaaagaagaaagaagagagaggaagagagggagggagggagagtgaatgtgcaacctgtgttctcatctacaaaatgaggataacaatgtctcctcacatggagagggataaagcaggcaacgcagagcccagcacctcattggccctcgttgcatgtggatcgcctcctttggaacaatgtgctgggatccaaaatctgcacaaagccagtgagatcggtatgagcattgagtaggcgcgcccttgttctccatcactcagggtgaactgggttgaatgggggctccccaaaaatatatccccccagaacccgtgaacatgactgtttggaaaaagcgtctttgcagatataattaagttaaagatcctgagatgtgattatcctggattacctgggtgagccctatatctaatgacaagtgtccttaggagagacagagacacacagagaaggccatgggcagatggagacagagactagagagatatggccagaaacccaagaatgctaagggttcccggcagaagccaggaggggcaaggaacagacactgccccggggctgctggagggactgtgggcctgccgacaccaggatttcagacttccaccctccagagctgtgcaggaatagactgctgttgttttaagctatcaagtttgtggtcattgaatcagcagcctcccctccggaaactgagacagtgaacaagtgggaagcagtgacttgctcaggcaggcaggactgtgcccattcattacttcatctgtcttccttgcactcccatttccaaaggagaaatgagggactgcgcggcccagcagtgctagcagaagagagtgacccttaagcaccagagcgggggctgcagcctcctgggcccagccaggcaggctgggctggcattggagcccaagggaaagctgagcctccaccacagccccgatcactgttctgccacaagggcctgggggcttcccaccctgtctggagcccccttcctgctgaaatgtgactcggtatcttcccagaaaatttctcggaaaagcaaaaccaaggaggcccggaggcacttcctgaggctgattattgccccgtctttgacctctgctgtgaaattacagtgtccagtgtgtggctccttcttttctcatttttaaaaaagcctttcccagaaccactggggactggccctggtgcctcaaaccattgtaagtatttacaggaaatcattcagcggcactgcttatacgatacacatattgtgaaatgtaaagtgaggtcactgttcagtgactgggtagtagaaacaccccccggatcaacctgagacctggactcaaagaacttgggggaaatccagtgttgttttcatagcctcccccgacgtccaggttgttgctgggccgtctcaggactgttttgcaatctggtttctcgcccttttttttcttttttagctttaaaatttcatagatttttattaggttttttattattattattatactttaagttctgggatacatgtgtagaaggttcaggtttgctacataggtatacatatgccatggtggtttgctacacccatcaacccgttatctacattaggtatttctcctaatgctatccctccccttgcccctgaccccctgacaggccctggtgtgtgatgttcccctccctgtgtccatgtgttctcattgttcaactctcacttatgagtgagaacatgcagtgtttgcttttctgttcctgtgttagtttgctgagaataatgatttccagcttcatccatgtccctgcaaaggacatgaactcattcttttttatggctgcatagtattccatggtgtatatgtgccacattttctttatccagtctatcattgatgggcatttgggttggtctctttttttttaaagcattcccaaaaagaacatctaaagatcactattattttcaatattaatttcattttcctgattatccagttgtggactccatgtggcatcagagtatggaggatttctattggtccttgctacacagacccatctgaatatcacatacaacttaaaccacttcagagacaaggttctgtcgtgatgacatgcaaacttcctcattcatccattcattcattcattcacccatcaattcattcattcatctgtgcacatgtttaagcatccgttcattcagcaagtcatctgataaatactgacagccttctgtgggaataccatggtgaacaaaatactctgctcccgtggaatttgccatgtgtcctggcagaaacaggaagagcaggcagcatgagagacacagagggcgagatgcctcatctgtccaggagtgtgcagggagctgagacctgaaggagaagtaggagtggaggtgaggattggtgtgttccagatgaggggaacagcccatgcaaagacccagaggcaagaaagaaagtgttgtttgttctaggagctgcaaatcatctacaaagtgggtggaaagtagcctgggagaggacaggtaggaggatgagactttgagaggccaaaaggccccataggcccccctgcagagttgaagcctcattctgcatttgagagggcctatactgaaaggtttgaagcagaggggtgagcaggccaatctgcacttcagaacggttgttctgggggcagtgaatgccaattggaaaaagtgagagcaacagaggaacttgcatgtgggtggtatccatagttctgctgagcgatggggtggagatgaggatggagagaaatgggtgcatctgagaggcactaaggaggtggaatggagaggccttagtctgattgaatgtggggtgagggaaaggggacagccaggcctgagccccagcttcctggctggcccagtacagtgagtgggtctcctgcacgcagaaaggctccttccgggcttggcacctgccaggatccaggcctgagaggccaaggccctcgtctgggacaggagtggcctgaatggaaagaaagaggtaggctcaagagatatttacaagaaaaagaaatcccttttgaagtgagatttctgacactccgaagtttttttttaaaaatcataatagtgtcatagaatgagtaattggattcccacgatggaggcgaagctccgggaggaaatgaaggaggacaacgtgaatcccagtgttgaaaccaagccagcaccaggcaggcaactcactcctgctatttttgcaagtgagatcctcctagaattctgtttctccaattgaaaccaaacagctaaatgttcccagagctgtagaggtgaaaatactctttgaggttaagtgaacggttcaaggacccaaaggtttggaacatggttgtcacatcagacccctgctcaggcctgtctttccaagtcgcctctctgtctttccaaagctgactctgagggctggtgctggagcagaaggagggttaaacagctcacatttttttgccagggctcccttttttttctctaccccatctccagctagtttccctccattcatttcccatccccatggcctagatttttcctactctcaacccttccatcaaaatgcattgcacgatcttgttccttcaggatcctgatggctcagctgggtggcagccatcatctaggtccacacaccaaccagagcaagacagcagtaagtgacactgtaacagcacacactgccatgtagtggccactccctagagcccaggtgtcgggctcagaatgtcactactgcagtcttggataatcactgcagtgatcctagaaacatacatgtaaatagtgtgctgtgccaaaacagaggaagcagaaacttaacaagtgtggctgagattaggtgagtaagccttgggctgctctgtgcagagatggatctagaagagtagcatgacaccaaactgcgggaagtctcgatgccaccataagggattctgatgtaattctaggagtcaagaggaatcactaaaggtatttaaagtatggtgtgaagtgaacacatgcgagcttcccagggtggactgcagagatcagagcctggtatcggggtgaaggctaaaaacacttaggacctgttaggcagtgacagaaggaatgaagaagaggaacaggtaaaagagttgtctcataggtgagacaggcaggacttggtagtatttgagagtaaaaaagactggtgggccctcaaaggtgactttggattttctctaatccgtgtgatgccatgcactgagacaaaggaacaggatgaggagtggatttaaggatagacaaaatgagtttggtttaagctacaatggaagttgaaatgccttgggagatccgtgggaagttgactacaggcagctggaaataagatctgaactcagaggagagattagggctagaggcgctgatcctggagtcatcagtcaaagggcgaaagtcgcctgggaaaggagtgactccaatagagaggagaactgaaaatcgagtttaaaaggccagtggaagaatacaggccaatcaagaaccctgagagggaggtgatggagaggagaaaggaaagactgggaaaggaggtacaaagccatctaggaaggtgtttcacgcaaagaattgtcaaccgcaggccgggtgcggtggctcatgcctgtcatcctagcactttaagaggctgaggcaggtggatcacctgaggccaggagtttgagaccagcctgaccaacatggtgaaaccccatctctactaaaaatacaaaaattagttgggcatggtggtgggtgcctgtaatcccagctactcgggaggctgaggcaggagaattgtttgaacccaggaggtggaggttgcagtgatcatgccactgcgctctagcctgggtgacatagccagaccctgtctcaaaaaaaaaaaataattcccgactgcagaattcaaatgctgcagaacagtcaggtacatgcaggaaccgagaagaggtgctgcattgtgcctcagcttcctcttctgtaaagaagagcttggactagatagtctctaacatttcctccagctccagagattgctgactgctgtgccttgatcccaccgagctcgatcactggggtgagcagttcatggagggtggtccctgtgcacaccctgcatggatgtgaggcagtgccaggcgcgtggtcatttacatcccctggtgtcccgggtttcccacgtgcgtgcttaggaccagcgcggactggacccacacttggattctcgcatttcattctcacaatagccttgtatactattaccctcatcttagaggtgggaaaactgagacttggcaagaaaaatcacttgcccaatgtcatgcagtcggtacagggtggagctgtgatttgagtccaacctgaataaatctaatgtggggtttgatggtaaaaccgtctttcttattcgcacactggaaatacctgtgtcatctttccgatcctggttcctggttcaaacaaggacattctccccttctttcttattcactatagttttcagtactgatcaaattgctgccatgagcttgtattactttgagcatcaggggtaaaaaagcttctaaaaataacataatctaaaggtaataggagttaaaaggggcaacctcccttcatggtttcaatcaagacttctctcctgagattaacaaatgtatgggtggggttaatattgtaacagtttcagcctatatcctaatcttgttcatgcaattgtaagcacccagaggccaaggaacaggccatctttttcctttttgttttttaaaacattttaattgagatataattcatgcaccatataattcacccatttaaagtgttcaattcaacagtttttgttatactcacagatgcatgcaaccaccaccacagtcaattttagaacattttcatcacttcaaaaagcagccctggactccagctaccatccccctaggcagcccacccacccccagccactagtatacttccagcctctgtatattctcctgttccggactttcatacgaatggaattatataacatgtgatctgctatgattgacttctttcacttagcataatgttctcaaggttcatccatgttataacatctatcagtaatttattcctttttctggccaaataacattccattgtatggataccccatattttgtttattcatcttcaggtgatgaacactggggctgcttccacgtttgagctattatgagtaatgctgctatgaacattcacatgcaattgttgggtggacatatgttttcatttccctaggaataaaattaaggaaccagccatactcgttcctctttccaccacaatgcctagcactgtgtgccatgtgctgtgaggcctcaatggctatttgtctaagtgaatgaaaagaatacagttttcagcacaaggcatcaaagctaagggtccgttgggttccatagacacctccaaccacctttaagctgtgagtcctggcttcctcaccctggactaaaataaacttccaccttgtttcttattcactgtggctttgtttgtttctcctgtattttagggaccaatgaagcagccatcattgaaatcttatcgggcaggacatcagatgagaggcaacaaatcaagcaaaagtacaaggcaacgtacggcaaggtgattccaggggtggtcagcaagcttgcacccagccatggcctcagccgtctcggcttcctcatgtccccaggccacgcagaatatctttatagctttattgagtcagcccaggaggaaaagtgaaataaccacttaaaagcattaatggagttcagaaaaactgaaattgctttgttaactcaatagcctgtaaaatcaatactcttaaactcatttcttaaattgacttcatttttctatgaagaccctagtctttttttcacttaattgggactaactgtacatatgtagctagatcagtaatttgaaaatcagtttccacaagtgggtctttatacaggaatttttcataagcgattgttacagaaaactaccaaaaaaaaccctccattttattaagctatcaacacctatttttctttacattttctttcttttctttcattctttttattgttgaaaataattttatagagagaagtcttcaagtatgcattaggctttcttatttctttattaatatgtaatgaacacaacttaaacttttcttaatgtcattagaattatcattatgcaaaatgaatatcaattattatgctgtattctcatttatatttttcaaacttttaccatttcaatcactgtaggtataaatagatatatagaaagatgaagatgggttttcctatttatttgatactgagcaggtaacaattgcttcaggccttggtcttttcatggatagaaagaagatgataacttagctcccttctcaggttgctgggagaatcagtcaggataatgccagcatgtaccaatacaggaaaaagctatgatagctatgattgtttccattttacaaaatcacacacctaaaaaaaaaaagagaaccaggactcacatccaagtctcacatccaagtctcctgacttcaagaacagtatccattcctggaggacccagtgccataaatagagctatttgcttgtacactaaatggcccaaatggctgtgcttttgtgctttttctgcttctctccttactattaggtgcgtcaatgtaatttttgatgaaaataagtgcatcttcagttcaactgcatttaattgaatgcatgaagctgaatgtgtgtgtggttttttttgttgttgttgttttgttttgttttgagacggagtctcactctgttgcccaggctggagtgtagtggcataatcttggctcactgtaacctctgcctcccgggttcaagcgattctcctgcctcagcctcctgagtagctgggattacaggcacgcgccaccatgcccagctaatttttgtgtttttagtaaaatttttgtattttaattttggtcaggctagtctcaaactcctgacttcgtgatctgcccacatcagcccaaagtgccaggattacaggcgtgagccaccgtgcctggcctgaagctgaatttttatccctgtcaacatccctaactccagtagcctcccaagacacattcaccctaccaatatgaaaagtcagtccaggcaaggtggctcacacctgtaatcccaacactttgggaggccaaggcaggaggatcacttgagcccaggagtttgagaccagttgagaccttcatctctaccaaaaataaaaaattagctgggcatggtggtgtgtgcctgtagtccctgctactcaggaggctgaggctggagggttgcttaagcccaagaagttgaggcctcagtgagccgtagttgcaccactgcactccagcctgggtgacagagagagaccctgtggaaaggaaagaaagaaaagaaaagaaaaagagagaaagggaggtggggaggaagggagagaagggaaggaaggaaagaaaaagaaagaacgaaagaatgaaagagagagagaaagaaagagaggaagaaggaaagaaagaaagaaaaatcggatacaatgcttcttaatctttagtctttagtctaaagaagagtaaatggattcaaactgaaagcctaggggccctgttaaaacttaaatgggcatgttctggcacaaaactttgtgatacttcatttgccaatcatttgcttactttctggttctcggctgtgtttcagagaactgagactgccaaagagataatctagaatcccaacaacgcaaagctagaagatgttagatatgatccaatctcagccccgtgtcagttgacctccaaagagaataaccatcccgtggtaacagagtcagcaggaaaaccaggagtagagctgagctatcccgagccttctactctgtccagtcagaatgtaagcacacaaggatttgtttttatgcctgtggcttgtaagagtgggaagctgggatttttcttctctgcagctgtatataatgcccatctggcctgaaaatatatttccaatttttagatgactccacaccatagagtactgaccacagacctgccttcacaagatgcagtgttggctggagcagccactgtggggcggaggcataatataacagcccccttgtaggactgcagatcccagggctttggacaaaaatattccgggtttttctcccaggccaagagctcagagcttcatttgaaaaatagttgatgtgcctcctcttagaaaatttttttcagcatgggagattaatgataagcatttattgaccgtttaaaatatgtcaggcactaatgctcagtattgacaaggattgtcacatttaattctcccaaaaaccctgtgaggtcagtctagcactgtctccattttctagagctgaaaactgacagttggtgagattaagtacatttccaaggtcacaaaggtactgtggctgtgttctttgccaccatgccacactgctggggagctgcccaccctatgctatagtttgtgtccttgaaatgccagcttgtctatgggcctccaatctgagccatcccaggctgtcgctctatgtgaaggtctttggtttaagttagggcattaactactctaggtaggctgatgcccatccttgaccatttctcctgttaaaccacattgtcagagggagacagggagaaggtagttagttttcttgtgaaaagagggtgctcaaagaaaagaggaagacaggtgcttgtcagaatagatggcaggctggggtcatggtggctcacgcctataatcccagcactttgagaggctgaggtggaggatcgcttgagcctaggagtttgagattagcctggacaacatggcaaaaccccatctctacacaaaaaaatttaaaaattagccgagcatggcagtgtgtacctgtagtctcagctacttgggaggctgagatgggaggatcatctgagcccaggaggtcgaggctgcagtgagccatgattgcaccactgcactccagcctgggtgacaaagtcaccctgtctcaaacaaagaaaaaaacagatgccagtaagaattccatgtacttccccttctacatacctgcattcttcttcacctgtgtcccttccaggatttagcgagataacggaagtgacggtacaggccgtcgttcttcccatgacaatcctctttattcctgttatcctctgcaattgctaatagtgccccctttcacactgaaaggcatcccaatttggatgacaaattctccggtcctagagataacagccctgtatttcagcccttcctagctgaatatttggggaaaattcttcatcttatcaggttcaacagatcttgaggattttttcagcgatcttgaagactggctgaaaaagctctctgagctctcaaatgttccacagatactgttgttattgtgattcatcggtgaggtctccagccctgagcagggagctcctctctgcctctctgccagccctggggaaacgtggatgggcagctgagagcaggttgcatgttctcagcaggttgcaggttggcagaattcatgtccacagcacctttcttgtcaactatgagcacttgcaatagtgcaagcagacacctgcccctctcctcctgggccattcccagcacgtctctcactgtcttctggtaggagctggaggaagtactcaagagtgagctgagtggaaacttcgagaagacagcgttggcccttctggaccgtcccagcgagtacgccgcccggcagctgcagaaggctatgaagggtctgggcacagatgagtccgtcctcattgaggtcctgtgcacgaggaccaataaggtcagtcccagctgagcccgcaagggagcatcacacacccaatagagatggttgcagccccccagaagggaccctacttcccagcattctatccatggactgagcaggtgtctggggagacatatgtgtgcttggtccatgtgggaggacatctcttccagtcttccagaggtcagtcttggtgttgctgccacttaacagaatcgatcttttcagaagagctgtgtccagcgagcttctgcttttctaaactgatgcttttataagcaggaggcacaattctactttcccccacccagcctgactttgcggctcttctgacatgaaaaatcaacaagcagcccaagcatgtctgtgccactgcctgggctatggcggtcagctagcatagggtacaaaagagactataatgaggaagagaggtgagtggtgctgggggatgccagtgaacaccccagtggctgccagtactaccctgaagggttgtgtgtccttctgtcatcagacagagggatgtccctcggcacatgccacctttgcaggggctgaagagagcatttgttgaggccccatggagaactatttgtctctggctccagaagccaggagaaccaagggactcatcaagtcaagagggtccacaaataattcacaggagagacccctccctcttcagcaaccacacatgacagcagaatggggcagcccagcaaggaaaatgccagaagagcccaacattcttgaggcctctcagcaggaaatagaagcagaggttggagcagacagcaggcaaaatgcaaacagtgccctgacacaaaaatgcctggagaaggcctgggtgctgggccacgttcacgctgctcagcctcttttcctgaagtgccgccagggtccaggctacaggtgcaaaccttttctggagcatccccggacttcttttctccccacaagataataaaaatcctccatttcaaggagtctcaggttgggatgatgcttcggaggagggttagcacaggccccccgggagtgtgagttgaggccaagaggcacacaacttcccccactcagcatccacccttctcagaagcaccaaggtcccagcagggaggcagccaacgccagggtggtcagcacctgcctttgtgaaaaggttaattttaatcatatttttcaggccaggtacagtggttcacgcctgtaatcttagcactttgggagaccaaagcaggaggatcacttgaggtcagacggagtttgagaccagcctggctaacatgatgaaaccccgtctctactaaaaatacaaaaattagccaggtgtggcgccatgcatctgtaatcccagctacttgagaggctgaggcaggaggatcgcttgaacccgggaggcggaggttgcagtgagccaagattgtgccactgcactccagcctgagcgacagagcgagacttcgtctcaaaaaatatattcatatatatttttctaatctcatgtgatcatagctttttctccctcagcctagtttctttaagttcctggcttcaaccaataagcaaggcctctctatcaatcaaatagatctgatgggatgagaagaaaaacctgcagagagtgggtgccaggttcaggcagatcctggttgcgggttggaaggagaaaagggagggagctgcacaaacacaagtgatcagcctcccccagcacctagcctgcccttccctcccacccaggagcagtgaggctccccactgctttctccccatcaccaccttctcccaatcaccacctactgactttcattttagccagcttggtggtgggggggcggggggagcaggaagcctgctcttacaagctgctggttcaagtgtaaactgaggcagctcctgaggtgcaccccttggcaccagacattgaaatataaagcagtttctccaagaacacaccctcaagagaaactagcactcctgcacgcagccagtctgttactgaacgaagccttgtttgaaggagagaaaacttggaaacgacctaagcctccatcaataggaggttggctaagtaaaccgtagcttattgtagtatggaatattttgtgtccctttaaaaaactctaggtgactatccatgtacaagcatagctggatctccgggatattattattgagagaaaaactaagtcaaggaatgataggtacagtattccacctgctaaacacatgacacctatacaattctgttttcagtagcacatatatatacaaacgcaaaaaaaaaaatctgtgtatctttctgatacgcactgaacttctaacatgggttacctgagtggggaagagagagtgagaccaggcgaggaggtggtgaaagaaggtgttagcctagctgtaaacttctcacatttaaagaaagagaatgcatgcatttgtcacttgtgtgttagagatgtttgcagaggtgggcggagtggggggggggcgggccgtcacatctccagggactcgctccaggcgtgtgccctggacctataggggtgaccatcttaagaggaagtcttgaaggcactttgtgtccagacatggtctcccgcctcttctctctgtatctcttattgattaatccctccttggaatattgatttttttgtaaattaccttccctaggaaatcatcgccattaaagaggcctaccaaaggcgtaagtgacttttcattctggctttggataaagtatgtttctttcaaaatacctctgggaaactaaatcatctgctttcttccctccttgtttacttccttcgaagtatttgataggagcctcgaatcagatgtcaaaggtgatacaagtggaaacctaaaaaaaatcctggtgtctctgctgcaggtaagaggaaagaggtgtcacctgttttatcatcttaggaaagaatccttggcaacatggcaccatgatgaaaaagggtaacgtagataaacatttctttcttatattaaaaatattatcaagggattatcaacccatgctccatcagcccagctctggtgaaattatattcaattggaattacttccatataaacaatctgcctagtcatttgcagtttacaatcactttttgtaaatgaatcggctcattaagcatcactttgtcattttgccagtgaggaaatgtaggccatgagagggtgggtaacctgcccaggttcatgcagccagtaagagacagcccagaagcaagaaccagactatctgaccccaagcagggccgcttccacaacacaactctacaattacttccaggattcactggatcctgggcctgtaaggactacaacaagaaactcagccaggacatcagggctttcagaattggccctgctgggacacagccccccgagacctctagacagacacatctgtattcttatggacacactcatctttacgagctctgtgcattttctctgttttgtttctcccaatgggatacactgacagcagagaacagaagagagaggcttccactgcagcaggaagagagtttaagttttctcttgctgcataacaaatcgccacaaacttagcacctcagaacaacatagatctatcatctcacagtttccatgggtcaggagtccaagtagtatcttggagatccagctgaataatatttgggttcgctgagtcctttggtcaggttatcaacaggctgaaatcaaggtgtcggccagggctgccatctcatctgaggctcagagtcttcttccaagctcattaattgttggcagaattcatttccttatgtctgtgtttgatgtccccattttcttgctgttgaccagaagctactatcagctcctagagaccgccagcagctcccttccacacagtcccccaaggcagtgcaccacatggctgtttggtttcttccagtccagcagcagctcatctctctgacttcttccatctctgaccttttaagaagagctcattcatttgggtcaggccggccaaggataatctcccttttggtggactcagctgattggagacctgaattatatctgcaaaattcccctttgccattgaatataacacaatcacaggagtggcatctcctcacattcatagctctcacccacactcaagggaaggggattatacaaggatgtggaccattgggtcatcttagaattctgcccaccacaaagggctcaagttagacttccatgaccagctctcagggttttttaggactgggaccttgagtggtgaaatctgatattttgaaacgaagaggggactcattctagggaaaaccagagatcgcactcagtctgctcagaggtcagtggggtgtgtgggtgactctggtttctacaaaaaaaaaaaaaggcaaaaccaagtgttgccacagaagctcctctgtttatccattgtgcccaaaagatggcagcaaagagcaggtgtttcctccttgccaggctgaactgagctgagctgagaaagaattcacctctttctccaggactttgttttttttgttagtttgttttctgtggtcaagcaggaatgcaagttaataacaatgtgtcaatttttctaggctaatcgcaatgaaggagatgacgtggacaaagatctagctggtcaggatgccaaagatctgtatgatgtatgtgtgcagacatgccagtctctgcaaattctttttttaaatttattagcattattttcaacaaatgtttatttcatgcaaagaggagttacttgggaaataagaaacaaagatatgcttagatctttctagatcatatatatagtctccatgaatctaaatgaatggttcctattcttatactctggggttgaccacatcagatctgttttggaacaaagaatggtataaacaatataaataagtatgtgaaatacatttgtgggttagaagctgaaagtgcttagtccatttgacttctattcaatgcatagtttataatttcctgtcagtgaggcctagtcacagcactgcataatcagtcttttcacaaaagcctttttcaaagtgtttgtatttgacccttgaggcaggggaaggccgctggggcactgatgagcttgcgttcaatgaagtcctggccaagaggagctacaagcagttacgagccacctttcaagcctatcaaattgtaagtcataaagtattggggcaaaagagttcactctgaaagtgtcttaagttatttccaaaagaagccaagatctgcaataaggaattggggatcctttacaacagtggttctcaattggaggcgattttcctacctagggaatatttgataatgtctagaattatctggagttgtcacagctgggggtggtggccctggcatctagtgaacagaggcccgggatgccgctaaacagcctgcagtgcacaggacagcccaccaccaagaatcctccagccccagatgcagtacccaggctggaaaccggcttcacaacagacgccagggaagcaagtgtcccattcaggggagaagctctagagtccaagagcccaggtgcaaatcctgggtctaccactggcaagtgaccaaatctctccatcctgtttgtagaacaggaaccgtgaacatcatcttcacaccctcagagtgattttaaggttaaataagataaagactcagaacagttgagctggcatgtggcaagcatactaatgtttgctactattactccagtttacagttggctaacagtgcccaccattctcaagacagatatgaggtacctcaaagatagcctcctgaaaagatgcacataaattatattttaatcccaggataaatttaagcccacaaagcgagttagttatttcaaggcccttagcagtaagtccttccctgaaaagcagtctttacttgcaaaacgcctggagtggaatatcagattttttttttggcatcctattttatatgtgtagagtgcttttacctgctcaaagcacttctatgttctgtgtctcattcagtttcacaacaacagggtaactataatgtaggccgaacaactattgtgacccacaactgctggacaaggaaagtctgttgagtgaggaaccatctgtaacttatcaggaccacacagcaagttggtagcagagagtggatgagaactccaagactccccggcctgagctcctacctcagctgaagctggccactcctcactccaaatagcatttcctatgtgttgccagcagataaaaagacaataaagctttggaattttatcatgactgtatataagcctttagggcctgctcctttcaaatcgtgcccagagtcatgatcaaagacagctgaccctgcactcccctggtctcttgttcctggagctgcgtagcctctgagctggaggacttctctatgactgagatcctcctcccacactacggagcccacagatggagtttctgggtacgtgtgtgtgtgtgtatgaactgactacctgaaagtacactctccaggctaatatctcaaagttgatcctgaaacagcaccatcagcatcacttgagaatttgtttaaattgagaattctcagtccccaccagacctactgaatcagattccccggggctagggcctgaccatctgtgttagagcaggtgttccaggtgattttaatgtatattacagtttaagaagtcagctttaggctacagctgtatgtccttgtgcaagttattaagggttctgtgcctcggtttcccaaacgtaaaatagggataatagtacctacttcatagggttaataaggattaaatgagttaacagaaataagcagttagtccctggcatgcagtaggcgttcaatgaacattagcaattgtcgggcgtctccctgggtgaacagacagtgccaaaaatcagggctaaagcttatatgtacaataaggtaatctatggatttgatgattctttacatgaaaccagctctaaaatgctatctattcatccatttcaaaagccttgctcaagtgtcattcttgatatttattgctgatgtttttagagttcagcctgctcttagaccctggttctatgatttttctgatggcttctgaccaaaagcacagagatgctagtctgagatcactggagtttcttatgtggcatgagtcgtcctggcttagggttgaattttaattttcagcacaaaaactcagggttttgccatttatttatgctctaagcctgagtcttaacttctgacactcccagcaatcccaggccacgcaacagtttcccaaacttctgcatcatgcaggattattacagtccccagcgttaccaaatatgaaagacttatatagctataaaaccaaagtaaagtccccaaacagggctcagcataaacagtaggtatgcatacccatagcccactttgctgccacctcactgcgtgcctcaccctttgcccctcccctgtacatgttccttattccacgccagaggcttcagccctctaactgctatagtcagtgccagagcacagagggctctgctgtcagcgtgccgtccatttggggaaaccgattttcaaagaaagaaatgtctcccctgctcctctaataacctccctgcaggcattgctgcctgtttaactagagtcttagagacttgtttggaatctacccttataatgtgtttttctactgagatcagaaaatctgcttctgtacaaagagcccctaagaatcacgttgcagtaactgaagtgagaagtatccaaagtacagtcccaacagcttgggccagaccattgtttcagattgtgtcccacggagacgcctcagcagctaccaggagtagggtggggcaggaagcagacagggcagtaccttcttgttgcagtgtgtgaatagcgcctcctggagttgtgcaaggaaaaaacctgagcgggcaaaaacatggtatagatgccaatggcaagggaaaggagcccacctcccgcctcccagcacagctctgctttctgctttcatctgttttgtaggctgagattctacagaaaatttaaaatccctgctctagcctggtattaacaatagaaatggaaaacggtttaatgtgaggattttttaaagtaaacaagacctgtgtgaacaaaatgttctcttgaagtatgatctcagtctacagaacaagaaccttgtttctgggaaagggataccaatcccttccaaaataatgactcccacatcaaacccaaaaaagactgggggcagctaaggaagggacagttcccccactcttctaatctggtttctattgccacacaccaaggcctccagatacgcaaacaatgactaggagatcaagcaacagggcttcattaaatctggacacagttcctcccctgacatatattgtgcttacatcacaaagaacattttgtttacctgtgttttcaaaataaaccacataaactccactggtgcatactcaaagtccccaattatttatagaatcaattgtgtcatatcctcaaaagataatttctaagaaagaaatttcagtgtttctaatgcttaattgcatttctccaaacccagcaaagcattctcctttctctttatgtgcctgccctgagcttggcccgggcagtatttgtgttaaggatagtcacaatttactctgaacttcagcttctgtaaatatttagaaagaaacctaatgtgtaatgctgcgcagagcaatatgtgagccagtggtgaatataggattatttggaatcaccccagagtgaagacaagtggcattttgatgtggtcagcacccccggctcccagcccttgcagacccaccctctcaggaactttagatcaagttgttatcatgaacttcaccatgcctacttatttcactcaaactgtgactaagtccctggtcccaagacaagggagaggatggaggtgcatgtcagatgatcataaccacagcctcctgggaaattgaaactggaaagggtgaagaacacatgggaactaaactacacatcaatgttaaaaaaaaaatctatgattatagtatatataatatattaattatatatattataatatatattatatattaattgtttctccactcccaaattttacagatgaggaaattgaggttgagggagtggcactaaggtcaaatccattgggagtcaaatctagactgactcctcagcaacgagagccctctctcgaatgggtggcaaacaccccaatcctacaaggcaagagtcaggatagcagttccctgaagccacaggactaaatctggaaaacttgagtgctttttgtagaggaacaaccccaagagtactaaggtcaaaggcaaacctggaataacagttgattttggttttcgctgcagctcattggcaaagacatagaagaagccattgaagaagaaacatcaggcgacttgcagaaggcctatttaactctcggtaaagtaaagttaggagagctcctgtcttaggttgggctgcctggaaccagactcagacagaggtttgtgtgtaggaagatttgagggaatagcttttgggggtcaacaggtctaagcagcactgagcaagagagagagtgactgtgatgtagttgcaacaggggcgttgctgatcccacaggaagcttggaagctgagatgtccaaggtggagcaagggggccaggcttttgcaccccacatcaaacagtcatgtaacactggctgtaccaggggagcagtgcaactttgggcaagccagctctctcccttggagggagattcctggggagggactcagctgtgaatgactgcctcgatcctgaatagggcatctgagtggcacaccacagcatccattgcagtcctgctgtattagtccgttttcatgctgctgataaagacatagccaagatggggtaatttataaagaaaaagatgcttaatggactcacagttccacgtgcctggggaggcctcacaatcatggctgaagacggaaggcacagcttacatggtggcagacaaggcagaataagacccaagcgaaagaggaaaccccttataaaatcatcaaatctcgtgaaacttattcactaccatgagaaccgtatgaggggaaaccactcccatgattgaattatctcccactgggtccctcccacaacatgtgggaattgtgggagctataattcaagatgagatttgggtggggacacagccacaccatatcacccactaacaccatgggtccctgagggcacctgtcaacaacctagactgttatccagtttcaggcagcctgatagctcacaggtttccttttccatttggttcctttcaatgttttcaaataatgaagtttgtttggaaagagaggtgagggagatcagatcctgattgtgccaaccaaaccccaggacctcctctccaggtgttgcccaaaggcaggaaatagcagagagatgggcatggggctgtgtctgacaggctccttctttctttctgcaagccctggaatgaaggcattgtccattgtccacagtcctgtggtgaggaatccagggcaccaacccaaatggcagaaggaatggagagacctgttctcagaagaggaagaaccaaataagcagccctggaagttaaaaaatgtgctccagttgccaaactcttttgtttggtttctttggggtttttttgaacaatgtcagcaattgatttttttttaatccatccttattttgcattcaatgagcaagacctctgctgtgatatccggaggcctaaaaatccctggcattactcatgacccacactggatatatacacgagccctggtataagtgactgtgcttagggccttaagccatttatgccggaggttgcaattttttgaattgcagacatgtgtgaaaaattcagacctcggcgatgaccttgagcagtaggatataaataactcctacaagcttaacattccaataatggaacactaggcataattaagaagagtcttgagtagataataggatctactcacagcctggttctgaggctgtacgtccttgcttgctatacctgcattgtgagaatcgggaaaacaccagagtgcagtcagaagatggtattaaaactattcaatgatttaacatttactcagcacctgcctgggcccagggtttgtgctgggttgggaataagaggtaaataaggccagttcttgctcttaaggagcctaaagctcatggtggattttaagctggtgggtacaaatcaacagataaggctaaagataaagataaaaaaacaaagagcaaagatggtacagatgacagaaaagccaagtccctggggttgaggaccacacagtccaagagagagctgtactccagtggtagcgaaaaaaagtgattagaaaagaccttgagaataagccacacaaataacagaatacggcttcatgactattttctagacacttcccaccccgctcccacctaacttacagcgatgccagtttatgactaacatctaggagcagggggtgaggtcaaatggctcccaccacatccagcctctggagcagcatttctcaaagtgaggtctatggaccccctaccttggaatcacctgttacaatgcaggttcctgggccccactccaggttcccattgagaacctccaggaagggagcctgggaagccacacttctacaaactgtccaagtgactgtgttatactcactgaagttcaggaactcactctgaaggcaaaggggagcaagatatagagcaccgggctggctgcctttcctgccatttgctgtgaagaggtttttttctttctttctttctttcttttttttttttttaagacacagtttcactctgtcacccaggttagagtgcagtggtgcaatcttggcttactgcaacctctgcctcccgggttcaagtggttctcatgcctcagcttctcaagtaactgggattaccaagcctggctaatttttatgttattagtagagacggagtttcaccatgttggccaggctggtctcgaactcctgacctcaaatgatccacccacctcggcctcccaaagcgctgggattacaggtgtgagccaccatgcctggctgcagtgaataattttattccacatcttctttggctatccctgcccagccttttgagagattcctgctgctgctaacaacagaggttgttccccaagcatagattatagacaggagaaatgttgagagttttcttcctgaaatatcaggtagaaggaatgtcaagggagaagatccctgtgcaggagcggaacacggtgacttcaggcagacaatgatccccacatcaagccgtgctgtatggaagaggattttcaggaaaactttgtggtgctcattagctcaaattgtctggggatcacagtaagtcttgaatatgctactccccagaatagcatgcaagtttcccctgaaccaccaatccagcagcttttgggttgttctcaggagaaagaggccagacattgtttcttttccggtgcgattttcttttccactgaaactgtggcagctgccacatggcctgtaaaaggcggctggtccccaaactagactctccttcccgaactctgctcctctcccctgcttataagcatcaatcacacagacagtcccctagacaacaacagccccattatgggacatagtaagattgcacattccacatttatgctgaaataatcacttactgttaatcactaacatcatcaagtgttctagagaaatgttaacagcctaaagggcaaatattttttttttcctctaacgtgttagccatgatggattcatatgagcctgggaagaggggaaggaatgatttattcccaggagaagagatgcaccctgtcacctgcttgatgaatagagaccacgcttcattaagctgtagatagatcaaagctggaaggcaaggggaagccaggaaagagcaaatagcagcatcgtaggaaagtgatctttaaaaaggatcaaacatttcatcaagtccacatcccggattgcaaaccaaaagatcgtggggaacctggaaaaggttcagagatgaggcttgcaaaacaaccccagtgaggaaaaacaaagagtagggaggttgttgagcataggagagcaggcggctgtccaactggatacattgtcaagatgatgaagttttgttccagaaggttgctggccaatctgtttcccttcagaaccctaggacagcaccagagatttcactcgatagggaaagttatttctgctgggaaataacgagaatcatggacgtggccgggagggcccgaggatgccacagctctcctctagagggtcttcaggggacaggaggggagctatgcttgaagattccaggtgctctgaccagggaatcttccaaatctcatttcgcaacggtgtcaagtcagctcttttcacacctctgtctcaccatccagtcagctcgaagggcagccaggtgacatttaggggggtcccaaggtcattccacaaaacgtgaaagcctcacattctcttttcctttgtcctgcccagtgagatgtgcccaggattgtgaggactattttgctgaacgtctgtacaagtcgatgaagggtgcggggaccgatgaggagacgttgattcgcatagtcgtgaccagggccgaggtaagacacactccgactccaaagaggcggctgcaacttctcttttttccaccactgatgtcatcaacaaatagtttctattaagggcctatttacagaaaaagtaaaacagagacggccccttgccttcccagaatttgcagaagacattgtgctctgcttcaatctgtttctttttataaaaatacaataatgatcgttgcttctttttttgtcctctgtggctctggagagctagtggaggggcgcagaggcaaccatgtcgagcagttctcaggggctgcagctatgcatggctccatgttaaggaagacaaaacaaacacacttgaaagaggtcaaccagcagcaggaacaaaaagagaatgatttctgaattcctgagtgaggcctttccttaactgaacacactgcagaagcaagcacatcagcataaggcaatggttctcaatctttttaaaaactattgctgttctaaggaacctttttagacacgtgtttcttcattgccatcccttccccacaagaaatgttaacaccagagataatactacaaatctgtttatataccatgtggatatcagtgctttatacataaaaaaattaagggctttttcaccccctaaaaaccaatttgtgcttgctctcggagaatgtgtatgtataagaaagaaaagggagaggaagagccaacggcttgggagcagccgtcaagatcacagctggtcgggtgcaatggctcatgcctgtaatcccagcactttgggaggccgaggtgggtggatcgcctgaggtcaggagtttgagaccggcctggccaacatggtgaaaccccgtcactactaaaaatacaaaaattagctgggcatggtggcacacacttgtagtcccagctactcaggaggctgaggcatgagaattgcttgaacccagaaggtggaggttgcagtgagccaagatggtgccactacactccagtctgagtaacagagcgagactcggtctcaaaaaaaaaaaaaaaaaaaggtcacagctaacacttcgggatatggggccacagacagaaggtggtacaaaataaaggggaagtggcatttcatcagcagcaggagaagccttggggaatgaagtggaactaagcacttgaaaaccacagacatcttccctcaaaaaaaaaaaaaaaaaagtggttaaatgaagggggaggtgaagggggagggacaccaacccaaattctgatccatggcttcttaacaaataatgcttaacatctgacactgtttttaaatataactttgcaacaagatggttcttgcttttttatttctattcctggaatttctcctcccctcctttctcctcctccacaactcatctttttctattgaaggccatgtctctctctctcccctctttccctttgccagtctctctgctctgctcctgccatgcctctgcctctctcctccatggctccaaatccctctccctcctttctctccaggtcttctgccttgtccgtccctctgtctgttagcaactcgacctccagccaaagtcactgagagatgagagatcttgagggactcaaaagggacaggttgaacacaatgaagacccaggattccaaatgacccccagagagactggatccatccgaagggcttgtgagggttccgtgatcactccgacatggcccacggagtgttttattccaagaagctctgtcccatctcagaatcaaccacacgtcctgggccatctcaacatgtgggcagttacctcagaaggcttcaggcctggctagatatagtagtttggccagatttcctaatctcccaaagccacagaacagagccctgtgcaccccatccctacccaccctccaccttcctgcccgtgtcccagcacggggcaaggagccaagcagcggagcagggggacacacaggctgggggagagacagacaccacctgtctcctgtagtgtctgccacctgctccacatccactgcaaaccctccctcactcccccacatactcccatcctgatcatttctctcactgtctcagctcagccctctcactggggcaagagaagaaagaatcagatccctgagccacactttttgggtctggagtacaaggtagggtctaagccaaaaaagaaaagaaaagaaagactcctggttaaaaagagttctctgcttcttttatgagatccattatgttctacctggaattacatcttttctggtacaagtatcgtctcctttgctaggctgtaagaatcttctggcagagcaatctttggatttatttttctcctgagtcctatcatcacttctagcacctgggtttttcaagcttccaataaattagattcaaaataaatcctacaagttgctagtgatttgagttgtgttgactggtactaatatccttgctaatcatggtatgagggaaaaactgcttaattgcttaattccacatctctgtgttgacaattttcttagttttataccaggggtcaaccaactacagcctgcaggccaattcaggctcactgccaggttgtgtacagtcctgctagcttagggcaattcattttcaaataactgttaaaactcaaaagaaagataatactttgtaacatgtaaaaactgtatgaaattcaagagttttagggccaggcacggtggctcacgcctgtaatcccagcacttcgggagctgaggtgggtggatcacctgaggtcacgagttcgagaccagtctggccaacatgatgaaacccccgtctctactaaaaatacagaaaaaaattagccaggcatggtggttgactgtaatcccagctacttggggggctgaggcaggacaattgcttgaacccaggaggcggagattgcagtgagccgagactgcaccattgcactccagcctcggcaacaagagcaaagctctgtctcaaaaaaaaaaaaaaaaaaaaagaaattcaagagttttagtggaacacacacacacgtggacacctctgcaacctttggggaattgacctctgccttccctttcctgatcacaaaattgaaataacgtgataaaggaaataatgataggaaataaagccctatctcaagggctgttttaaggcatgaatgagcaaatgagtataacatgtgtagaacagtgcccactgtttgtgaacacaccataaacgttcttatctccattgctgttattttttctacaggtggaccttcaggggatcaaagcaaagttccaagagaagtatcagaagtctctctctgacatggttcgctcagatacctccggggacttccggaaactgctagtagccctcttgcactgagccaagccagggcaataggaacacagggtggaaccgcctttgtcaagagcacattccaaatcaaacttgcaaatgagactcccgcacgaaaacccttaagagtcccggattactttcttggcagcttaagtggcgcagccaggccaagctgtgtaagttaagggcagtaacgttaagatgcgtgggcagggcaccttgaactctggcttagcaagcatctaggctgcctcttcactttcttttagcatggtaactggatgttttctaaacactaatgaaatcagcagttgatgaaaaaactatgcatttgtaatggcacatttagaaggatatgcatcacacaagtaaggtacaggaaagacaaaattaaacaatttattaattttccttctgtgtgttcaatttgaaagcctcattgttaattaaagttgtggattatgcctctatcagctgcttttccaaagattgtcttgataagtttgggctcttctctgggaaatgtatgacttgtgaaattcaaacctacattttttagtggtcactaatcaaggctagtcataaggaaacaattcacttgcttttgtaaactgtaactaagggtaaaattccctaatctgctacctggtttaactgggttttcttctctagacatttgacccacttgagtcttccctctgatcttcaaatacaattaagctgagcaaagtgccaacaagatcaagatcaatggtctacctctgaagtgaattggttccacaccaatagattctgtgttccaaaactttagtctcatagccacgtgttgctagacatagagggatctgtcaagagaacctggacactttggcccaataatcatagttgtcattcattggctgattatttgtgcctgacactgagtagtccaatttcattcttaatcctccccacagctctatgtggttaatattactcccaattatcagttgaggaaactgacacattaagtaacctatctaaattcatttacaagtgctgttttcacactgctataattaccggtaaaaaattaccaagactgggtaatttataaagaaaagaggtttaagtgactcacagttccgcagggctggggaggcctcaggaaacttacaatcatggtggaaggggaggaggcacgtcttatgtggcagcaggaaagaaagagtggtgagcgaagcggaaagagccccttataaaaccatcagatctcatgagaactccctcactgtgacgagaacagcatgggggacacagaccccatgatctaatcactcccaccaggtctttcctggggattacaattgacacatgaggattacaatttgtgatgagatttgggtggtgacatagagccaaaccatgtcaactagcatttcaatccagggctggctgacaccaggaatcatgctactaactgccttaattggaaaaatcagttgaagtacatgggaatgggtctgtattcattcatctgcttagttccctactatctgccaatcactgtggtgtgctctgaggatacaaagacaagtagaacactgactccccttggggcagttcattcccaggtcaataatgtctcttttattcaatagaatgctgtaagtgcattaataagagcagtatatttgttcattttcacactgttcattttcacactgcagtaaagaactacctgagactgggtaatttataaagaaaacgggtttaattgactcacatttccacctggctggggaggtctcaggaaacttacaatcatggcaaaaggtaaaggggaagcaaagcacgtgttacatggtggcaggagagatgggggaggggaagtgccacacttttaaaccatcagatcttgtgagaactcactcactatcataagaacagcatgggggaaactccccccatgatctaatcacctcccagcaggtccctccctcgacacatggggattacaattcaagatgagatttggatggggacacagagccaaaccatatcaagcaggtaaagggctctacctatgagtaagaagagagaacacacagctctgcatggggaactggggaacacttcccagagatgcatttgtgctgggttttaaagaatgcatagaagctctccagaaaaataaaagaagaagggcacaagcagaggctggagaagcctgagtgggcagggtgtgttcagggagaggtgaaatccattctcctggggcacagatgtgtggaaagaaaggaatggccctggcaggcaggcaaagcagctgtgaaaataggtttgaaccacatcagccatggttctgcctgccaagcatgagtttggtcctctgggcaacagcagtcattggagatgtttaagcgaagaacatgatcacatctgggctttgggaaatcactttagtggctgctagacatagagggatct

SEQ ID NO: 651 - DNA, 13595 bp, Human
ccatcagaatgtgtagattatacctcaggccatacttttaatttacttatttatttatttgacaaataaacattgtacatattttctatgtacaaccttctgcttttatgagtttaacctgtttagagtctatgtataagtgagataatgtgatattttgtgttttggtgcctggcctggcttattttacttaatataatgttcttcatgttcatcaatattgtcagaaacgataggatttacttccatttaaaagctgaatagtgttgcattttgtatataatccacattttcttcatctattaatctgtccacagacatttaggttgattttatatcttggctattgtgaataatgctgcaatggaaatagaagttcagatatctcctcgagacactgattttccaatttttgatatatacttaatagtgggattgcttgatcatatctttagctctatttttaactttcagaggtgtctccatataggtttccataaagaccatgctaatttactctttttttttttttttttttttttttttgagacagagtctcactctgttgcctaggctggagggcagtcatggaatctaggctcactgcaacctccgcctttagggttccagcaattctactgcctctgcctcatgagtagctaagattacaggcgcccaccaccacgctcgggtaatttttgtatttttactaaaagcagggttttaccatgttgtccagcctggtctagaactactgacctcaggtgatctgcccgccttaacctcacaaagtgctgggattacagtcgtgagccactgcgcagggcctaatttacgttttaccaacagtgtacaagagtttctttttttctacatcctctccaccatttgttatcttttgtctttttggtaatagccattccaacaggtgcaaagtgatatttcattgtgacttcaatttccctggtggctagagaggttgatcatttttcatatacatattctctgtatgtcttcttttgaaaagtgtttattctggtcctttgcttatttctaaatcagtttattttctttctattgaattgtttgtgttctttgtattttgcatattaattctttatcagatgtatggtttgcaaatcttctctaccatactgttgattatctctttaatcttttgattgtttctttgactgtgtaaaagctttttagtttgatgtaatttcatttgcatattttagcttttgtttcctgtccttttctgtcatatccaaaaatcactgtctagaccaatgttatgaagctgttcccctctgttttcttctagtagtttcacagttttggttcttacatttacatatttaactcattttgagtttatttttgtatatgtttagagatttttattcttctgcatgtggttttacaattttcccaatatcatttattgaagaatttgttctttcccagttgtgtgttcatgaaacctttgttgaaaagtcaaattaatgtaaataattgggtttatttctgggttttctgtcctgttcatttgctctctgtttctatttttatgcaactattgtgctattttgatgactgtagtactttgtagtctattttgaactcagatagtgcgatgcctgcagctttgttccctttactcaaaattgctttgcctattcagggtttgtttttttgtgtgtgattccatataaattttaggatttgtttctatttttgtaaaagctgccattagaattttgataggaattgcattgtatctttagatttctttgggtattagggacattttaataatagtaattttccagtccatcaactcaaaatacatttctacttatttttgtcttcttcagttttccctatcaatattttatagttttgagatttgttattattgctgatatttttgagacaggatctcattctgtagccaagactggagtatagtgtcacaattatagctcactataatctcaaattcctgggcttaagcaatcctcctacctcagacttccaagaagcaaggactatagacacatgctactatggccagccaactttttaaatttcttgtagagacatagtctcaccatgttgattgggttgaagttttatacttttacgtgtacttgttttttacctactcggttaaattgatttctaagtatttttgcagcaattttaaatggaaatttatttattttttaaagatggtttattgttatacagaaacactacagatttttgtatgttgattttttttatcctgcaattttcttgaatctgtttatttgttctaaaagatttttggtggatcctttagggttttccgtatataagaccatttcatctttaaacaggcacaattaaacttcttcctttccaattttgatgccttttatttctttttgttggcgaattgctctggtcagaactacgttgaatggaagtggtaaatgtgaatatctttgtcttcttcctgatcttagagaaagggttttcaacttttcaccattgagtatgatgttagctgtgtgtttgtcatatgtgactttttttgttaaaaactcttcaattttattgcttattatatttcttcacatatcatttattcagtcaacactatattagtttactgagcacacaaataaataaaacagaagcccagaactcaggtagtttggatatcccacacactaatctgtgtactgtttgcaaatcacactgtgttgcaacatctgtacctgatgttgcaagactaacatttttgctacctcttctcagaagcctttgtgatctcacctgttggaatgcactaatgttttctgagccccttaaatatcttgtctacattcttttaagaagctcttcaccaactgtcaggtaatgtagtttgatgaattaagaatgggggctctggattctgaacccctagatttcaattcttgttcccagttactatatactcggtgttcttttacattatttgagtcaattacttattatcttccattttccatataagagaggttaatatatgttttatatggaatttttgtgaaatttcagtaatgcacttggcatgatgagggctcaatgaatattaactattttaactgaaccatatcatgattaactatatagactatggtgaaaaaaacaagatttgaatcctaattcatgtgatgtgacataagttattatttaaatggtgaatataaaatagggaatataataactaccccactggcttattgtgagggtccagtatattaacatttgtaaaacctttggtacagtgatatgtaaatgataatgatgattataataatgatttaaattgttttatatgcattcattttttatttataataagtacatgggagatattaccctttactaagttaatttatattatgtaacttttttcctggtttgtaatgtctaatgtttttctcataatagctgcccaataagcacgtatgaaaatattaattcaagataacccagacaatgaggctggtgcttctgtgccaaagcttttgtgcaatgtcctgacatgatttctttagatgtcattttgtgtcagcactatccttacacctacatggattgtataattatctttgtagcattgattgagaattgataagatatccagcatttctgtgtacaatctgccgaaatcatatctgttgtattgaaacaaaggatgtattactttggtatctatatttccttataaatattcaaattactctaaggagtaatacattaacatggtgtcaaattaaactaatccaccacactggaagattaggaatcaggttactttcaattttaaattttcattgagaacaagatttgaaagaattataaatatggatgcactcatccatttattctttatgtatttagcaagcatattaagtacttttaaacattttgaatacaaagatgtgggtataggatgtaagttaaaaaaatgcaaattcaaagatatagttctttcaccaagaaaactaaatacagaaaagagtaaaaatcatataggaagtaaaaatctagtaggaagaatttatattctagacaagagcattgactttcccgggaatatatattttaggcagatcattatcactatgggccgtgaaccagtaaaagagaaaaatgaatacagtggatgaccaggaagtttgcattaggtccaatgccacagaaggaagttgagaagctaaaagaaaagaaaagaaaaaagaacaaaaaagaaaataaaaagtatttagtggcaataaattgttaaacaacctggtaggaatatgatgaatgacagaactctataggtacaagaagacagatggtgaagtaggacatactttcagaagtatttcacattatagaactatatctaaagtgagggtgaaactctttaagctgtgcccatagttaaaggaatctttctatttctaacagaaggcaaccacagaaaaaagccacttaaggtgttggaatccctgggcaaagatttcctcactggtgttttggataacttggtggaacaaaatgtactgaactggaaggaagaggaaaaaaagaaatattacgatgctaaaactgaagacaaagttcgggtcatggcagactctatgcaagagaagcaacgtatggcaggacaaatgcttcttcaaaccttttttaacatagaccaaatatcccccaataaaaaaggtaagactggattttttacaatgaatgtctcaattttccctaaatctgtttaactccaaggcctaagcagtgtcttctgtgattcccctatctttcccttcctaaactatcattttcactaaacctatctttgtccttttagagaccacttcccttttgtggggtggaatccagtttacaatcagctaaaaggctgagtccttgtgttcagactgtgtacaaaaatagttaatagttcacaccttgtagtaagggacacatagaactaaacctagattctgccacctgtgacctatgtgacatcctgtaagttgcttaacttccctagatccttagttattagtcttaccatctgtgaaatgaagacaattccagtactttctcacaagatcgtctaagcctagaaacattataatgacaggcaccacacgccaacaactctcaagatattagctctcatccggaactctctcctctgaactccaggatcatttagctctagcaacatattcaacaggtctacttgagtgttttgctggcatcacaatacaaatacagctaaaatatacactttgttccccagaacaaaactgttgcatttttattcccttttcatctcagtagacagaaacaacatctaccaagtttctcccaccagaatgcaactggtttcttcaccaattaataacagtaatcagtagttttcttggcacatagcagatgcctaaataatgtaggatgagtaaataaataaagtatatgcattcaataaatactagttttcataattattatgtggatgctatgaactagacttttccagtgcttacttacttctgcgaattacaaaatatgataaggagaatctccataaaatgtctaaaattttaaaacttctttttggaacttttgacccagattgaattacgtattattaaaggttaaatattctcatattgaagttcaccagagacagactcaataccccccagaatttaagctgaaatcttgagccatgaagtattacagattaccaataatgataaatagtgataaacaaaaggaaatataaattgttgagacctcactatatcaaatgagctttttcaatcagcactcctctatgaagaaggggtgttcctaccaacagggagcacatgatagtatgatagttgtccaagattataagaaggtagcattctcattaatatttaaactggtccctttgcaggtttttagttttttctcaaacctggatggcatggaaacaatctccattttcaaaaagtcagtgatagtgcaactaatgggaattagaatagaagtaatagaggcttcagaatggttttagcaaacccagatatcacaatgagcattcaagtctaaactgaagtaatctatctgattagcagaggctgtggcaggaataaggcagcggcaacccctcacaggaggggtctagtgtctccctgggctctatctgcagttggagtctccagagcaatcccaggaaactttaggtacactgccagtgtacctagagtgtatccagctctctttgggcagcagtctgcagtataatatgtactatcttctaatgaaatgatttgctttcatgctaattttattattggatgtaagatagaaattctatctaatttctaattttacctgaaaacactgtatctcacacacacacataatgatcattaggagatgactaagttatgaagttctctaaacctgtaagtgaagtggaaacaggaaactttggattagaaaacataccctctgaccagggaatatccaggatccagcatgtcttcacattggcagaattttctgaaataggaccgaaggtcatatatcactgtgtaatctatgaaaagagatgctcagaaggtttgatattcatacacactcttacaacttgttacatctccagagctcagactggctggctttacaaatagctggctttacaatttgcacagggataattgaagttcatttcttctagaatcattaaaaattaacagtaaagttgctaaaaaaataatgccttgaaagtacaagattcaatattctgtgctttggtgtatgtatgtatttatctgtatgtgtagtggggattaggaggggacgattactccaaaataggattttgttccatcctgtatgggataactattaagcatttggcttgtggctaaaaatacatgttaaaataatactttttgtatgttatgttaaataaatgttattagaattaattttacctgtttaattttactttttacatgtgatagtagaaattaaatattggacatggaacacacattaaatttgtagtagatagtgttctgacaactatttactcagtatactcttgcacagacacaatagaaagtccacacagataaatgagtatcctggagtaaaacctttggaaaaatcaaattcttttgacggtataaggaaaggccaaatttaaccccaacatcattgacatgttttccccagaatgatcagaatatatgattacatgtttgggtggatctgcttttctatcttttccagtaacaatacatctcctgatgtagaatactagatatgagatacaactaaaacccctatatgtgaagaaatcttcccaggacgtcttctctctcgatcttcttaggtgataaattgggtcacagaggcagaaatcacaatttatgttctgcaatatcctgcagctcatccgaatatggaggctggaccacctgagtcaggagaatctacagatgccctcaagctttgtcctcatgaagaattcctgagactatgtaaagaaagagctgaagaggtgctatgctatctatatgaaatagaaaaaaaagaagagatatcattgctttccttcagtgcaccatttcttacagcactaaatgattgggggtggggatgacagtaaccattttcaataatgcttttactaagggaaagattatgtgacttcacaatgataccaatcctttctcaatccatgatgcagatcattttatcatgagttgaaagaaaattggtatttctattgctcctgtatttattcttgtaattatttggattttatggcaattgtagcattagccatggaataaacatatttggaggataatatagctgacttgtaattggttgcactctacttgaaaagtctagacatgaaggatacttgggaaatataattaaagcttgaaaaacattataaatttatgtgttaaaaatagtaacaaaatagctatgcttccaaaggcaaagacttttgctgtattcatttttcactggagtcaacgacaacatctcgttttgtatgaaatttgacctgaactttgaatgctaagaaagattggagtaggtgaagaagaaaagggagaagaaaaggcataggaattacctagtttcctcaagattcttaataacaatttcagatatgtccggttctttccctgggttcttgagagagagaaagtcagtgtcttttgatacaagttagagcagagaggagctgcatgaagacttgaaaaagcaacactgataggcataaggaggctgaaaggagacttgagtaaattaaatttattgcatctccatatcctgcagatctatccaataaaggagagaaacaaccgcacacgcctggctctcatcatatgcaatacagagtttgaccatctgcctccgaggaatggagctgactttgacatcacagggatgaaggagctacttgagggtctggactatagtgtagatgtagaagagaatctgacagccagggtaagaatccctcagccgccacaaacacatacatattcaagacacatccttctaataactacctagcttcaaagagctcaacaaggtttaacaacctttgggtgtgtgtgtgtgtgtgtgtgtgtgtgtgtgtgtatacaaaataagagtactagactggtaaatctatgtctctttggtcctccaaatatcctcaattctggaaaactagactaaacatgattgacacgtgttttcacatttcttattgaattccaaaatcatgtgattgggatgcagccccgagaatccccagaaaattgtagagtaatgaatgttaaatggcagtatacttataaaacaaatattgaatcctaaacttggtgctaagagctattcctaacgttgggaataggtctgtaaatgagacaggaagttcccagccagcattcatctaggttacagtagagagaaacagtgaaattgtaagaaaaaagacaacttcaagcaccaggtgtgcatatgtgtgtctacaaaacagcgacaagacagccaaaagtaagtaaaaagaaaataaaaaggaaatatgagacagaattgtagggtggggagcaacgtttttgggttggttggagatggctctggaaagacatgaatgcagcgccttcaaagtaggagacgccacctgtgaaagagctgagctgaaaatgaacctggcacatgagaagcacaaagagaagaccagtgtgactagaggttgaaggagaaggaacatagtatgagggtggtgtatggtcaggccagaagtttgattctattctaagcatagtgggatggattttacaaagaacatggtgtgttgcatttataacacatgacttgctaggtaaggagatagaagattgagatggaaaagaaaaagtaacatgagtaacacatagcaatatacaatatactaagaagacagtatgtcagcaggaagagaaaatgggaatccacggccccataaagaaggaaaaataaaaccattaaacagctgtcatgactgagtaagcactaagtgaagcaccacgacctggatgttacatatgtttcttgtttcgctcatggtaaatctaggagtcccctttaattgtgatgcttctctgactgaagttagacattgctcttttacaggatatggagtcagcgctgagggcatttgctaccagaccagagcacaagtcctctgacagcacattcttggtactcatgtctcatggcatcctggagggaatctgcggaactgtgcatgatgagaaaaaaccagatgtgctgctttatgacaccatcttccagatattcaacaaccgcaactgcctcagtctgaaggacaaacccaaggtcatcattgtccaggcctgcagaggtggtgagtgctgagactgaacatctaacagttatgaaggtgtatgcagaggattgtgatgtttggtttatatttaggggcaacattcttaaacctcatccagtgtaaagaaagtacattgaattctaaagaaactctacctaagggtctggtataacaagaaattgtctcatcaaaattagtggagaaatttctgttcaattttatccacagtaagtggtgaaggagatcatcagaatccctaaatcaaagttaaacagaaatactcaaactttggaatggaatcattttcatgatagcttgatttgtaaatgttttacagaaattttgacattgtgtggtttgagaagaatttcatttgaaactggggccattatgtaaaacagcatccctttttcttataattattgagggggaaattagtaaagagatcaggggactgtagaatgttgcagtgccactttgctccaaagattcaattgcctcatggctggctgaggatggtggctcatgcctataatcccaacactttgggaggccaagacaggaggatggcttgaggccaggaatttgagaccaattgtctgatagctcttgggagctatttttcaaaagaaaacagattttttttctagaaaatggtaaattcaagatgatttcactatcagtaggcacattgttgaatgacactggagagaaagaaaagtggtgtgtgtgtgtgtgtgtgtgtgtctgtttctctgtgtgtgtttgtatgtgtgtgggtctgtatgtatgaaactagtaagaatgaacattcaaaaagaacaaggtgggcaactgtgacagccattctgtgggaggcacagcagtgtgcagaaagttaatgtctccatagcaaaccgtggggaactgtgggtcagagactctccagcatccttggaagtggcctcttcacagtcatctgagaacctggaggaagatgctgtttacaagacccacgtggagaaggacttcattgctttctgctcttcaacgccacgtatgtatctttcagtggcagtaagggatttgtgggcctgaggccatctttgaatgaatctagaaaatcaagaatccctatgaaacaatgatctgatagaatgttgtgtgctctccacatattttacatgatcttatgtgtgccgtgagaacagattcctaaagcaacccgatacatggaaacccattcaccactcaccatttaaacagatgatgaattctgttttttttattaagcccatttaacattttacatagtgtttttatggattccaggaatggcttctctttctcaaatgatcaacttcaagtcttctttccatatttcacatctgattatacaatgagcagtgccattgcatgccctgctagaactgtggataccctttaaaacaagtagaaaatgatagggtggggctgattaggtctaatctcagggaacactggttagtatttcatgtctaggtaattatcttaaggagcgtacatttaactgtttttgatttgtatatttttaaatcttattttttaaaaccactttattgaggtatgattgacatacataatgttacatatttaatgtatacaacttaatgagtttggagatttctatgtactcctgaaatcatcaccactatctatgccataaacatatctctcttctccaaaagattcttacacttctctgtttattattatcatcattccgtgactgcgtgtgagaagtatacttagcataaaatctactctcttaacaaatttcaagtacataacacaatgttggttactactggcaccatcctgtacaatagatttttatcacttttttcagcttctatcactgaaacttgtcatgtgttcatctatttctattatacggtgaaagacagtgtggcataatctgcaaacaactttggagcctggtggcaattttttgttgcttactcactgtgtgaacatggggaagttccttcatctttctgtgcttctatttcttcctctgtaaagtgggataattctagttatttctcaagcccctataaaagctgagagaatgaacatgagttttgtagtagaaagccaatcccaagaatcaaaatttcttcaatacacaatctcttgcaatgcttaccaactgcaacttttgatcaccttttgctaggttttctgtttacgttctgtggaaagtaggtaaatgtcaggttgtaagtgcttcctacaaatctgtaaagataattcccaagctatgcttttctttttaaaaacattctcaaaacaaaaatatgaacaaaaacatagtgaaagtcatagcccaaggcatacccatctgtatcattatagacaacgtgtcctggagagacagcacaatgggctctatcttcatcacacaactcatcacatgcttccagaaatattcttggtgctgccacctagaggaagtatttcggaaggtaagtgtctcttttctagttactcatttatttcttcaggaagaatttgtcatgattcactttttacttcacaatgacaatttttgtcagggaagtgaaagtagagaggtacccagtttctgtcattcagttgtttaaaatatggctaaggaaaagacaattccaatatatcccagcagaagatcaaagtaaaataaaataatatcaaccataagctttatgttatggagcgtaagttcttaagttttagagaaggaaaaatattttgaaataatttttatttcttaatttattaaatgaataaaatctgggtggtctgctaggtcatggatttcctcctggtgacagaggggtaaatgaggcctacatgacgtaatcctatctaggactcacattttcgtgggagatatggatactgaaaatgtgggttaacaaacaaatatgtgcttacagattgtgataggatccataaagacatgtgagagggaacaaaaaagaagtcattctttcaataaaaaagtgcagaaggaaaggtttgctacttcttgcccaacttgggacattccttattcccactacttcctatgttatttttctccatagctcgtacatctacccactcagcaaatattaatagtttatttatgtgtctggttttttacttgtatttactcactaacatgcaaacttcgtgatggcagggatttgctcagcaattcaacaaacctggcacgtagcagatattcaattaataattattgaataaatacatgcataaatacacagataaatgcaccctcttgtttaaagagaaaatgggattggtattaacacagaatagtataattattaataaagtaaaaattgtagagaacagtaaaactcctgcgggaaaagaaagatacacctctggcgtttatagaagaaagccatccagaaccagcacagtcactcattcctgtaatcccagcactctgggagtccgaaggagggtggagtggcttgaacccaggaatttgaggccaacctgggcaacatggcaaaacccatctctacaaaaaatacaaaaattagccgggcatattgactggaacctgtaatccgagctacctgagagctgagatgggagaatcgcttgagctcaggaagcggaggttgca

SEQ ID NO: 652 - DNA, 9104 bp, Human
  misc_feature (1)...(9104): n = A,T,C or G
cccagctccgagcccacctctcctgcctccaccccttccacccgcagcccccgcctctcccgcagaactctccccaagccagaccgcctggaccggctgcttaagtcaggtgggactggggcctgtagggtggggatgggaacgctgagctattcatcaggaagatggaagaagtccatcactggtcagaggcatctgtctgtctttctggggggtggagatactgcttacgcaggctctaatgagagctgagctctggcacaatgaaaatctaatttaattaaacaggcttccccacacccagccagctgtaactctcatgtcctctacctccctggttcacccacaggctttgggacataccctgggaggaagcgaggtgctttgcacccccaagtgatcatgttcccgtgcccagcctgccaaggtgatgtggagcttggggagcggggtctggcagggcttttccggaacctgaccctggagcgtgtggtggagcggtaccgccagagtgtgagtgtgggaggtgccatcctgtgccagttgtgcaagcccccaccactagaggccaccaagggctgcacagagtgccgcgccaccttctgcaatgagtgcttcaagctcttccacccctggggcacccagaaggcccagcatgagcccaccctgcctaccctctccttccgacccaaggtgagccagcccttccaaggcctggggagggagggacatgctgctgcaggtgggtgggggtgcctggcattgtgggtttccaaaaggaagtgggaagggttttccaatgctaagcacctatctctgtaatctgtcacaaagtcactggacaaatcattcaacaactttgggcctccatctcatttacatccctgtagggggatggtagtatctgccctgcaatgtccatacctaaagggttgctgagaggatggtgtgagataatgtttgttcactaaaaagtgttacctgcacactgaaaaggtctgtgtgcattcactcactgaacaaatatttattgagcacctatgtgcatggtgctattctaggtgttggagatacagcagtaaacaagatggacaaggttaattattaactaccaggcaaagattaattggcatcattattactgttattaccatatatcccaatgagagagatgaagggaggtgcaatgctggtgaaatgggcaccgcccggagactgcaggaaaggctctttgatgccagtatgtaccaccaggtggcactgtggagcaccaccagcggatgtctccactcccatcttgccagtggaggagggcaccaaactgctgtagtggtagcatagcacccttacccacaccattgtctgaccatcacattgttctttgtgtccctagggccttatgtgcccagaccacaaggaagaggtgacccactactgcaagacatgccaacgcctggtatgtcaactctgccgggtgcggcgcacccacagcgggcacaagatcacaccagtgctcagtgcctaccaggccctcaaggtaaggaccccccttatccaaccctagtgctaactcacactcttaccctcttgcacctcctcccaactgctggcttctgcagagctgggcttgatgcccacctctttcttccccctcaggacaagctgacaaagagcctgacatacatcctgggaaaccaggacacagtacagacccagatctgtgagctggaggaggccgtgaggcacaccgaggtgagggagggcacagaggtaggccctgggccctgcctgggagtaggggcaggaagggggtgtgggtgatcatgacccaatcaccttgttgctagctcaggaagcccgtgaggtgtccaggttctggttaaaccaggtttgcaggaacaccagtgccccaggccaggctgtacctgggctgcaggagggggcagggtggctatagctcaggagagtgctcgaaaaaccccatgcatagctcaaaaaaccccacgcgtagctcagatgctctcaggctcaggtgcctaccgaggatgtcacgcattcccagtgctagagtgaggtgatgactgataccttctgccaggttgcttgagctggctgacatggggatggacaactaaggatggcatagatgccagtggacattaattagtgcagtccaagtggacattagggtagccatggcctcgttcatttggatgagtcactaaggggcagagattatgatgtggggttccgggaaggttggcacaaatgaccaggagttgagtccatctagaggtgcctttgcagccatgagcccaggccctgtaggaatgggtgagtaggatttccccagatcccttgtgaccttagccatgctgtggcatccaaggaggccagcacaagtgctgcctccaaaaagaagatagtaagtcacgcatcctttgggtgttgctccctgggcaggtgagtggtcagcaggccaaggaggaggtgtcgcagctggtgcgggggctgggggctgtgctggaggagaagcgggcatcactgcttcaggccattgaagaatgccagcaggagcggctggcccgtctcagcgcccagatccaggagcaccggagcctgctggatggctcaggtctggtgggctatgcccaggaagtacttaaggaaacagaccagccttgctttgtgcaagccgccaagcagctgcacaacaggtactcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccttcctccccagcagcgggcccggggggcagtgcctaccggggacctcccccggcctcctgcccggcctggccagccattcctcccacccagcccaccctgccacaccgtcctaccgcgctcagcgctgcttctccctctctttgtttgtaggctgtggccaccgcggactctgctccggagcaccccaggcaagtcagcggccctgccccgggggccctgcccgccgccgggcccccttcccacccgctgctcccacgcatctcagccaaccactcattgcttccttctctttcctgccttgccccgacctcgtggtcctcccactggaccaatgccctgtctcccttctgccttctttaggcgcttgcgtaatcctggcccttctgaccttttgtccttgtgacccttgccctctggccttgcacttcctttcccttgacctccaacccctgccctcagcttttgctgtccctctgttgtccccactttccacctcgctgcctcctaaatctctcttctgagcctggtccccttccttcctgctcagcgccctcttgcctgtgggctccagtggcctttgcctgcccctccctggggctcctcttaattcatagaatatctgagctgcaagggcccccagaacttacctgatctgataccctcatttgacaggggaggaaactgaggcccagaaaggggaagtgacttattccaggccagagtgaggtagcagcagcccagaactagcacacaggtgtcctgacccccagcccagcgctttcctgcctcgttctctcttgggccctgccctacccctcctgtgcccagttcccagatgagcccttccccagctccctctcacccacactcacccccccggctcccgctgctttcccttttcctgcctgcccctgccctccatgccaggccagtggccaggccctgactgacacccgctgtctcttccaacagtgcctgaggcccccgtcattgacacccagcgcacctttgcctatgatcagatcttcctgtgctggcggctgcccccccattcaccacctgcctggcactataccgttgagttccggcgcacggatgtgcctgctcagccaggccccacccgctggcagcggcgggaggaggtgaggggcaccagtgccctgcttgagaaccccgacacgggctctgtgtatgtgctgcgtgtccgcggctgcaacaaggccggctacggcgaatacagtgaagatgtgcacctgcacacgcccccggcacctggtgagtgggcaggcacaggtggtcgtgcaaagggcatggggtatgccagggcctaggccctgacggttggttccggtggccgctagagaggccatataacatagtaggtctcacacacactagctctggagctagactgcttgggttcaaatcccagctctgcctcttgccaactgtgtgggtggcttctggcaagtttttaccctctctgaacttcagagtccttttctgtagggataacgataatactggccaggtgcagcggctcatgcctgtaatcctagcactttgggaggccaaggagggaggattgcttgaggccaggagttcaagaccaacctggccaacacagcgagacccgatctctaaaaaaataaataggccaggcgaggtagctcatgcctgtaatcccagcactttgggaggccgaggcgggcggatcacaaggtcaagagtttgagaccagcctggccaacatggtgaaaccccgtctctactaggaatacaaaacttagccaggcgtggtggtgcgtgcctacaattccagctactcgggaggctgaggtaggagaatcgcttgaacctgggaggcggaggttgcagtgagctgagatcgcgccactggactccagcctggacaacagagcaagactccgacgtctcggaaaaataaataaataaataaataaataaaggccaggcaaggtggctcacacctgtaatcccagcactttgggaggccaaggtgggtggatcccctgaggttgggagtttgagaccagcctgaccaacatggagaaaccccatctctactaaaaatacaacattagctgggtgtggtggcgcatgcctgtaatcccagctacttgggaggctgaggcaggagaattgcttgaacccaggaggcggaggttgcggtgagccgagatcgcgccattgcacttcagcctgagcaacaagagtgaaactctgtctcaataaataagtaaataaaatacgtaaaaaataaattatttttggctgggcacagtggctcacgcctgtaatcccagcactttgggaggccgaggtggatggatcacgaggtcaggcgttcaagaccagcctggccaacatagtgaaaccccgtctctactaaaaatgaaaatgaaaataattagctgggtgtggttgcaggcgcctgtaatcccagctacttggaaggctgaggcaggagaatggcttgaacctgggaggcaggggttgcagtgagccaagattgcgccactgcactccagcctggggaacagtgtgagactccgtctcaaaaacatatatatatttttaaaaaatgataatgcttacctcatagagttgcaagaattcaactggtttgagacgatcaatgggagtctgagtacagtgtccggctcatggttagggctcaagaatgttactaaagtgactagaaaatagttcggactccagggggtgggcataagagggaagccttgccacccaaataggggctgggtataagggccaggtgtgaacccagagtatgggctggaaggcacagattgatggtgatgggaatgtcaccaggtggaacagaatagtgggaactgtccatggggctggccacaagtaaggggttcgagggagccccatgagtcagccaggtccggagcactgacttctgtgcccactgccatcacaaaaactctctggggtcccacgcccatttggaatgcccccttcttttttcctcatgccccccattccagtttcccatgtcctgttctcctgaaccccctgcctgttcctggtgactgaacccccttgcaacgcgttccctgttctgcagtctcacagcccccagtgccagtgtttgtccctgaagttcttgctccatctcaaccctctccctccttccagtcctgcacttcttcctcgatagccgctggggcgcaagccgagagcggctggctatcagcaaggaccagcgagcagtacggagtgttccagggctgcccctgctgctggctgctgaccggctgctgaccggctgccacctgagtgtggatgtggtcctgggcgacgtggctgtgacccagggccgcagctactgggcctgcgccgtagacccagcctcctacttggtcaaggtgggcgtcgggctggagagcaagcttcaagaaagtttccagggtgcccccgatgtgatcagccccaggtcagacccctctggaagggatggggtgtgggggtcctggtgggagtgaggggcacagaaggggtggcaagtggagcacagacttgctagggtggggctgggaggggattaggaggaagtagtaggagcctggaagccaggctgggaggcctgtgtccaggagacgcatgggctcagcaaaagggcttttgaggactgattttcagagcatgtcgtgtggtcagggaaagggatgatagaagagggagccatctctgcttccttccaaccatctgtcactctggatcaacacaccatctctccaagcatctgtgtcctttcttcctaacactccatttccaacataccttctccataaaacctttgctctccaagacctccttcacccgtatcttaaaattcttcccttagccggatgcggtggctcacgcctgtaatcccagcactttgggaggctgaggcaggcaaatcactggaggtcgagagttcgagaccagcttgaccaacatggagtgaccccatctctactaaaaatacaaaaaaaatagctgggcgtggtagcgcatgcctgtaaccccggctactcgtgaggctgaggcaggagaatcacttgaacccgggaggtggaggttgcggtgagccaagattgtgtcattgcactgnnnnnnnnnnnnnnnnnnnnaaattcttcccttaaacatcccacctccataaccctcctctccccaactccctgtttttttttttttttttgaaatggagtctcgctctgtcgctcaggctggagtctagcggcgcgatctccgctcactgcaagctccacctcccgggttcacaccattctcctgcctcagcctcccgagtagctgggactacaggcacccgccaccatgcccagctaattttttgtatttttagtagagacgggctttcaccgtgttagccaggatggtctcgatctcctgacctcgtgatccgcccaccttggcctcccaaagtgctgggattacaggcgtgagccactgtgcctggccccaactccctatttaacaccctcccactaatgctttgcatcctaaaccttctccccagcactctatcccccaacaccttatttcttcaaaatgctttctccccaacacaaacccctcctaaaccccattgtccccaaccccgcatacctctaacacccttcatttgtgacaccaatccaccctcatctctctcccgacacccaccttcccaacatcctttctcttcttagtcactaatctcggattcttccaatgtcctctaatcctcagaaccatctccccagcatgatttccccaagaccatttttctcaatgcctttccgcgggctataccaatgccatgtctttcctgtccgcctgcccctctcttgccaatgtgctttcctctcagtgctctctttccaccaaacccaaacccctgaccctatactctaacccctgcctcttcagcgttttcttctcaacacccaaaatccatcccttcaacctcttgctccttaacattccatccttccagcgtctccctctggtacctcatccgtcactccatccctcaacaatctcgtccccaacacccgcttctgcaggtacgacccggacagcgggcacgacagcggtgccgaggatgccacagtggaggcgtcgccacccttcgctttcctaaccattggcatgggcaagatcctgctggggtcgggggcaagctcaaacgcagggctgacagggagggatggccccacagccggctgcacagtgcccctgccaccccgcctgggcatctgcctggactatgagcggggccgggtttccttcctggatgctgtttccttccgtgggctcttggagtgccccctggactgctcagggcctgtgtgccctgccttttgcttcatcgggggtggcgcagtacagctccaggagccagtgggcactaagcctgagaggaaagtcaccattgggggcttcgccaagctggactgagccttccaggcccctcatgcagacctggggtcctcctgggccctggcccccaaacctcttggcacccggttgttaccccctggcagcttctcccccaaactctcctaccatgtggccctgctccttctcccgtgtctgtcttcccacagttttctcttgacccaggggctctcttctgcccacctctctggatggcccccgttctctccattgcttgttagccaggcccccacccccactgagtctgccctatgacctgcctttggcatgttacccaagccatggagagagccccttctccatccctgtcctgtgccccccaggctgattgggagggagggcacctggaacactgggcatgatctccagctctgcccttgccctgccaagctccctgccctgttgatgctgaactacagccttggga

SEQ ID NO: 653 - DNA, 33515 bp, Human
atcgggtttgcaaaatccagaagaatgaaggtctagaggtgtgtctgttcctctgtgttcaatacagcaactgttagccaggaatatgtattaaccaaagaccacttaagggaggatacgcagcatatgtaaaacacaaacaacataaacagaaccataatctcctaggcccctagttttcagtttaagatcggactcactgcgagctcctaaaaggcatgtttgttctctaaataagttttcctgttccaggctgccagatgagatgtcactgccaaggcagccgaattcactgcaagtttccaggatcaggtttccttggaacaggctcgcacatggcctctgtcttctaaagctgattgctttgccatggtgagtgctgactgcaaagtgatctagccacactcttgcataatacttccaatggttgtatagttagaggcgtacatagggcatgcacttgactaagctactgggtttaataatcccctttcctgaagtccattagacctcagttctacaaacctttagctggatggtttaggtataagtaggactctagaaaaggagatggggctatcaatctctgtgggcctctgatatcaaaattttcatatgacattatggtgcagtggtctttgttaactagttaccttaaaatgctctatcaagggattagttcaacatttatttgacaaacatattttgagtaacagatgggttattagccactacaacaaaataatgaaaaatttacctatgcagagttcatagtcaaatgcaagaacacaataaaatagttagaatagaaacacaatattataatatacagtcatgtatcacttaacaacagggatacattctaggaaatgcatctttaggtgattttgctgttgtgtgaacatcgtagagtatacttacacaaatctagatggctacaaacctgtataacatttactgtacggaatactgcaggaaattgtaacacaatgataagtatttgtgaatctaaatatatccaaacatagaaagagtacagtaaaaatatagtattataatcttatgggaccaccattgtgtatgcggtccaccattgaccaagatgttctgttgcagtgtataactgtagataaattttttggttttgttttacaatagcaatccatacaaaatgctgtggaaactccaaagaataagctgctggttaggtctgtcttagggcacggaaaaagtcatttggacaaaattaatacaatatttttcacaaatatgacgtagctaccaaaaataagctaatatgatcttggagttcactaatagaagtataaccatctagaagctagaatagtagacacaggtagtaactactttgagcttacccaactatatatggagtattgggttcaatttgggaccagcattaaaaggatattaagaaatcatagctcattcagaacagaccatccacattggagaagatgagtaatatttagctcgactggaatatccagagaggactccagaagaaacatgctagcagtcagcaaatatctggagggcttttaatggaaagatgcataacatttattccataagacttcaagagtaaattaataaaagaaaatacataatagatggaaactgtgagtatattaattttgactaaagttagaaagatcctccaaagaatccgagccatctaaaagataaactgcttcttgagttgataagagtatcaccatacttaactgaggctgaaccttccatacagaatattgcaaatacacacaagcatcacttgggtggttaggctgagtgattttcggtctcttccaaaccttaggctttatgatttggagttgtggttttaatattatacattatttccaaaacatagcaattaaagtagatggctgttcttttcatctgtcccttccaattgtcttatgactagtgcgtgacagtattgggtaatgaatgagtcacttggcaagtgacagtcttaacgtactacaccaaggtctttggaggcatgtaatgaaggtcaataataatctcctccttctccaccacccagattttaggattcaaaacttttgaataaactataccaagaaataaacaaagttggcacgctgatgtagagcaaaccatggagttaagactgggaaagaaagagcatcaggaagagccaagccatgcagtgaaagatacaggggagtccctcaacaagaacagagataaagttgatccttaatgcagtgtttactgcgtgccagacactgtgctaggagctttatctctacttactcattcatcctaccagtgaccccgtgactaggttttataataatcacccccaccttgtgacggatgaagaaacagtcagatagaggttaagtaataatgcctaagatcatgcagctagtaggctgggatttgaattcggttaccttggctctagaatccgcacacttaacacctaatcacactttacaaagtatctctaagctgaagagaaagaaatgagtcatggaggaaagaaatcaaggcaattgtaaagaaaattgactaaggaatcacacactagcaatttcaattctcgaaattctacttttcaaagacaggtaaatgactaccaacatgaaggttttgtgtaaacccagtaaaaaaaaatttcttagcacaattttaattctctcttagaatcattttaataaattcactttagaatgtcctttagccaacttgacattcctgcctcatggatctgacctgacaccccgatgataaaatcctgaaaagattcattttgcaaccgtctgcagggacaaagagaagaaagtacttcttatcatcattgtctctgtaccaaaaccccagctcggatggatgaatgaggactcaggagcccacagactcagagcaattagaaactattacgtcctgcacatggctgggtgagcagtgggagaatatttacaatctcagaatgacgtttcaccacgtaagcccttagccctaatctgcatctgatactgtacatcaagataacataaggctccatcttctccagatcctagatattttactcctcctaatctggtatagtcagtggtaagtgaagaaagagcttgcaaacattcgttatcatttctagtgtgctgtctttgcagaaaccttaagtcaagctgctatgcagaaatttcagcctctcttttctgcctagccagcaggatgtatccttgaacttgaaggtaggagctgactgaattctacctttaccaattatatttgatatgttccagttaagttttacagaatgcagcatatgatataccaacggattattaacatgcattagggacatcatacaaaatttattttggtggatgtgacatttccaacaatttctaaaattcgtttactgaaatcctatgggctaatcctaatcaaatcctacctagagccactgggacaatagacaaatgaaagtccaaagtaaaattccaactattgactgtgaattcaagcccaaacaccaggaaggtggagaactggcccacagggaagtttgagaaacatctaaaggcatctgcaagccctaagcatgtgtcatttatttatacaatgtgtgttttagaacgcggaaaaccataaaattggacagaaaacctctaataagaatcaaagcgaaagatctgtggtcagtaggggtgccaaggggagaagggtggggaatggttccaccccctcttcctccaatttctgactcacaaatttaaagcaattagaagcaagcgtctcttaacaaaaagcatattcactgggtgaaagttattcaataatattttcctccaagtgtcccactgatggaatcattgcacaccactgcatgggtaaagtgtaattttaccaagccaattccatatttagcaaaggcagtcagacccttctgcctagattaatactcagtactttttcagtcttttaatctttcaaagctgtaaacgtaatatttagcgtggaaatacgtattttattatattaaacagaatgactttgttttcttttttattcaggtgtaaagtgcgtgaatcttaacccgatgaattttcatgtgtattcattggtgcagaactacttaaatcaagatatagaacattccagcatcccaaaggctctgtcacatctcttccccgttactgttccctgtccttgaactttgaagcaattactgttatactattctaaatttcatcaccatcattttgcctgtatttgaactttacacacacacacacacacacacccacacacacacgcacgcacacacacgagtaggtacttttgtgcctggcctcttttgctaaacatttttcagtgagattcacacattttctaacatgcaacaattgtttgtttcttcctgttgcttgtagtagaatccattgtatgaatatacccgaactcatttaccaattctactattgttgagcttttgggctgttttcaggtttggtttatgatgaatatagttgcgatgaacattcttggaacattcttgcatattccttttggtggacgaaagcatttgcttctcttctatatgtaccttgtgtgaggtatacagatgtttagctttagtttaatcctgcaaaactatttttcaaagttatctttccaacttatacccccaccagcaacgtatgagacttctagtcgctccacattgtttccaacagtgtgtattttcaggctttttgttttgttttgttttgtttttaactcatcatcttgatgggtacatcatggcatctcaataataggcatttccctgataactaagagactgagcactttttcatatactcattccattacgcccattgggtaacttcttttgggaaggatctattcgagtcttttggcccatcttaaaattcagttgtttgtctttttctaagggtttgtaggtttcctttatatacggatataagctctgcaaatatattctccgtggctgtggcttgccttctcattctcttttgatgggtagttcttgcgtatttattagttttgtttttgtggttagtgtttttaaacagcagtttaagaaatctttacctaagcatagaagaggacgaattaagtacaagacacatgaaggcttatcctatcattctgaagttatactgcttgatagacttgtctgacattcttgataattagtttcatgtctatactaagcaaacattcttaaccatactatattatttagatgaaaatatttcttcctccctatatattatttgtataagaaaaacatattaaaaattacttggttatggccaagagcaatggctcatgcctgtaatcccaccactttgagaggccaaggtgggcagatcacctgaggtcaggagttcgagaccaacttgaccaacatggtgaaaccccatctgtctgtactaaaaaatacaaaaattagccaggtgtcatggcgggcaccagtaattccagctgctcaggaggctgaggcatgagaatctcttgctctggatgcggaggttgcagtgagctgagattgtgccactgcacgccaccctgaatgacagagtgagactttctctaaaaaaaaaaaaaaaagaaaaagaaaaaatattactgggttatgtggggagagggggtgaataggcagagcccaaggatttttagggcagtgaaattattctgtatactacaatggaggatatatgtcactatgcatttgtcaaaacttatacaatataccatatcgagagtgaatcctaaatatgggctttgggtgataatgatgtgtcaacatagattcattgattgttaacaaatgtaccacttgagggtggaatgttgattatgggagagattatgtacgcgtgaaggtgggagacatatcgtaactctctgtactttctgcttaattttgttgtaaacttaaaactgccctaaaaaataaagtctacttttatcgattttgtttatcgtttcaaagaaccaatttttcctttcaccagtcctttttgttgatttttttctctatttcatttagttctgctctgatctttatttatctattttcttctactaattttgggtttggtttgttcttgctttttcagctcttctaggtgcattgctggattgctaatttgtaacatttccacttttttgacataggcatttattgatataaactttcctcttagcactatttttgctgaatcctataggttttgatatgttctttccattatttgtttctagaaattttttttattcccaccttaatttctttgttgacccagtggtcattcaggagcatgttggttaatttccatatatttacatattttccagagttcctcttggtgttttgtttcgttgaatcggagtttcactctgttgcccagactggactgcagtgatgcgatcacggttcattgcagcgttgaatttttgggctcaagcaatcctcccacctcagccttcctagtaactgggactacaggtatgtgccatcacactcacacccagctaacttttttgttttttgtagagatgggttctcactatattgcccaggctgattgtgaactccagggttcaagtgattctcctgccttggactcccaaagtgttgggattgataggcattttggtattgatttttggttttatttatttatttatttatttttttgagacacagtctcaaccgattcttctgcctcagcctcccaagtagctgggattacaggtgcccaccaccatgcccagctactttttgtatttttagtagagaaggggtttcactatgttggccaggctggtctcaaactcctgacctcagatgatccacccacttcagcctcccaaagtgctgggattacaggcttgagccaccgcgcccagccaagatattacctgaacttaacagacttatatgcaatggtctcacagagcactaccttgtgcgcacacaaaaaaccatatcatacaatcaggtaagtacatgtgttttctccacatttatagaaacttaccagggcaatatgtttttaaaagtacaaaggcccctttatatgacccactaaagatagctaaggtgtttgaggtgaaaaaaggtctaccttcatctccaacttttaagaaaagcagcaagcatggtgattacggaagggaccagtattcgaatcctggctctattacttactggccaactaaccttggacatgtttcttaaacctctctgagcttctgttttcttatctggaaaatgataataatagtacctatcttatagggttgttgggaagagtgaatgaattaatgcatgtaaattattagtaaatgttcaataaatgttagattttattattattgtcatagagtatcacatttggtatagttaaaattatactcagttttagatgaagaaacagtataagaaaagttaagcttacataacattagcagtagaacttgtccttcaacccacatctattttttgttttgttttgttatttttgagacaagtcacccaggctggagtgtagtggcacaatcacagctgactgcagccttgacctcctgggctcaagtgatccctccacctcagcctcccaagtagctggaactacaggcgcacccacctggctaatttttgtatttttagtagagatagggttttgccatgttgcccgggctggtctcaaactcctgggttcaagcgatccacccgccttggtctcccaaagtgctgggattgcaggtgtgagccactgcgcccggcccacatctgtattttcatgggctttcaattcaccatgtgcaaattgcaaattatttactcttcaccagcattgacaggtctgaatttgggtaaaagttaatgagaaataaatacaagagatactaaaacttttcacgaaacttcttgagttacaccttctatgtaattcagtattaaaacaaacatttaaatggatcatgtctcaaaaggggactcattggtttaaactagattcaaagctccttgatggcagaggggtatcttctatgtcattagagtaatcataatagtagagtgctgggcatggcattgatttaccgatcacagagaagactttttaaagcaatttatctagagatgctaccttcaaaacgggttacattttagatttataaagttttgaagttttgcttacgttctctagagcctggtgactttttttatttttttaggtggagtttcactcttgttgtgcaggctggagtgcagtggcgtgatcttggctcactgcaacctccgcctccctggttcaagcgattcttgtgcctcagcttcccgagaagctgggattacaggcgcccaccaccacgcctggctaatttttgtatttttagtaaagacggggtttcaccatgttggccaggctggtctcaaactcctgatctcaggtgatccgcccaccttggcctcccaaagtgctgggattacaggcatgagccaccgcacccagcagacttctaattcatatacatttttatttctgctatggaatgtgaagtgttttacagcaccagtgactcattgctgatgttactgctagaacagtggttcttggccgggcacggtggctcatgcatgtaatcccagcactttgggaggctgaggtgagtggatcacctgaggtcttgagttcaagaccagcctggccaacacggcaaatccccttctctaccaaaaatacaaaaattagctgcgcatagtggcacatgcctgtaatcccacctacgaggggcgctgaggcaggaggattgcttgaacctgggaggcagaggttgcagtgagccgaggtcatgccactgcactccagcctggtcaacagagcaagaagactctctcaaaaaaacaaacaacaacaacaacacaaaaacgtggttctcaaattttggtccccagacaaccagcagcagcagcacctgggaacttgttgaaatgagaattcctgggacttgccccagccagtctgagtcagagaatctgggggatgaggccaagcaatctgttttgaacagtccccaggtgattctgatgcacactaaagaagcttggaaagaatgtgctggagaaaaaggattatcatcttacccatctgagtacgtagggtaagttgacttatttattaataaagtgaacttcaaactctagaaaccatatcaaagataatcattttatttgaggtcatttgatttgtttatctgtttattggactacaaaatatacgattcaaactttaaaaatccaaaatgatatacaaagaaatttctcggccaggcggggcggctcactcctgtaatcccagcactttgagaggccgaggcgggcagatcacttgtggtcaggagttcaagatcagcctggccaacacggtgaaaccctgtctctacaaaaatatagaaattagctgggcgtggtggcaggcgcctataatcccagctactcgggaggttgaggcatgagaatcgcttgaacccgggaggaagaggttgcagtgagccagcatcgcaccactgcccttcagcctgggtgacagagcaagactctgtctcaaaaacgaaaaaaaaaaaacctaagaaatttctccctttcactcctatgtcctagtggcaaaccaagatgataggttagttttgtatatttccagggttattttattaacatagtaacaagtagatgtattctttcttttctacacaaattatagcacaatatgcagtgttcaaatgcagccatctttaagagcactcaaaggtatatggtttcaacactggtgggcttttccacattttgcaaaagagatgtgctttctggaaacttcttaaaataaagatttgttttgcacttacgttcttccattaaacaaatgctaatactgtatactaacaatgtattttctttttagttgactttcaaaaatctcatttaaacaattgaatatatagagttatcaccaacaccaggtactatttcctctatattattttccaaaaactcattcttctaccaatgccacactttcatcttagagagctggttgagcttttggattaaaatttaagccatgtgttgttcatccaataatgctagaatttattccaaattacgctgaaggccatttgctttttgcctccaagcatcaagagttatattgaaactcctttcaaatttacttctattctgtttgcccacatctggcataatgccagttcatttttaactcaaaaaaacaaccatgttctcttctttcctcttttagcaatattaccatcctgacacttgatccctgcaagcaattatctgatttcttcacgtgtccctttaatattctttaaaggagtcaaagcatttaaaatagcccttttgtctgtgccaaatgttcccagctgtctcaaaatatgaaccaaattatgtaccaagggatttatcttttgaaaatgacatctacagtagtgattctaaatttcctaacttagaattcaaggcccacaatatcctgctttttcagagctatctcacttgattgagctttccaccccataaagattgtcatttttagtttcctgtatctttgtggtatatttctttttctgtgtcttcatgaaggccgttctgctatgctcgtctatcaacttgtttcctactccatctcaaggttttgccatgtgatcgaaaccctccgagaataagatgctttctaatttgtatgtaggtacatttcatcttattgacctctatagccatcctgtgatataaaagcataagcatggttacccatgtttcaggtgaggaaattgaggcctagagggctcagtcatcctggattcttctgcattaacaagctgctctactcacttggcagtctgtactgcctcacaatattacctttgtacatatgcatgacttgtcatcataactgcatctccaaggcagttcatctcattgttccttgtattctcccctgtgacttgaacataaaaggaattcagtaaatattagctgttcgacttgttagaagccaagagtcataaaacttttggctcaaagagagcctttgtgattatttaatgaatccttgagtttgtcaaactggtttgaagtctgtatagcactggaggtaataggtacaatgccattccttttgttagaagacatgagataaaattattttaattttaaataaatactgacatataatggtatggaatattaacattaaagttgtaaaatgaatcataaaacaagttttttagacaaaacatgaaacttcaaagaaactccagaggaatatcagaactgtaattagctgtttcaggctatcccaggcttctggaggtgggaggagggggtaaatattgaagtctggagaggttaagcaaattgccctaaatcacacattaattcaatcaatattgattcagcccccactactaattgtgtaaacaccaaggttgcaatgacaagcaaaacaagacattgaccacataaagtttgtatgtaagtggaggtgagaggaggacagcgttgttaaattaatattcaatatgcataaactatataaagcagcccctctcttggtcagtccagcagaaaaaaactttattgcaactcttcagaaaatacccaagagagtccatcttattgcaaaacagaaaagctttaacatcttttcctgtgtcttacattctcagtgtttctctttccagttactcactgataaaaatgaattttcctaagttcttcctgacccttggcccgagaagttcttagctctttgacctcttactcctatcttttcctcttcttccatctgttctatcctcaatgcaaatgaagctacctcctggcgagagttttctttagtgattgtggtggtggaaaaaaatatgaaatcttatgaattggttttttgttcctgttatatttttaagtgacacagtacagtagatgtaaaaatgcagagaatttgacttaggctggggttagggaagaatcctttgatgaaataatcttttaagggaggcttggacagttaaatgagaaccgtattaacaaagaaaatgacgtaagaagatttcaggcatagggatcttagtcaaggagactccaaggtaggaagacacagggaaatgacaaaaggccattatggctagaatacaaggcaagaagctgccaggaagaacctggagagggagaaaggagtccaacgatccaaagcctcgtggaccacatttaggatttgatctccttctctgagagcgttgagaagccatcaaaatgaagcagggccgggcgcagtggctcttcactgtaatcccagcattttgggaggcaaaggcaggcggatcacttgaggtcaggagttcgagaccagcctacccaacatggcaaaccccatctctactataaatgcaaaaagtagctgggcatggtggcacacgcctgtagtcccagctacttgggaggcccaagaatcgcttgaacctgggagagagagattgcggtgagccgagatcatgccactgcactctagcctgggtgatagagtgagactctgtctcaaaaaaaggaaagcagggcagtgacatgaccagatttgcattctgatgcaaaggattggtggggactagaaatttggggagaacaattgataggtttctgttgaattgagatcatgtcaggggagatggaaagcagaaaacttccgaagttctttgggaagaactggtcaggacttagtgatagattggatatggatgtgaaagacagagaggtcaaggacaacttctaaaacctctggcttcagtaactgcatggatgatggtgacacacatggagagaggaaagttagaagagcaccagagtttgcagggtaattttgaaagtcagatggcttaaaaatgagacagaaaggaaaaaaacaaaggcaatagtgattttgccccagcaagtcatgaagcttccattttttcttgaaattcttgcttgaattatttatttatttatttatttatttatttatttatttatttatttgcgacagagtctcactctgttgcccaggctggagtgcagtagcacgatctcggctcactgcaagctccgcctcccgggttcacgccattctgcctcagcctcccgagtagctgggactacaggtgcccgccaccacgcccagctaattttttgtatttttagtagagacagggtttcaccatgttggtcaggctggtctcgaactcctgacctcatgatctgcccgcctcggcctcccaaagtgctgggattacaggcgtgagccaccgtgaccggcttgaatgattttttatatccatttatctcctcaataacaatctaaaaggcacatagaaagcactttgaatttaatttgttattttttcattgacattgaaagaatgacatatacatggtatcatttagtttaataaaataggtaggaagtgagctcattctcaattttatatattatattatgaaatgtaagtatcgtgtatgttcataaaatgagtaggtaagagatattcagggtatctgtcactatataacaaatcactccaaaacgtagcagcttaggaaaaactatattattgtattactatttctcatgattttggggttcaactgaaagaatggagttattctctaaagcttccatagtcacatatctggctggtgagttgatgctactgaacttttgcctgggacacccacgtgatggaacacagtcacctctccatgtggcctcagtctcctcacagtgtgggagttgggttccaagactgatcgtcctaagagagccaggcagaatctgtgttaacttgtaggacctaaccttagaagtcgcatggctaaactgctatatcacaggcctgtctggattcgaagaaagggaatatagtccccatctctcaaagtgaagagtgacaacttgcatgataagatgagcaggtagaacgggaggtgttgttataaccatcttggcaaaaacaatctgccataacagagaagagcaaatggaagtacactcttctttgctggacagtatctataatagcacttgggaccaagtaagtatttgttcaatgaatgactaagcaactagaataggatacactatcttccaactctgattcttgtttattacttttcatagttactctttggctagaatcttaagtataaagagaactaaactaacggaaaaaacttcagattgaatagtcttatgaagttcagatttattattaatatattatatatttatttataaatgatatataaatagtatattcagtggctcatgcctgtaatcccagcactttgggaggctgatgcgggaggatcgcttgagcccaggagttcaagaccaacctgtgcaatatagcgagactgcatctgcaggaaaaataaaaaaaaattagctggtcatggtggcatgcacctgtcgtcccagtttctcaggaggctgaggtaggagaattgttcaagcccaaaaggtagaggctgcagtgagtagtgattgaaccactgcactctagcctgggagacagagcaagaccctgtctcaaaaaaaaaaagtatgtctaattacttattaagtataagtttagtcttcatatttttaaatattctaattcatctgaaataaagtattgtaaattcaccttaagagtaaaataataaaaatataaattattataatgacaaatatttcatttcagtggtctggtggacagagactaaatagttagaataatcaatgtggtgggcttaataatggcctcttaaaatgtccatgttctaatgcccagaacccatgagtgtgcccttatacggcaaaggaatgtcacaggtgtgacgaagttaaagacttggggatgagaagattatactgaattagccccatgggtcctaaatataatcacaggttttcttcaaagaaagaaacagagggacaaattggactctgttagagcagaaggcaaagccaaagacatattggagagagggaatgggaaagggaaagaaagaattctctcctggaacctctcgatggaaccagtcctgctaatagcttgattccagccctttaagactcatgttagcctctgacctccagcatggtgacagaataaatttgcgttgttttaagacactaaatctgtggtattttgttacaatagccatagaaaaccaatacagccaacaaaatgataaaatggggaaaaaaatttgcatttgaaataattcaaagccacatgttcttcagctggcataaataggaaatagatacagttaatttaaaatgctgaataaagattataggtattaaaatgagtgtatatgattgcaaaaccctatgcaatctatgttaacatttttccttttgaggctggtagtgtagtaaacaaccttcctccttccgttccttctgtccttccctccctccctcctcccttcctcccgccatccctcctgatatagtttggatgttagtcccttccgacgctctgttgaaatgtaatctccagcgttggaggtgaaacctggtgagaggcaactggattacaggagtggatccctcatgaatggctcagcgccatctccttggtgatgaatgagttcttgctctgagttcactcgagatttggttgtttaaaagtgtgtggaactggagatccttatgttaagtgaaataagccaggcacagaaagacaaacatcacgtgttcttacttatgtgtgggatctaaaactcaaaacaattgaactcatggacgtagagagtagaaggatggttaccagaggctggaaagggtagggctgggaggagggcagcggtggagggaaggtggggatggttaatgggtacaaaaaaaatagaaaaaatgagtaagacctactatttgatagcacaacagggtgactacagtcaataataacttaattgtacatataactaaataactaaaagggagtatttagattttgtgtaacaaaggataaatgcttgaggggatggatacctcattctccatgatgtgattattacgtattgcatgcctgtatcaaaacatctcatgtaccctataaatatatacacctactatgtacccacaaacatcaaacatttaaacatttaaaaataaattttaaaaaattaaaatgagagtatgtggcacctcccccatctctctcttgcttcccctctcgccatgtgagacacctgttccccctttgccttctgttatgactggaagcttcctggggccctcatcataagcagattcgagcaccacacttctttttttattttttttttgagatggagtctcactctgttgcacaggctggagtgcagtggcatgatcttgggtcactgcaacctcctcctcctgggttgaagcaattatcttgcctcagcctcccaagtagctgagactacaggcatgtgccaccaaacctggctaattttcgtatttttgttagagacaggatttcactatgttggtcaggctggtcttgaactcctgacctcaggtgatctgcccgcctcagcctcccaaagtgctgggattacaggcatgagccaccgtgccccgcccagcaccacacttcttgtactgtctgcagaaccatgagccaattaaacctcttttctttataaattatccagtttcaggtattcctttacagcaatgcaaaaacggtctaacccacttccctccctcctttctttctttttattcatatcagtatggactcatacattctaactttactcaatagattttaacccagtattactattatttatattaatgtgcaattttgccagtttgggttagtgggaaccacttcaagccaacccgtgtccttttgatatgtggctatcatattttgagcctatccttacagatacaataagatgttcctgattcatcttccacttttcctgctctagttttgggatcagcatttcttcaaggttccatttattagagtaaagatatttacagacaatgatctgggtagcagctgtgttctttgctgaaggcccttctaggtccaatgagtggatagatttaggaatcacatacacttacatagacacatctaaatacatgtatatacacatctatgtatttccataactattgctacctctatctacaaatctatatctagatactaaaaagcattatttcatatttgtacctctgattccaatctacagcttggtttcccttttcaatgtttctaactttctccgtgaacaattaaaaacctggctttcattatcctcaataaattcatacatttgttccaacctagaatacacaaaaactcctgttggaattgctaatccactgagaaaagcaaatctactagagctgatacttgttttcggttctttgtcttcgaggtaacatttaaatatcatgaaattcacaaatcttaagtgtgcaatttgatgacttttgacacatgtgtattctgtataacactctatcaaaatttagggctttttttttcaccctaaacgttccctaatgcctcttcctaattaacacccctggcagaggcaaactcttcttttttttccattccagattatttttccaccatagattttcaacacatattttctaacctctttgagaaatttatgtaagtggaatcatggaacatactctttgtgtccagcttcctttactcagcacatctgagagattcatccatattttggatatatcaagagttctttcctgtggatagtttgtcattgtttgagtgtacaatatcacaatctgtttatccgttcacctattaatgagcaattcggttgttttcagttttcggtgaccatgaatgtcctcattcatgactttttggacctgtgttttaatccctctttggtaaacatttagaagtagaatttctgggtcatagagcaggtatatgcttaactttataagaaattacgaatcttttttgtttttgattcccattagcaatgtataatagttccacttgcttcacatcttggtcaatatttggtgtcttcagtacttttaattttagccattttagttgggtgtaagctagtatttcactgaagatttaatttgcatttttccaatgactaagaaagaacttgatcatgtgcttattggacatgcataatatttcctttgttgtgtgtctattacagattttatttactttatttcttgcattggtgtcattactaatgaattgctgcagttatttatatattctcaatacaagtcttttgtcagatatgtacattacattttctcccagtctgtggctttctgttcatttttaaagtgtcttttaatgagaaggcttaacttttgataaagtttaatttatcttttaaaacaattctgtggttgttttctgttttaagaaatcttcacttacctgaggttttcactgtagacttaggttttttttttaaagaccatctatagttttagcttttatatttaggtccctggatgaatgaggtagaagttatggttgttttgtttccacatagatatctcgttttcccacataatttattaaacactttcctttcctcactgaattgtcttgccacctttcttcagaatgaaataaccagataggtgttggtctgtttctgcctcgtactttgtttcattgatctatgtgtctatcctgttgccagtattacacatcttatcataatttatgttaagttttgaagttaaataatataaatcctccagctttgttcctttatttcaagattgttttggctattccaggccctttacatttccaataagtcttagactcagattgtcacctgtactaaaatgcctgctaggattatagttaaaatcattgtggggaaaattgacatcttaataatattgagtctagcaacatttggacgtggggtatctctatatgtgttatttaattgcactgattagtatttgtagctttgaacattgaggttttacagatcttttgctgaatttgtttctaagtattttatgtcttaaagctattgttaaagtaataaccttaatttgatttaaaaatgtgtttactgttagtatttagaaatgcaattgattttatattgaacttgaatcttgaagtgttgctaaattcacattagttccagtaactttttgtagattccttaagattttctatataaagaattatattatctgcaaataggaatcagttccttcttctatccaattgttctggtttttatttccattttttgacttatcaaactggttcagaagtttatagaatagaatagaacttaaaggagaagaggcatctttgcctggtttccaatcacgtaagaggagttgcctctttaactgtcaagtgtgatattgactgatgctgtatatcaggttgaggaagtttctttttttttctttttttttttttttgagacagagtttcgctcttgttgcccaggctggagtgcaatggtgtgatctctgctcactgcaacctccgcctcctgggttcaagcaattcccctgcctcagcctcccttgtagctgggattacaggcatgtgccaccatgcctggctaattttttatttttagtagagacagggtttctccatgttggtcaggctggtctcgaactcccgacctcaggtgatctgcccgcctcagcctcccagagtgctgggattacaggcatgagccaccacccctgacctggaagtttctttttattcctagtttgttgagagtttttatcacaagtgcatctattgaaattatcatgtgtttttttttctttattctgttaatatggtgaattacactaattttcaaatgttgaccaactttgcattcctggaagaaaccccacttggtcatgatataatatctttttaatatattattgaataagttggttaatattttgttaatgattattgtgcttgtattaggaacattggtctctaatttcctttgttcatgtctttgttagagttatgctgccaaagtcagataacagtattttgatggccttgtaaaatgagttgacacgtatttatttttcccgttttctgaaagagcttatgtaatagatgtagttattcaaattttctattttatcttgtatcaagtgtgataagtggccttctgagtaatttttcatttcacctaagttgtcacatttattgacataaagtcgattataatattctcctattacctcttattcctcacataggtaatgtgtgttctttctcttatggtctcctgtcccactcctccattttttcagtctcaccagaatatacccattttatttatctttgcaaacccattttatttatctttgcaaagaatcaactttgactttgttaagtttctctattgtgtctgctttctgtgttgttggtttttagtcttatttattttcctctcttttacttactatagttttcatttctcctcttttttctagctttttaagtagaaagatcattgatttgaaagttttatcttatttgatatagccatttaaaactctaaattgtcttctaaaccatgctttagatgagtctcacaaacttctatttgggaatttagatttttggaaggaatgtacttttgtgatcattcagttccattttttcctaatttttcttaggatttcttcttcaacacatttaaaagcatactgtttaatttctaactatctggaagttcttttagatatttacttataatctaattataatccgagaatatattctgtaagacttcaaccttttgaaatttactgagacttatttcatgtcctaacttatgttctatcttgatgaatgttctacacgcaaatatgtcctgaagttgttaggtatagtgctctatacacgtcaattaggccaagctgtttgatgtttttcagatattctaaatccttactgattttttgttaccttattgtttactgagacggctatgttaaagtctcactcaaaattgtgaacttgtctatttctccctttagttctgtcaatttgggcttattatattttgatggtctattactaggtacaaatactttcatgatagtatcttcctgattaatgacccttttatattattatacaacatctttatttctggtaaaactctttctcttaaagtgtattttttttaattgttaaaaaaagcctttccagcttttttatggtttctgtttacatggtatatactttctattcatttactttcaaactatttgtgttttacaattaaagtgcatctcttgtagacagcatatctttgattcttgcttttttaaattcattctgacaatctctacattttaacttacatataatataattataaatacttttggatttagggctatcattttgttatttgtttcttatttgtccagtctgatatttgtttctctgctcctctttttgtggcttcttttgtgttaatacaatattttagtatttcatttcaattctctattggtttttttttctttagagtctaactctgtcacccagcccaggctggagtgtagtggtgcaatgaaagatagctcactgtagccttgaagtcatgggctcaagtgatcctcctgtctcagcctcctaagcaactaagactacaggtacacgccactgcacccaactatttttttttaatttttaatttttgtagagatggagtctttcttcattgcctaggctggtgttgaactcttgacctccagtgatccttccacctcggcctcccaaagtactgagataataggtataagccaccatacctggcccctgaatttttagttctactactttacatcattttttagtggtgattctagagattgcagtatacatccttaattttagtacaatctgcttagttaatattacatcattacatgtaaaatatgtcttgcaactgcataattttatttgcccaatttttgtgctattttatcatatatattacatctgcttattttgtaaactttacaatacagtgtgataatttttactttaacccttcatatgtcctttaaataagagaagaaaaaatgtacccatttatatatatatatccatatatttaccatttctggtggtctttattcattcttgcagatccaagttaccatctgctattatttcctttgtcaccttaagaatcttctatagcatttcttgtagtgtgtgttggttggtgattcattctctcactttcattatttgagaatgtgtttacttctctttcgttttttttttttctttcttttctgagatggagtctggctctgtcgcccaggctggagtgcagtggcatgatctcggctcactgcaagctccacctcctgggttcatgccattctcctgcctccgcctcccgagtagcagggactgtgggcgcccgccaccacgcccggctaatttttttttgtatttttagtagagacggggtttcaccgtggtctcaatctcctgtcctcgtgatccgctggccttggactcccaaagtgctgggattacaagcatgatccactgcgaccggcccttctctttcatttttgagggacattttcattggatgtggaattgggtggacagtcttttctttcagcacctgagagatgtaattccattgtctcctggaatctattatttctcttgacttgtcaaaatttgattaatcagtcccctttttctcatgtgtagtttacctatggacattttcaagattttctgtttatcttttttaaaaaattattttactatgatgtatctaggcataattttcggtatttttctttctgcttatgtttgttgaacttcttagatctgtacaattatattttcaccaaattttgggaaatttttggccacaatgtttcaaatatttttcttttattattattttttttgagacacagtctttctttatcaccctggctggagggcagtggcatgatcttggttcactgcaacctctgtctcctgggttcaactgattctcctgcctcagcctcctgagtagctgggattacaggtgtgtgccaccatgcctggttaatttttctatttttagtagacatgcggtttcaccatcttggccaggctggtcttgaactcctgacctcaggtgatccacccacctcggcctcccaaagtgctgggattacaggcatgagccaccacacctggctgatttttcaaatatttttctgccccgttttctacctcctctctttctgggactctaagtatatctgtgttcatatgtttgttgtttcttcatagatcctttactcacttttctcaatttctttttcttctctgtttttcagattagatatttctgttgatcttttttttttaattcactaatcttttctttcactgtttccaatctgctgttaagcccattttaaagacttagttattatatttttttcattctagaatttactttggttctttctattttttccactgatattatcttttaagatcttaaatatatttaaaacagttttaaaaagatcttttctgttaattccaacatctgagacatattggaatagatttctattgattgaatttttcttgactctgggtcaagagatatgctgtttctttgcatgcatgtctagtaagttttgattgcgtctggtgcatttgatgagacattttacatactcttgattttcttatttttttggctgagtgttgagttttgttttagcaggcagttatctagctggactcaaaccccaaattttttctcccttgtcaaggcattagctgaaatctctactcagtttttcagcctcctggttgggttccttggagtctcctacacaatacacagttcagagatctgcaggaatgtgtgcagagagtttacacatggatttagaggctcccatatctgtggctaccatctttctgaaatttctcccctcataatccagccatattggcagtcccaaattctgtcctttaacccttcaagcaattaaaattgtggttttagcttcagttctagcttctttctaccacaaggtctggggagtatcctcaactgaaaaaccatatttagttcccttctttaaaggattcccttcttatttctgcctgcttctagacaccctccagtgccttcagatagacattatttacatttttttcacagtatataattttgatctgcaggagatctagtttgatgccagctaccctaccattaccaaaagtggaactccagttgactacttttttttacttaaagataatgtgatcttttttttttttttttttgagacagagtctcgcactgttgctcagactggagtgcaatggcgcagtctcagctcactgcaagttcaagtgattctcctgcctcagcctcctgagtagctgggagtacaggtgcctgccaccatactcagctaattttttttgtattttcagtagagaccggggggcgggggggcgtttcactgtgttggccaggctggtctcgaactcctgacctcctgatccacccacctcggcctcccaaagtgctgggattacaggcatgagccaccgtgcctggctgataatctgatcttttaatcattggcatgtgtgaagcagagaatgagaaggagggcttacctagaacctcaggtgattacactgaaataatttagataatttagtcacaattcttgaatgattagctcatggtacgttaaggacaatgtttttcagtaaaataacttattgtagttcttaagggaaatgtaataatagggaaaaataaatgatatttcaaggttaattgctatttcatatcgccatagtaagaaaattgatatgtggagtctaaataataaaataaccaattaggctgggtgcagtggctcacatctgtaatcccaacagtttgggaggccaaggcggacagattacctgaggtcaggagttcaagaccagcctggccaacagggtgaaactccatttctactaagaatacaaaaattagccaggcatggtggtgctgcctgtaatcccagctaatggagaagctgaggcaggagaatcacttgaacctgggaggcagaggttgcagtgagccaagaccacgctattgcactccagtctgggcaaaagagcaagactctatctcaaaaacataaaacaaaacaaaataaaataaacaattaaaaataaaaaataacaaaaggttttatataaattacaaataattagggcagagactacattgtatgctttgttttatacatcatataatggactttttagagtatctatacatgctacatataggaagaaatagttctgaaaattcttcaggtgacaaagaaaataataacagatggtaacttggatctacaagaatgaatgaggaccacctgaaatagaaaatatgtggataaatataaatgactttttttcttctctttatttaaaggacatatgaagggttaaagtaaaaagtaaagtacatatgaaaagaaatagtttctttttagtaaatacttttagattagttataaaaacagtaaatgactatcatgtatttcattgtattttttcataacaataattggcctctcttataaatttaccacatcaaatgtataactgacatgtctgatatatcagattgcactctttcatttgaatctgctttatggaagagaagacatatatacttgaacaaagggaattctcactggataaatctcaaattggataaatctgtgaaaaccatccaattaaaagggcactgaggctgcttgaacatattctataaattgcaaactcaggtttaaaacagctttaagcaattcttgataaatggcctttttattaaataaaatgatttggttctttcttcaaagaaagcaaaaatacacctgaaacctttagcttcaggccactccaaaagctccattcctcattggttgcataacttcattttaaagcaattaaaatcgtgtccggtaaaaacatgcatagttgccgtctttactattttcatattcttctgaatagatcagttacagctcaggacaagtgtcatttgagaacttgattgacaatgacagcactgactagattaaacaataaagatctaagttctagtactctcttattgaaataaaaagaaggaagtatatttgccagtcacaggtctaaatatctttcaaacctattaaacttcctgaaagcgtttccgaaggacaactcaggaatcaatataaagtagcagagtggctgctttgtttgccttccagaaagtactgtagaaaataaatatttaatggtagacaaaccaatatgctgagtgtaagacataataatggcttgagacagtagaccgaagtattgttacattgagagatcaagtgaattacaattattctaatgataaaaccttttaagtctttgctttatggttattgtccttgaacctcatcacatgcatgtagatactacagactcataattatccactctggatccatgagcctaaggttgaattttactttctttttcctggtttatcgtttttacctagagtacaacatagaagacacgtcaacagtctaatatgttttttaaaggtcattcaccttggtttctgtactaaagataaggaatagtcagatcaggcatcagctaagaaatctgggaacagttgacctaacgaaggtttggaatcaatttcactgagaaaatttcctcatttaaaagcagtgaatttgttagttcacttcctgagaaatgcaatggatgcaaaggaattcttttattccctcagggttttaacctttttctgtgcttgattttctagaaactttaggattactggagcccagtggctgtgtctgtacaaattattgagtaagggaatgaagacggacaggactctgtgtgtgtgtagagggggagggaggcggctatgaaaagtctctctttttaaataacagaacatgtttaccacatcattattccttctcaaaatattttttagagcagttttaggatcacagcaagattgagaggaagatacagagatttccaatatatccctcccctcatatatacatagctcccccgttatcaacatgccttcattattacatctatctcactaaacaaaattcttttttcagtatgcatctattttctctttcaaattcttgattcaataattcattgttttgatttcctggaatcctcttgagattttcagttttttccttttttttcacactagagaaatgaatggagatgtagacatgagatgtaaggaccagaatttggaggtcaattaaagcaattagcaaatagaaatcatctaagctattaagactgatgctgtcatatatatatacacatatatatgtatatgtgtgtagatctatacatatacatatatgtatacatataaacatatgtgtacatatacatatatgtatacatataaatatgtgtgtaatttacatatacatatatgtatacatataaacatatgtgtacatatatacatatataacatacgtatattatatatgttatataacacgtatattatgttatataacatacgtatattatatatgttatataacatacgtatattatatatgttatataacatatgtatattatatgttatataatatacatatattatatatgttatataacatacgtatattatatgttatataacatacgtatattatatatgttatataacatacgtatatgttatataacatacgtatattatatatgttatataacatacgtatattatatatgttatataacatacgtatattatatatgttatataacatacgtatattatatatgttatataacatacgtatataataaacatgtatacatatgtatatacatatataatatacattatgtctatatacatatagatatataatatacatatattaatatgtagattaatatggatatagatattaatatacgtatataacatataatatacattatggagattatataacatatgtaatatacgttatgtacattatataacatatgtaatatacattatgtacattatataacatatgtaatatacattatgtacattatataacatatgtaatatatatatgtgtatataaaaaaacatacctggaaaaagcaatataaatgtctgggtcttactcagtagcccagactagagtgcagtggtgtgatcatggctcactgcagcctcaacctcagtcgatcctcctgcctcagcctcccacgtagctgagactacaggcttgtgccaccacacctggctaattttgtttgtattttttgcagagacagggtttcaccatgttgcccaggctggtctggaactactggactcaagcaattcacctgccttggcctcccaaagtgctgggattacaggtgtgagccactgcacctggcctacatttatatatgtctatataattgtataaagttatcatgggttcaagttgtttacttcaccttgtttcacataaacatatctatgtattacatcctccatttacttgtcattttaatttgtatatggtaatacaccatggtttacttaaacatgttaatactattgggcatttgaactgaagctaattttccccattataggtaaggctgcaatgaaaattgctttataagttagttttcctttctcaggggaaggaacgggtaataggtcaaagagcatgttatagattaccccccagaaatatgtaaccattttacatttctaccattaacatacaaaatgtacgtctgccttcctcccaaagacttgtccaggttcagttttacaagctaaaaaatgtcttccaggctgggcgcagtgactcaagcctgtaatcctagcactttcagaggctgaggcgggtggatcacctgaggtcaggagtttgagaccagcctggacaacatggtgaaaccccatctctactaaaaatacaaaaacaggccgggtgtggtggcacgtgcctgtaaacccagctacttgggaggctgaggcaagaaaatcgcttgaacccgggaggtagaggttgcagtgagccaagatcgcatcatagcactccagcatgggtgacagagtgaggctccgtctcaaaaaaaaaataaataaaataaaaaataaaaaatgtcttccagtttaatgcatctgtaagagagtcttcatgtgagtttaattaacctttattttcattttttaataaaactgatttttaaaaacacaatgatgtagtctaaatgttcctaactgcaaactgtccattcatcaagtggaaagtggttattgacttacataatcatttattttttcatatattttgggagaaagctattatcacgttatatttgtaatatatctattctatactggaaagttttctttatagcatttttattttacattttgttgcatgaaagttaaaaaatttaaatctgctcaattaatcacccctgcttccggtaacaacctttgttttctgcagtgattagaaatgcatgttctccaggttgggcaacatagtgagactgtgtctccacaaacaattaaaaaattagcaaggcatggtgacgcatgcctgtagtcacagctacttgggaggatgagatgggaggattgcttgaccccgggagactgaggttgcagtgagccatgatcacaccactgcaatccaacgtgggcaacagagtgagacactgtctcaaaaaagaaaataaaaatgcatgttctttttctcataggaaatagataaaccactcttccattttttaaaaagggcttttactttttgatacagctggaatttattatactgtttgtttccgtgtatttacgtatctaacatgatgttttttccagcctgttagccaactatttggaagacaacttattatgtggttttcccttgccctataggttggattcttttttccgactgtaataacccaaggccataagattttgatcattgttgcagtgtgttcagttttccaagtttgctgagttcatccttattcccaatgaaaatgttttgataatgtcatccatttatttttcactattggttctcacaggaatttataactgcaataaatttatatattaaacatttttaattgatgtcttatttaatctctctaaaaaagaatgtagcatagttatttaggtatgtttacctttttttattagaatttaatcaacttatttttcttcaacttttaagttctgaatacctttgcaggatgtgcacgtttgttatataagtaaatgtgtgccgtggtagtttgctacacagacctgcacagatcaacccatcccttaggtattaagcccagcatccattagctattcttcctgatgttctccctcccaccatcccaccttcttggagaggcccgtgtgtgttgttaccgtccatgtgtctatgtgttctcgtggttcagctcccccttataagtgagaacatgcggtgactggctttctgttcctgtgttagtttgctgaggataattgcttccacctccattcatgtccctgcaaaggacatgttctcattcctttttatggttgcatagcactccatggtgtatatataccacattccctttatccagtctgttgttgatgggcgtccaggttgattctatgtctttgctatcgtgaatagtgccacaatgaacatacgtgtacacgtatctttttatttatttttacacgtgcacgtatctttgtaaaagaataatttctattcctctgggtatatacccaataataggattgctgaatcaaatggtatttctgcctttaagtctttgaggaatcaccacactgtcttccacagtggttgaactaatttacactccaactaacagtgtaaaagccttcctatttctccatatcctctccagcatctgttgttttttgactttttaataatagccattctgactggtgtgagatggtgtctcattgtggttttaatttgcatttctctaataatcagttctttcttatgtttgttggccacatgtatgtcttctgagaagtgtctgttcatgtcctttgcacactttttaatgtgattgttcatttttttcttgtaaattgtttaaattccttgtagactctggatattagaccttgtcagatgaatagattgcaaaatttttctcccattccgtaggttgtctgttcactctgatgatagtttctttttctgtgtagaagtgctttagtttaattagataccgtttgtcaatttttgcttttgttgcaattgcttttggcatctttgtcaggaaatctttctgtcccttcaatcaatttttttaagaaacacatctgtttcaagttaattttattgctgggttatttaatgtattattgatacggtaaattctgtcttctagttgtgtataactattttttgtttgattctgctgacattttaagtatgcaaccatgtaacatgtaaaacacacttaaatctttctacattctctgtttagtgatagtggtcgtaggggtaccctctgtatgtttctgttttttaagtaaattggctcaagtgtttctgacttgtatttcttcattaagagtttttttttcttttttttttttttttttgacggagtcttgctctgtcaccaggctggagtgcagtggtgccatcttggcttactgcaacctctgcctcccgggtttaagtgattcccctgtctcagcctcctgagtagctgggactacaggtgtgcaccaccatgcccggctaattttttgtattttagtagagatggggtttcaccatgttggccaggatggtctcaatttcctgacctcgtgatctgcccgccttggcctcccaaagtgttgggattaccgctgtgagccatcgcacctggccaaaagatttttctaacaacagattatacaattaattctggttcttttcattaaaaattatctttatttttaaagttatgtattatttttgaactatacatctggggttgaaacacaaaagtaaatcaaatgtagaactccaaagagctgagttataagaaggcagtgtatttggtggttcaaggtcagactgacctggatttcaatcctaatcctgttatttattagcttcgtgacactgggcatatttataactagactgggtttcaacttcatcacttataaaatgaatataatagtatctacttgctgggcaccatggcacatgactatagtcccagctactcagaaggccaaggtgggaggatcacatgagtccagggctttgaggccagcagcagcctgggcaacatagcaatacctgtctcttaaaaaagaaaaagaagaagaatgcaataataatatctacctaatagaattgttatgaatatttaaacaattaatacatgtaaagtgtaaaatgactaaaatcgtgcatggtacataatcaaggtttggtattatttttataatcatcataattaatcttaatatctcgtaattttaatcaagaaatctttgaatccatgatgaatattgatgtggttaggcttttgtgtccccacctaaatctcatcttgaattgtcatccccaggtgttaagggaagaacctggtgggaggtgatcggctcatggaggtggtttcctccaagctgttctcatgagagtgagtgagctctcatgagatatgatggcatttcccctggttgcacttacttctctcttgcctgccgccatgtaagacatgcctgcttccccttccacagtgattgtaagtttcctgaggcctcagcagccatgcagaactgtgagtcaattaaacctctttcctttataaattacctagtctcaggtagtatctttacagtagttttgacaaacactaaaggacttcacaaggttcattagtgctgactcaggtgcctctactctgtcgcactttaactgattcctattccatcagggagattaagtttctcacaattccatgttgaatgagcataggacttaggaagacctgaagattctacttcagaagatgggggtgattattagattaaatcaaatcaaataatatatgtggaagctactagcaaaatatctggcacatagatctcagataaaagctggttgccttctgctcttttttcctctctatggcaccctctgagcattcacagggacttctgccaacctgtttgagcatttcatgcttggtgc

SEQ ID NO: 654 - DNA, 33489 bp, Human
tgaaacaactgagatgcactcagtaacgtgggctggaaaaggatccccagtttttcgtttcatagattggaatctggtaggaggcccgcctggggatggccggcagcaggcagagacctggattctagatcctcccatttgcaagaatgtcccaggtgacctcctctcggggatgctagaggatgaggacagggtgaagaagccagcctactgggggaaggggggtctttgggaccaatcaagagtgcttagagaggggtcctctgagatatctggacactgaccgcttcccaatgaattgcctatggcccgctgcttcagaatcacagggagcttgcctaaaatgcagattctgggatgttggctctgggtgggaatctctaggattcaggcccaggaatctgtgtttttaaccagttgaacaagttttctaggtgatttttgtttgtttgttttgttttgttttgccacaattaggtttgagatccactgccctacgactggtcctttatctgacttaaacatttgacaaaggagcaaatctaactaaggtatctgtggtgtgggcagcagtagagcctgcaacttaatcacaagagctgtccttgtcctgtgaggtgacaaccgagagtttattgtttggttgattgcttggtttgtttaattgtaatgttttgtagtttaattgtttatttattaacagctttcagaaacagtaataagaatagaatgtgaagccaactgcagaagaaaaaactaaactgagaagggaactaaataaaaaagcagctgggcagatgagatttgggggtgcagggagcaagcatgtggatggagggaggagattaatattgagccatggtcatgagaacttcagagagagatggatgagtggaggtggcccacacggtattctcttttagtgttaaagtctcaccaatgcaccacgacgtagcagtctctcgttgtgaggtattacctggagttctttgtctcatgacccagagaattaaggagtgtggacacaaaaggtgagattggagcaaaagttttctaagcaaaagaagaaagctttctgccatggagagggggcccagaagagggttgctgtctttacagttgaatgcaaaggcttttataagaaactgatgagggctgggcatctcatttgcataagacacaaatttctgttagctccaccccatcctccaagtgtgcatgtgggcccttagcttagtgactccatattgctttgttccccttactgtacatgtgttacgggacagaactttccactgcaggcgtgtctgggtgagtcacctgtgtagcttttcttatctatgtggctgtgggcgtgtcttaggcaagcccctctgtgcaagttggctgttcttttgtttgaaagaatttaactgagggcccaccctaactgcctgcctgactggcttcttcctttctcctctctcggtaggtcatggattggctcctgctttgacaccgccttgagggacttaagatgttggcatgatttttgaagctttttattggatattgggttgatattatatttgaacatgaagtcaccctgaggtgtgctgtcaggtggccccattgtatttggatacaggcagctgtgaaatgcaggggagcagttaagaatattaacaggtccccagttgaaatgctttaatggcagtggtacatggcctgttcctaccccacccaacacacgtcacaaccccaacccctacccccaaagcctattctcaatatggcagccagacttagcctgttaagatgagtccaatcctacctactccaccttcagggtgagagcaccccctctgaggcctgtatgaggggcttctcccctccctcgtaggtctgctgcacccactggcctccctggaacccaggccactcctgcctcaaggcctttacaccagcaatcccctgggtctggagcttcctccccctggaagtccccacagttcaccctcacatctttaatgtttttgctcaaatgtccctgggggagcctgctccaaccacgcctaatgctgcaacctcccacacctggctctcctgctccctctcacgtgtgtcctttcttcccccaaaatatcccatttatcatgttctaacacgcaacatgatttgtttattgtgtttggtgtctgtctcttgtcactatcatgtaagctccacagggacaaaattttttatctcttttgtttgttggtatatccctaccgtcaaactcatcagcgcttaatacagatttgtagaatgaatggatgaatgaatgaatgcctctaggctcccagtcagtctgagcaggctggtttgcaggtccggagcttctccgagcagcatctccccactcctggtccccattgggtcactggaatctcactccccatgcaccaggccacgtcttgatgtttgatgggctgggctcccgctctggttctgccccaggactcccttctgcatcctgccccgtggtgtccttgcctatgcccctctcatcggtgccactgccctcccgaatgcagcctgggcgtctctgctgtgagctcccgtcactgggctctgccctctgtggacacactgtgccacttccccttctatgtcactgacctggacccagtctgaaggttgccctcctgttaaagaaacccaggacctgacagtaggtaaagtaggaaaagcacattttattcaggaagtattgcaaagggggaaagaggcctcagtgcatatagaacggactcagtggttaattcaaccagaacgagtggggatttatagccatggagcaggctggcagtcgggatggaggaaattactaagagaaagcagcagggggaaggaaagcttctggttaaacaggcttaggattcttgctgaaggcaggccagggtggtcagatgcgaaggatgggggcctctctccacactgacttaggagggacttgctaaaactggctgatgcaggcccaacgatgacaggcacagaagcccagggttgaggccccgttgaaagagagcttcgaggagcctgacttaagtgcggcctcagagcgagtctttgtcctgggaagcgggaccttttgctggcaaggcaagcgcctgccctagcttgaccagggtgcggagcccgccctcccctgctgctgtgccttgagaatcaggcagatccagaacaggaccaggccagaaaatcctgcggctgtgggacgtgggcaggatgaggccttgctgtgaatgtccctgagaaaaatgtgcctccctccctttctaaaaaggtttcctgccgtgaaaatgacacccaggaaaatagaacaggagaagaccagtctcgggaaccacacctccgggagctcctctcagcccctagccagcggcccctctaggcccacagtccctcctggactggagctggggtcgttgttctctcaaggaagcagtgaggagtgtggacaggcccagggaagaaatgcctgactctgtgcttcgtggggaaggcggggaagacagcagggattggagctgagaaccagaggccagaggacgccctgagacaggacttcctgaaagaagccctgggacccccactgccaagggtccaggtgaggaggggagatggggtgggggctggggctttcaaaggatcaagttttcaccacccatactttttgggattcaggaggggggtgttggagtgaacactgggcttcagcttctgtcctaaaatacctaaaatcaaaataaacccagccaggcgtggtggctcacacctctaatcccagcactttgggaggccaaggagggaggattgcttgagcccaggagttcaagaccagactgggcaagatagtgagaccgccccccacccccgcacccccatctcttctacaaaaaaataaaaataaaaatttgctgggtgtggtggcgcacgcctgtagtcccagctactcaggaggctgaggtaggaggattgtttgagccaggaggtcaaggctacagtggaccaagatcaccccactgcactccagcctgggtggcaaaagggagaccctatctccaaaaaaaaaaaccttaccctgaaaatttaatttccttctaacacatcatcctgatccccaggagagattcatcatccttctacttgactttcttctgttgaactatctaacctggtctatttcaacaaatactatttcttgacaaccactaacctggcttgggctttattaggctaaagaaatgcctgcctccagaattagattctataaagttttcttttgcagacagatagtggaagtgcccaaattaatcattttaatttctcagaagggaagaaaaaatgccatttgatccaaccacataggcaaagtgcctcgcacacagtagctactcggtaaagctgagtcacggctgtggttgggaccagggagggtacccttcccttcacatgcagtgtcctgggtttctccctcccgacccttctcatcaggagtccctggaactgaggtcccacgaggcttcaggtgccacagcatgggtggcagcttctgtcatgccagccacaatcagtgaccccagataaggttggcagggtgatcccaaagagaacggtgacttcagccccagcacagggaggccgatggctggggactgggggaaactcctgtggacggggttcctgagaatggcctggaaagaaaaagctaaaaaggtggaagtcagacagaacacagctcatgccacttcaaataggaatttgcccacatctaggccaggccctgtcgcctcttgtctctctcagcagtattggtgcctgaagggatccattaagggatccagtgtgaaattttctggcttggctcatagaccgtcctgtctttggaatcaaagagcagacacagatcaatgcataaggtgaggagtcttgaattcttaactatttctttccttagtgaaagagagttgcactggctaagtgtactgagtttaaagcctcttgttccttctgcaaaatctgcaggcacagcagcctgaggcatctgcccctaagccagggtcagagctgggggcagcaacaggggctggggacccgagacagccccttgggtttcccttgcaggtgccaagaaccagcaagtctcctggggattgagtgccttgtggggcacttgggcctgtcccattgtcctcctccaaggaaacttttggggcactctggctctccagggctggggacggctctgccccatgtcaccaaggccctctgcagggtgtgggtgtggacacagctagtagcacgagccgtggtcggtctgcagttccacctttgcagctttgcccttccctgtctgccaatctgatcccaatcctgtctgtgcccatcccaaccccctatacctgaattacatcagcctagaattcacctgctacttccattcctgccttcaaattctgacctttacctgtctggccaaggagttttgtccctcctcgatgtgctgttgtttaaatgctcccaaggaaatgcctaccccaacccccaaaacaggatcagggaccagggtttttttttttttgctgcttccttctaccttcaccttcagtgttgcagagcacccatagcccgctgaaccaggggttccgtgccatctgcaatgctgtgtatgtgcaagaggtgaggcagagaacagggaagcatacgttcccactcctaaaaattcccagagaaaaatactttctgtgagtgtcaaaacatgatgggactgttcatgaaatcagtccgtgaagtcagctgtgatcatgatgaaacatgagccatggttctgtgggttctgaagctatacaaatcacaaattcttcatcatgatagaaactgaaaacctaacttgttcaacatatgtttcttgaattggatatccagacgcaaaaaaaaaaaaaaaaaaaaaaaaaagaggagaaagaaaaaatctcaatcataatccaagaatctgataccatatacaaaaattaatttaaaatggatcatagacctaaatgtaaaactgtaaagctcctagaagaaacaggagagaaaatatttgaggaggtggtaggctggatgctttcccaaaaatgcctacctcctagttcctggaacctatgaacatgttatgttacctggcaagagactttgcagatgcaaggaaagagacagatcttaaaacagggagtgtatcctgggctatccaggtgggccccacctaatcacatgaccccttaatagcagagaactttctctagctgcagcagaagggaaaattagatattccagtcatgagaagttctttaagagtttatgagtcaggattgccagctagcagagtgagggcctcattttcaaggatcagagagaggcccagagagaggatcagagagaattccaagggcgaccccagttgaccccagcaatgaagctggcagctgagccccacaacctcgaggaactgggttctgcccacaccctgagtgaacactgtagtggatttttcccaagcctcttggtaagagcccagacagccaacactttgactttggcctggtgagacccagagtacagaaaccagtcaaggagctcagacttctgacctacaaaactgtaagatcataaatttgtgttgtcttatgccactaaggttgtggtagtttttcacagcagcagtagaaaaataatagagaccctgggttaggcaaagatttcttagctagaacataaaacacataaaccataagagaaaaaaaaaagaataagctgaacatcaaattaaaacctgatttttggaagatacttttaagaaagttaaaaaagaaacaagaaaagatgaggacaatatttaaaaacacatatctcatgaaggactggaatccagaatatataaagaaatcctcagccaggtgcggcgactcatgcctgtaatctcagcactttgggaggcagaggtgggcagatcacctgagatcaggagttcaagaccagtctggccaacatgatgacaccctgtctcaactaaaaatacaaaaagtagctagatgtggtggtaggcacctgtaatcccagctactcagaaggctgaggcaggagaatcgcttgaacccagaaggcagaggttgcagtgagccgagatcaagccactgcactccagcctgggcaacagagcaagactccatctcaaaaaaaaaaaaaaaaaagaaaaagaaaaagaaagaaagaaaaacaaatcttagaactcaatagacacaaaatattcaattttttttaagtgggaagggaagatgatttgaacagatacttcatcaaagaagatatacaaatggcaaattaaacacataaaaagatgctcaacatcactagtcatcagggaaatgcaaatgaaagccctgatgagatactgttacacacctattagcatggctaaaattagaaagactggcaatactaagagcagacaaggaggcagagcaactggaaatctcatgcatgtaaaatggaacaatcacatcggaaaacagtttggtagtttctgacagaattacactaatgtttatcatttggcccagcaaccccttcccaggcactgaaataaaaacataggtccacgcaaagacctgtacatggatgatcattgcagctttatttgtaatggccaaaaactggaaggaactcacacaccgatcagcaagtaaattggtaagtaaattgtagcacatccatgtaatggaacattactcagtaataaagaatgacaagctactgatacatgcggcaacagggatgaactccaagagcattaggctaactgaaaaaagccagactcaacaggccggtaatgatataatttcatttatatgatgtccattatatgacattctagtggaggcaaaactacagggacaaaacatggattggtggttgccagggatggcacggcaaaagaggagtgactgccaaagggactgagggagcgtctggcacgatgggactgccctgggtcttgactgtattggtgtcatgtggttctacatttgtcaaaacaaaacaaacctacattttaaaagagtggattggcccagtgcagtggctcatgtctaattccagcactttgggaggccgaggcaggtggatcatgaggtcaggagatcgagaccatcctggccaacatggtgaaaccccatctctactaaaaatacaaaaattagccgggcgtggtggcgggcacttgtaatcccagctacttgggaggccgaggcaggagaatcgcttgaacctgggaagcggaagttgcagtgagctgagatcatgccactgcactgcagcctggccacagagcaagaccccgtctcaaaaaaaaaaaaaaaaaaaaaagagtggattttaccgtatgtcaattatacctgaatatatctgacttctataaaaactacatgatgatccccacttccactaaaaataaaaccccctatttggtcccacctggcccacatgatcccctaaattgatcattattattattcacacttttcgaagtaacacatgtgttttctagtcttttcctgcaattatcttttagaggagggccccttgaaagaagaagttcccaggagagatcagtgtatcattatgagcttgagctcttccccactttaagccagtgtaatgatttagaattaattgcctacttttctttctgtcatctgcgattaatattttattgccaaagtaaatgagaattgtttttaaagggacagcacagcctatattgactcagggcatttgtttctgtctattgtactggaaagccatggttggattctctgaagcgaggacactctggctatcatccttggaagtactgacagcagagaccacagaaaataaattcatgctcagcccagacctattttggctgcagtcacttttcttggtggagaggagcccttctcagaaagagcaggaaaagcacctgctgggcagtgctgctgcagatcccatccaggttctctatttttaatttttattttatttatttatttcagatggagtctcattctgtcaccctggctggagtgtggtggtgccatttcagctcactgcaacctccacctttcaggttcaagcgattctcctgcctcagcctcccgagtagtgcccgccaccacgcctggctaatttttgtatttttagtagacggggttttgccatgttggccaggctggtctcaaacccctgacctcaagtgatccacccacctcaggtcccaaaatgctgggattacaggcgcccagcccccatccaggtgctctaaacagctgaataaaatccaggaacaccctagactgaggacttcaggatgctgatgcgctaattagctatcagaccaggtgcacaaaatcggagctcaccaccttgtttattttgccaactgctaggggtagaataaatgaaacaaagacctactggccagatgcgttggctcacctgtaatcccagcactttgggaagccaaggtgggaggatcacttgaggccaggagttcaagatcagcctgggcaaaataatgagaccactccccctccccccaaccccgtctctacaggaaaaacttagctgggcatggtgacatgcaactgtagtcccagctaatctggaagctgaagcaggaggatcccttgagctcaggacttcgaagttacagtagctgtgatcttatctctgccctccaggctgggcaatagagtaagactctgtttcaaaagaaaaagagctactgactcagaaaggctgataatcacaatgagctttcaaaggcttttccagaggactgtttttttcactttttatcttctatgctaccatatatcattgcatccaggacaccatagatcgtataaggcaggaaaataagttgcaaagtaaactatgccaccatgctttttcatttcttaggagttgtactgtatatttattgaagcttattcggacagatgttcatcctatatcacctttggtcacattaaaatagagatgcaaagaaaatgagttggttagggtgttccttaaatttgtttcgtccaacttttctgaatcacatttcaactcaaagtcatcaaatttcatattttatcagactttcttgtcttctacagtcaagagttggcaaactttttctgcaagtttcagactctgccaggccctgtgctctctgtgacagccactcaactctgccgctgtgaggcaaagccggccatacacaatactgaaatgaatgggcgtgggtgtgttccaaaaacaatctttatggacacagaaatttgaattttatataattttcacgtcatgaactattttcttcttttgactattttcagctatttaaaaatgtataaaacattcttacggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcatgggcgacagagcgaaactccgtctcaaaaaaaaaaaaaaaaaaaaaaaaacattcttactcgcaggctatacaaaacaaatggtaggctggatttaacctgtggaccgtggtttgccagccccgactgtatgccactgggagaattggtaatgcagtgtatcttttatttatttatttattatttatttatttattttgagacggagtctcgttcttgttgcccaggctggagtacagtagcacaatctcggctcactgcaacctctgcctcctgggttcaagcgattctcctgcctcagcctcctgagtagctgggattacaggtgcgtgtcaccacgcccagctaatttttgtacttttagtagagatggggtttcgccgtgttggcccggctggtctcgaactcctgacctcacgtgatccacctgcctcggcctcccaaagtgctgggattacaggtgtgagccaccgcgcccagccaagtgtatcttttaaaaagatatactgcagtctccaggattctctttgggccactgacagctgtttctcacatttggttgcaggagaatattcatcaggatagagttagttatgctgcagtaactatccccaaatctcagtggcttaaaacaaaggtttatttctcactcatacgagatccctggtgggtcagggctactttctagggcagccaccccgtgtaacagttcagctttagtcctccatgtgaacacgtgcaccctcaatattgacaggggaccagaatgtggaaaatcacacaccacctcttacaggctttccttcaaaagtgacaggtgtcacttcctatttgcaaaaccagtcacacggaccagtagtttaaaaatgtatctacccatcttcaaaaggtggagactaattccccttcccttgcatgtgggccagacctactgcctcgctacgactatggcagacattgaaatatgtgacccgagaggccaaatgcaaaaagaataccttcaactggtgtgggcccactttcagatggtgcattctggtgaaggccagccatcatgtcacaaggacactcgagcagccctttgagagcaccagatgaagagaagcctatgtggagaggaaccagttggccagtaccaacccactgggtgtgtgagtgggtccctcagagtggatcctccagcctccatcaagcctccaggtgatcccagcccctcagccttcaagtcttccagatgaggcacctcccatatgtctgtgtcctgtctgaattctcgatccacagaaacagtgagataataggcctctaggtttggagggtgatttattacacaggaatagacaatgaaaaaagtacacatggcttcacctaatctcaaaaagataggagaagttcgagtttcccattggcttaaagaagggactaattattggtaaatgtcttgatcttattacaacaaggtgtcaatgaggaattttcaaacaaaaacctggactcacattccttcctctaatggtttgtaaatggctgctgactgaaacatcaggggattgctcttgccctaagatgctccctggaataatgtctgaggtcatagacgcacaggccatggcacagaagctggacagcactttttagtctttttgaaaaacacatctagattttacattttacattaaaatgtaaaaagaatgagcacctggggatccatggaaataatatatcactgtctctcagtcacatgctctcttatttttgcctgtgttgtggttatttgcctttaactaggagatctgtggtggtagatatggagataacgtgagaacatgggcagaaaaagtccttatatccaaagcaaagcaaatgattgactgatgtttctgatttttaaaaaattgttagtgctacataaactgtaagtataataattacaactaaggttcatctgaccttaactcatggaaatagtctagattcaattggcccagaatggtcctataattgtatatatggacaggaatataaatttctctatacacatacatatgcatatacacatagcatctatactatacttagctttaggtaacatgtatacctatatatcacaactagaaataaaatttcctttcaaattagccattaacagattcttaatgatgaatagtgatcttgttagtagttaactggtaacctttatattgaaatagcaagacatactagaatgcaagcaagaaacagcttgattctttttcctggggcccattcaaaccctattttcaaatccaacctttacctccctaggatgaaatcttagatgagatcccatagttttgtctagtcactttttcaaaagactgtggaaaaaaaacgcagcataaaatgtaccatcttaaccatttttaggtgtatagctcagtagtgttaagtgcgtttacatggctatgaaacaaatctccagaacttttccatcttgagaactgaagctctgtgcccattaaagaactattcattctccctgctctctccagccctggcagttgccattttatattcaacttctatgaatttgactactttaaacacctctgataaatggaatcatacagtattcatcttttagtgactggcttatgtcacttagcattatcgtcctcaaagctcatccatcttgtagcttatgacataatttccttcctttttaaggttaaacaatattccagattttttaaggttaaacaatattccattgtgtgtatatagatattacatactacaatattacatatcatatcttattacatactatattacatatattataatattgatatatatcatatataagattacacatattacatacatatataattacatatataagatatatatcaattacatgttacatatattatatataagatatatatatcaatattctattgtgtatatatatcaacattccattgtgtatatataaatattccattgtgtatatatatatacacacacacacaacttatagtttgtttatactatatcttataatatgtaataagatcaagacatttaccaataatttgttccttctttaagccattgggaaattacatatatatatatatatatatatatatatatatatatatatatatatatacaatggaacactgtttaaccttaaaaaggaaggaaattatgtcataatttggtgtatatataggagatatatatatatatatctcactgcatttatccattcatccatgaggcatgatggacatttgggttgcttccacctcttgactattgcgaatgatgctacaatgagtatggacatacaaatatctcttcaagctctgctttcagttctttctggatatatacctagaagtgggactgctggatcatatggtaattttatttttgattttttgaggaaccttcatactgttttctatagtggtcatactattttacaactgcaccggcaatccacaagtgttccaatttctccatatactcagcagcccttgttattttctgtgttttgttttaatggtggctgtcataatggatgtgaggagataactcattatggttttgaattgcattttgcctagttattctaaataataaaagtcctttggtcattatcagctccaaagaacaatctcattttagtaaatataataggcagaataacatcccccactcccacaaagcttatggctgtgttatatggctatgttgtgctgcattacaagaaggaattaaggttgcaggtggaattaaggtttcttgtctgcttcccctacccacctgtgactccttcagtgttggaacagagcttggaagaacatgaaacgggcaggaaaggccatccttaacaaaggcagatgtaatatgacatttgcatcttctgcgtagggcagattcccagcggtgattctttcttttctataccacactgtgggatcctaggtctaagttatcccctttggactcttgggaaatccttgtctttagccaggtgcttctcactctattttcatcctctgctaccaatagtaacctccagcctctttcggctgaggcccctttcctttggcatgaagccctttggacaggtcgtttccaataacccaaagccagaccctacttgtaagtcctcttggctcacaagaacactctgacatcctctccccacctccaccaatgtgcagttttctctccactgcatatatatgtgtttgtatggccatcaggcaggtagttccagaaacagactttgaccttctcagaggagaaaaaaaaagcttaaaatccataagcatggctgattttacagtcttgaacttcttctaaacaatggcctgaattcattcaacattttcttatgatgagtattatgaactactacttttctattcttgcttttaagattttgcccaagtttattcttaaattagtcaatatgtgtttatatagcatatctacgtagaagccagaattagtttcatgcagaaataatgtgtttgcagttatagtaaataaaatattcataagaacttagaaattttgagataattcacattttatccttaaagcaatttattcttagagctttatgaaagctatatcttctctgaacatttgcccaaacctcccacactatctgactttaaactcactatcattgcaccattcaatatgagcaacgaacattttacaagaactctcaacaattgcaagtaactttacctaccacttcctctcttcccttcccttttgtatcttgcccaaagtttaaggttcccaggggtgcacaggattttcacatcatgaagttaattattgctgatatcatgaactctcatttgtgacataaattataactctaaataccagtttaaacaactttccaatctaaatctatgatatcaaaaccaaaattatcttacaaatgataaattctcaatactttgccttttgtagatcatctcttaaggaaaacacagaagaactgttaacattggttgactcttagagaagagtgggagacctgggaaaatggagaggaaaagatttttttttttttttttttttactaaatatcattttgaaccctttgacttttacaccacttagattcccaattcaaaatttttttaattttaaaattgataatttgtatttgaaagtatgaaactaccacttagcacttaatgttacaagcagaagtcacctttgagatcagaaaatagagttttaatagttttctacgttttaaggataaattaaatgacttatattagatctaggacttatatataagttaagcttggtaaatttttttactttttcttttactttctggggaacaaagatatcctttgctcttagatggcttaatatttcaacagttccctagcaagcagactcaggaaaaaaaaaatgttaaccaaaataaagagagagcttggcttttatggggaaggggtttgtagaaaggtatgttttattggttgatgaatccgtttcttaatctgagggcctacagtccaccaggccccgtgttgggtcccctgggggacaaaggtactaagacctgatgccttccctggaaagatacttgagcaatggaaaagaaaaagtgatgctttgttttctcaaagttggggttggagaggggcaagacttataacacctagagagaagcaagaaaacttgaagtcaaaatgtagtagaaaccactagagcctgaaaacaaggaaggcctgaggacaggagaatgtaatcaaaacaatgggtgaaaaaggctttcttccatgatccaggtgtccacacccaaagcacagtggagaatcgaggcctgaatctcccacgcaattggcccaactctcaacagtgaggaaatgatcaccttgggccaagtagtgtacaagacaaatgttaaagggaaggccccgacctcctaggtttatgtaaggccattgtaagcctcagctttttctcattttaaaatcagaaataatcatacctatatataaaattgttgtgaggatgtgacatattgtttataaaatagctcgcatcatgttagggttgccgttgttgctcaataaatgctatctgttgtttttgctgctgttgttgcctgtaggtaaaattaaatgcagtaaaggcagatcctatggattggctcattcaatcttcattttaccctccttttgtggtaacttccagcattgccaaatctatgaaactcagaactacatttccaagacttctttacttttagagttctggatgccacttaggttctaccagttagaagcaatgatgtaagatttggaagatggaagggagtggaggccgtctccctctcactatttcttctggcaagcaaattcacaaaggcatgagtgtcaaggggcaggaggagctgtggtggtggcagctgcttaacctccagatcatgctggttgcagtggtttactcttgacatcaatcaggcatggggtttggggtcccaatttcactccttcagctttctagggactttgtcagcatctgattcctgtattaggtcctttctgcttaaaatacctagggtgatgattcttattgctagaactgaatcctgactgattcagaaatggatgctttctctaaagaaatgccacacataaacttctgtgaaagaatatatttcatgctgctgcctcaaacttgcttaaagttattagtggatttccatgtttaaaccaggtcagtgttcttattgatgccattctctttgaaaactgtgaatataacacaactaaagttctctggcatcctgaacagttaactctgtatttgtatgtcatgctgaaaaacagagtatatgtttgtggtgaccataacccatccactgtctttctttatactttacttggttgaaaccaaactgatccttgaaataattttgcctcctgatacccattcttccttccttagtattaagaatcccaatttttggctgaggacacagctaaccagctaaaatttatttcttttctccatgtaagctagatgtattgtctgttcttacactgctataaagaactacttgagactgggtaatttatgaagaaaagaggtttaattgattcccagttccacaggctgtacatgaagcatggctgggaggcctcaggaaacttacactcatggtggaagggcgaaggggaagcaagcaccttctgcacatgctggcagaagacagagagagcaaagggggaagtgccacacaccttcaaacaaccagatctcatgagaatccactcactatcatgagaacagcaagggggaaatctgcctccaatgatccaatcacctcccaccaggttcttcccccaacattggggactgcaatgcaacatatgagatttgggtggggacacagagccaaaccatataattctacccctggctcctcccagatctcatgtcctccttacatttcaaaacaccatcatgccttcctaacagtcctccaaagtcttaactaattccagcattaactcaaagtccaattccaaagttttatctgagataaggcaagtccctttcacatatgagcctgtaaaatcaaaaacaagttagttacttccaagatacaatggcggtacaggcattgggtaaatgcttctattccaaaagggagaagttgggcaaaacaaaggggctacaggtcccatgcaagtccaaaacccagcagggcagtctttaaatcttaaagctccaaaataatctcctttaacttaatgtctcacatccaggacacaatgatgcaaggggtgggctcccaaggccttaggaacttctagccctgtggctctgcagccccttagctgctttcatagggtggcattgagtgcctgtggcactcaacttgtaggtgcacagtacaaggtgtcggtggatctgccattctgaggtctgaaggatggtggccctcttttcacagctccactaggcagtgccccagtgaggactctgtgtgggggttccaaccccacatttcccctctgcactgccctagtagaggttctctgtgagggctctgcccctgcagcagacttatgtctggacatccaggcatttccatacatcatctgaaacctaggcagaggttcccaaacctcacctcttgactttggcacacctgcaggcccaacacgacgtggaagccaccaagacctagggattgcaccctctgaagccatggcccaagctgtactttggccccctttagtcatggctggagctgaagcagctgggatacagggcatcatgtcccgaggctgcacagagtagcatggccctgagcctggcccacgaaaccatttttccctcataggcctccaggactgcaatgcaaggggctgccacaaaggtctcagaaatgtcctggaggcatttttcccattgtcttggctattaacatttctttacttatgcaaatttctgcagccttgaattcctccacagaaaaagaggttttttttttcctaccacatggtcgggctgcaaattttccaaacttttatgctctgcttcccttttaaatataagttccaatttcagaccacgtccttcttcacaaatatgagggtacacttttagaaatagccaggtcacatcttaaacactttgctgcttagaaatttcttgcgccagatgccctaaatcatctctctcaagttcaaagttccacagatctttagagcaggggcacaatgccacgagtctccttgctaaaggacagcaagaatgacctttactccagttcccaataagttcttcatctccatctgagaccactcagcctggatttcactgcccatatcaccatcagcattttggtcacaaccactcaacaagtctctaggaagttccaaactttccctcatcttcctgtcttctgagccctccaaactgttccaatctctgcctgttacctagttctaaagttgcttccacattttctggtatctttatagcaatgccctactttcctggcaccaactttctgtattagtccattctcacactgctataaagaactgcctgatattgggtaattagtaaagaggtttaattgactcacagttcagcatggctggggaagcctcaggaaacttacaatcatggcggacacataaagaggaagcaagaatcttctttacctggtggcaggagagagagaatgtgaaggggggagtgccatacaccttcaaacaaccagatctcaatagaagtcattcactatcacaaaaacagcaagggggaaatccaccaccacgatccaatcacctcccaccaggtccctccccaaacattgggaattatgattcaacatgagatttgggtggggacacagagccaaaccatatcactaggcatacccatgtgactaaatgttgtccagtttgacataagaaaaagtaagtattttgtgtaacttctaggaagtgtctacagaagaaaggtgccgacccttctttgctccttcctgctttctgttggagtgtgcctgtgatgataggcacactaacagccatcttgagtcatgaggtggcacagtaatcatggcacaacagaagagaatgagcttgttgactgtggagtggccacacaggcctggattatgtacctccaggtttgttttacataagaaaaaaaaaaacggctgggcactgtggctcacatctgtaatcccaacattttaggaggctgaagtgggaggatcactttagcccaagagtttaagaccagcctggacaacatagtgagaccctgttcctacaaaaaaaaatttatttttaattagccaggtatggtggcatgtgcctgtaagcccagctacttgtggggctgagtctggaggatcacttgaggctgggaggtcaaggctgcagtgagctgtgattgcaccaccgcactcaggtctaggtgacagagccagaccctgtcttaaagaaaaagaaaaaaaaatctatctctaacttttggaagccactgttattttgttgctgtatttttattatatgcagctgaatccacccttaattagtataatgggaaaagccaaacttcttcccttcacattaaccatggactatttctcagtttctaaaaacaagtatattcccaagacctgcctaactgctcatacacagtagagcacactactaaaaacactggtctgggtttaaagttaaagacattaaaaggatttcactgaagccaattcagtgtacacagtagtcaagtttgtaagccaaacaaataactttgacttactcatattcctttcaaaatcaaatgaaggcaccaattttaggttgagtgaaagacaggtcctcagccttagctgatgagaccattaggactagagttattgattcaaatggctgagttttttttctaaactagccctctgctgttgacagtgtgaccacaccatagctgacaacacatccaatggtgtaatctgctttgcagctctttattccagagcccatagatcagaggattaaaacactgggaaaatgcaaaaatgccaaaacccaccagatttaaagcaaagaaaaataccccacacactttcccctaacctatgaatatcagattctgggtgttatttatattaatatttcagaggagggacatatacacaaattatccacacacacgcaaaggtttgaaagatatactctttgtacttagaaaattgctcaaattcaggtcaaggttttaccgcttatgcatccttttctagtatctaggaagatactgggatctcagggttgctgagggaatgggaccaccaaaatgacaagctgtgcatggtaacttcataaagttttctcaagtgtgcacagcaatgccactgtgtggcagcctgggagaacacccaaattatagcatcattgttgttgccatgatagtctatgatgcagatactgactgttgcctgcccctccccacctgtaccccatccaaagtgatgtaccctgtaagcctttgctgccttgctccttcatcctcaactacagcatcaccttctcccccagcaaagttgattggcatctgactcactgcaagtcattcactagactgcactgagtcagaatatgtctctcaaaaacccaacacaaggtacacaaagaatgtagtctcagagtaatgtcatgcaattagcctgccagtcatgttgtgagcagaagacacagagggaggtaggagagaagcagagagaagtgagactatgaggcctctgagtgtccacaaaggcccttgcaagaagacaaaacaacctttgctcctgaatttccagttccactgagatgccctgcaatttctgtcctcggattctgaaaatatgatacacccctctattatttgaactatcttaaatgagtttctattccttcactctgtcctgtagacttcaaagtataaaaaatgggccctgaagaggcacaataaattatattgatttcctaaagggcatatcacaatggagatacaactattttaacttcctgagaatctgaaatgtcataactctttatgaaatccctcactgaaggcataattttcccccctgggtattgtgttatcctctttttgaggaaaactttcttttttctgatggatttttggtgccattgtcttgtttttgaactccaggcatttattttctcttctctccagctcttcagagaggaactgaattgtaatggtcattgtcattgtgaaagtcatcatctttgaactgcagatgtcttttaaggtcagactttttgatcaagatctaacacaaaaacctcttaatattaagcaggaaaatgcatatctgctcccatcaagtcctttttcctgaatcgctcactgtcagagcataccctgaaactgtcttggcaccaccatagaaactgagagccctaatgaagactgtatgaaaatcctggtaagttagaacaaatgctccgcccctggactaggcggatcacatgaatgtggcttgaagcctagatttgctgctaacaaggactgtgactttggatattgaagtcgctttgcttctgtggtccttggagctgtgcagcatcaccaggctccacatctgttctatttctacagtcatcctcactcacatcctcaaagccaactctgaacttgggcccagagcatctgcgcttttactttattcctgagaacaagatcacccctgccccaaccccaaaacaccctcatgatatttctccatgcctgagccttttcttgctgatctgaatagaagccctggctctctaggacagagcctgccttgtcctgcaatgtcccctccccggacctgaaacccagccgaccccgagatacatggaggtggctgccagcagagtccacaatagtgctggtctccctgtctgcttaggcctcttaacacacaatcctgggctcactgttgccagggttggcccagctgatgggtgatagtccccattatttggtcttgctcctcacccccattctgcccagaatcccagtcatcttttgaagcatccctgctggatttttcatttctgctcaaaaagactccctgtacctgcatgggggctcaccacctgccccccacacctgccccattccatttgtcagaaccctcagggccatgggttgggctttgcctagctgtgttccaagacccaaaaccctccatagggcatgcagtggctgtcattgtgtttctgttacaataaaaattttaaagctattcttttttccccttgaattactgcagatgcaactataataaaggctaagtcccgaaaaccccctccctctggatctgaaatggtttcaggcaactatttattgctgggaccagcagggactggttcctttagtgttctaatatgcttaacacattaatccacatggcacattgtttcatcattgcactcaacgaaccttcattgagcattgaaacatacaatgcataatcctaagcagtgaggttataaggtagtaaaacagtcactgagcccgggcacagtggctcacacctgtaatcccagcactttgggaggccaaagcaggcagatcacttgagcccaggagtttaagaccagcctgagaaacattgcaaagctctgtctctacgaaaaatagaaaaattagccagctatagtggtgcacacgtgtagtcccagctactgagaaggctgaggcaggaggatcacctgagcctagggaagttgaggctgcagtgagccatgattgcaccactgcaccccagcctgggcaacagagtgagatcctgtgtggaaaaaaaaaaaaagttgctgacatactgaagcttactgtccagtggaagatgcagaatatgatatagataaccaaaaacatcatgtatagttttacccacttaccaaaagaataagaaagtcaagtgtgctatgggagagttgttcagaaataaaaggaatcagatcaccatggtctgatacagtcagagaagacatcctggaggaggtgaggcttgaatcaggcctttcgtggataaaaaccagagcaaagcagggtcaggggtgagttggggagggaaaaggagccacgcagattccaggcaaaggaaaactgtgagagcccaagtgaaaccaaacttggtatgttcaggagacaatgagtatatatctgggttttgtgagagtaaggacttgtttagagcactagggacagactaaggccaggaccagatctggaggaccttgatactattccaagggtgaaaatccattttgtaagcagtaaagagacttgcacaattaaaattagtagcagcacatgccacgggttaagagccagcatgagatgcccacctgtgcatagtggcatttgaaacgagctctgtctgcagagcaggcagcccagcaaaggagaaatttgcacagtgaggacaatactaccacagaaagtggctcagaatactttttgtacacgtggtatctccaggagggttggatatctgcaaaatcgttgaggcctggttttattgcctttaatttatgtataagacctcaggaagattagtaatttattcagtatcatacatgcagaaagaatctcccagtctccaaattcacatttcttctcagaagcatatttgcatagatcaagagcttgtggcaaccaaacttatgtaattagctcccatctatacatgtttactccacttagccacattcttagagccttcttcttctgaaattctaaaatgggaaacacctgcttccttctggcccaaaatgttactttggtttcagctttgaaataagacctggagccaagagacttcagcaaaaaattacattatatccacaagtaccctgacaaaataaaaggcagccactgccattctctgcaaaagtcctgcaggaagcagatgggtgttaaggactggcccagatttatacacgaacaatgaagcctgagagatctccttgtaagagccctgtggacaacatgctgtcctccaagagaaactgaatatacaaacaaatatgaccagaccacatataaaaatagaactctgactcacaacctgcagcacccagcccaggaaaccaacccttatctccagtaaccacctaggaagccagcctgatgtaagtcagacttgcaggagtcagactgctatctctagtaacaatccaggaagcaaacaatagcccctgtaataacccacccccaagggccaggacttgattaataactgacagctttcctaaatccaaatttccaacttaggaccagtcagagagagctaaatatgctcccctaacctatcacataggatgtcctgtttctacttaactgcccacagcttccccacgttaacagcctccaatcaaggcacacctgaagccttcccttttttccattatgaagcttcctcactctgcctgcctttgaatctctgccaaaatccaagctctgaatacatagcctttgcttgttctcatctggttggtctttgtttctacatcagtatgaaaagatggctctggtggctctgcaacagtacatgcaccttgagtcatttctccaggaggctgatgaatctgtgtgctgagcccttcatagccattggatgtcgaccatcacttatgtggggactcctggcctggtgccttaaagagtgggctctctagttgaactgtctggtctaaattctagagccactatcatgacgtctctgaaagagactcctctctgtcctgtgcacctccaggccagcagcagagacgtgtcagggagtttgggcagagtgagacagcttccttccatggagggcaattgccaccttggtgtcatggagaacttctgccagggcagtgcagaagggaaatgtgagtgggggagccctactggggcactgcctaatggagctgtgagaagacggccaccgtcctccagaccacagattggtagatccaccaacagcttgcattgtgtgcctgaaaaagtggcagacacttaacactagcctgtgaaagcagccaggagggaggatgcagagccacaggggcggagtggcccaagaccatgggaacccacctcttgcatcagtgtgacccggatgtgagacatggagtcaaaggagatcattttggagctttaagatttgactgacttgttggatttcggacttgaatagggactgtagcccctttgttttggccaatttcttccatttggaacagctgtatttacccaatgcctgtacctccattgtatctaggaagtaaataacttgcttttgattttacaggctcataagcagaaaagccttgtctcagacgagatgttggactgtggacttttgagttaatgctgaaatgagttaagaatttggggactgttgggaaagcatgattggtttttaaatgtgaggacatgagatttgggaggggtcggggtggaatgatatagtttggctgtgtccccacccaaatctcatcttgaattgtaactcccacaattccctcatgtcatgggaggaacccggtgggaggtgattgaattatgggagatgggtttttcctgcgctgttcttgtgatagtgaatgagcctcatgagatctgacggttttaaaaatgggagtttctctacacaagctctctctttgcctgctgccatccatgtaagacatgacgtgctcctttttgccttctgacatgattgtgaggcctccccagcaatgtagaactgagtctgtaagtccattaaacctcttttacttcccagtctcaggttgtctttaccagcactgtgaaaatggactaatacacttggcctcatcacaggtgctggggcaccaggctggggaaatttctcacttctctcatctctgagggactgtaagggcactgtaagcccaccaccattgctaaagacaccccccttcaggagaaaaccaagggggcactggatgtgagagatggggctagactggaagagagcacaagaggttgatgacccatacaaaacataatcatagaaaatatgtgctgggttgtttactgtgacacagttttagtgagtgctgacttctttaatctgtacaacaagcctataaagtcagtgctactgtattagtcagttctcacattgctaataaaggtatgcccaagactgggtaatttataaagaaaaagagatttaacagactcacagttccacatggctgaggaggcctcacaatcatggcagaagacaaaggaggagaaagccacgtcttacacagtggtgggcaagatagcttgtgctggggaactcccatttataaaaccatcagatctcacaagacttattcactaccacgagaacagtatgggggaaccaccccccatgatacaattatctacacctgtcacccttgacaggtggagattattataattcaaggtgagatttcggtggggacacagccaaaccatatcagctatcatcattcccatttttcagaaaagaaaactgagggacagaggaaggaaatcacctagccaaggtttaccagctcatgacagtgactctggaatttggatcaggcagttcaactccagagcccactctctaagccactggaccaggagcccccacataagtgatggtcaacattgaacagccgtgaagggctccccacacatcttctcactcggtcctcccaacaggctgcagaggctggaaaaatgagtggtggtctcatccctgcttcatgagaggcagtgaccaggaacacggaggtgaagggagatgttggttaatggcgaagcctggcctcaaacccagctcttctgatttctgagaccattgcttttgctattgttgtttgtttagcttttttccaagtgtcatattggtgtgtgtgaatttaaacacagaaaaaagactgcaactgagtggttgttatagactaaattatgtctcccaaatttcatttgtggaagtcctaacctctagtacctcagaatatgactgtatttagagacagggcctttaagatgaaatgaggctattagggtggccccgatccagtatgactggtgtccttgtgtccttacaagaagaacatgaggagattaggacagagaaatacaccaggaatgcatacactgagagagaacaccatgcagagagggagcaaggggacagccgtctgcaagccaagaaaaggagcctcagggaaaagcaaccctgccggagccttgatcttggacttctggcccttgaactgtgagaaaataaactggtgctgtttagcccatccaatctgttgtattttcttatggcagcctgagcacacgaatatagggaaaagcatctaccagttactatcgtattgccaggaggctgagaatggcttacccatgggtccagctagactcctctagaacctacatgtggaatttctaaaggaggaaagatctctggtctctgagagggaggaggcctttggggcaggggcggtgcttacggtcattcggccagtgtctgccactaaggtcagggccagaatctgactcaccgctgatgggaagaacacatcagctgagaaagaactgcagaaatgagttcaaatgctcagcagctgctggccgaaggccattccaaaatggctgttacaatctaccctaatgatcagacctcctcctcgcccacagtaaacatgctcccttctcttcaaactcgtctttttctctgatctaattgtagacttacttatttggtattttaaaaatcactgcagtccatgaggctttggatttctcctcctcaaagcaggcaggaaggaagggagggaaccagtgtttactgagcgccaggaactcaacatcaaggtcaagcatttactaaatattcactgtgatcgttaatcctctggagacacttcagaggtgtgacacggagaactgggtgaaatcacaaagcctatttaggtatatcctgtaacttctgaagatagagaatggcacttttttctaatgagtggtttcccaggcagttggcttttatagtcttaacctgcctcttttcatataaagcgaattctccagctttctttcccattttttttctgaccaaaattttggtctacaggcattctttaagtactcataagattcgttcatctagagactcactaccttgttttaatagaacatcgtccttttctaaaatatgtttaaaaacatattttcaaaaacaatatgcacatgcatctttactgaacactactcgtggacagggcagggtgaaacaaattcccaaaccttgaatataaataaatattcaagaggggagtattggaaagaagtagctgctaataatggcagaaaagctcttctcattttacaattttgataatgatgagtatgtgtgattctaacttattacagtaataataacacctatatgaacagaggatacaatttaatgacatattttactatcctttatatatacatatatgtgatcaagcatttactatatatatagtatatatatgctattatatataatatatatgctcaagcatttactatatatactctatatatagatatattctctatatatatacagactaaattgtctcccaaaaaatatagagagtatatatacatatatacatatatatatatatagagagagagagagagagagacagacagacataagagaaataaggcataggggtcattccaagatttcagaaaaagattgttcaatattaactataatggtgtcatatgtaacaaataacatatttcatgaattcgaatagaaatttaaataatgcacttataagaaatcataatatactggctaaaagtcaatcaattctacttggatggatggagttctctgcaggcacagaaataaccaaggaactaagcacagaactaaccagggaacaaaagtagcaagctcaacagatgaacatttattcaatcaagtggtgaattccaactacctatgtgtccccagcatggatttaagtgctggggttgaccaacacgcaccaagtctctgatgtcatggagtttatacaatccaaaacctgtgacagtttcctggcatacagtaaacatatggtcttcctccttttctccttgtctctccagatgtcaaaggtcaattgatgtcaataaactacaaagagcaaacagcaagccatatgtggctgagcatatgattcattgccaataatatttcccaacatctgaaaggcttttgtctttggtcaattgccttgtctctattgagttcatcttccaacatttacttctaaaatatgctgaagctattttaatgttgccttactgcaattattaagctagttacaagttaatttgcctatgtaggacctttagattattagagcttgtaacacaacacagagcagccaagatggtgagttttgtgttgtgctggtaggctatcctccatagtcaaatggctttccctcacagcgtagttgagatagcggcctcatcctaacgcagcaagacacaatctttctgtctcagcaggccacgcctctccttagccataaaccagatgctttatcggaacaatcttggcaaagttgaaatccacgaagagtcttggcagattccacaaagctctttcattttctctctctgacttagcattggagactagtgtgaactttcttccaggcttaattctatttccctaaatcaaagcacaatttacacatagctatttttactaaccttttacacatgctgtgatttgtttcactgatgaaaaagaaatccctcaatttcgaaatctgcttgtaatatgtattgcttggttagaaacttctatctttattagatgtctctgcataatgcatattgtgtttgttcacaccatgcagagttgcctgcccagatctgaaagctgtatgattttaaatatctgaaactgaaaatccatggaataacttaaccttttgcctgctctgagaacttttacttagcatataattgattattaacttgaacttttacttagcatataattgattattaacttgaacttttatttaattgctgtttaattgatttatctcacttattggaagctgatatatttataaagtttttttggcagagttataagccgacctatcacagcgaattctattactatttgaatggacttgcatttttccatagcaaagtccacgtaagtcaagttattaatgtttttggttactttcattagcatttatatttgccttttagaatcagcatacaaatttgaatcatacatagagagaaaatagctaactcagtacttatccttgtgatttttttaaatcatcattatatttctcttttactttaataaacttattttcaagtagaaattatattactgttattagggctatttttgaaaacattatttgtaactatattttgtatttttcaaaagaacttacattctaagtattagtgacaaagaaaattactaactttgaaaactccagctatattatcattaaaccacttttgaatgagcaaataacttataatcaattacaatttttcaatatatggccccatctcaatgtctccatttatacattcactcatgcatttatccattcctccactcaataaacatgtattttgcacctgccatgtgtcaggaactacactaagcactggacctgcagagatgaatgggataggacctctgtcctcaaaaaatttatttcattgatttggggatggatcaggagtgaacactggtatgggttatgagagaggtggcaaaaacatatcaatttcctatttttttgaattggaggaaatgtatgaaaactgcaaaccttggattagtgaaaagcaagttcctttttccttttaccaagaagatttggggaaagtagtcttccttctcttgcatgaaaagccagagcaggaatattgggatgaatcctagtcagtacagacacaggctagcaagaaaagcctcctggaaaaagcaagggcaccacaaggttaataaggctgttttgaggaagacagaagcaggtaaagaggctctccagaaacccagaactgtgcaaagaggctggcactgtggataggaaatgacaggaaatctgacaaaaggaaacttataaatgatgcctgcagaagggaatcagccaacaaagaacctaatttaaggaaacacaggtgtttgaagggcacagttaactaaatttagattctagccaactttgtggtttggctcagtgacttgtcatttggggttttaaagccatcaggatgcaggttaagaaggacccgatcacagcacgaataaccagtcattacagggattctcagtgaacaacacaactgaacagatctaagtgacaacatgggtataagatgcaccttccctgccctgggaaaggaggatggcctttagataagggaacaatgactgggatgcctaaagctcatcatgtgcactcaataaatccaagactgtgtcactctggtctagtgagagttgcttcagtactgttctatcaaagacttttccaatagaactatgaagatcctattttctttttcaccacttccttggccacttaagccatccacatccatgggctcaggcccacataaattaacagagaatattaaatcctcggctgtggcaaactctgccaaagaatcaggcccacatgaccattctctggttattgccaattttatgtaacttgagtatctagctttttttcagactttaggctgccctcatcttaaatctgtttgccacttggtctatgtcttgatctttggatcactggtcttaaaacaatgaatattacttctggatgatccaagcctgtgggtcacatgaagctatttgctctttcagtgtgttcagagtggtgccatgcaaatccccacctggaccccaaggaagtgtggtctggtcaggcaagcatacctgtcagagggagtgtggtctgtggacagaggaccacagacaatagaagagaggggccaaaactgagtagggaccagattgggggcttctgtttgtgtgaccaaagctgtaagaagccacataaccccagaggaatgtactgtttcaaggaggtcccactagaaataaga

SEQ ID NO: 655 - DNA, 45915 bp, Human
  misc_feature (1)...(45915): n = A,T,C or G
gccattagtatgaaactgatattaatataattgcaatttgatagtatttaaacctattttttagcatgttaataatgctaattgctatttttaaacaaaagttcaaaggacataaacttttctcaacataatgcttttctcaagacaaaaattgcaaatcattacaacttactaaattgtcctggtctgtgtttctggcttttcattcttagtctccatggaggagtaagaccatcaaaaaccgaggccctgccccataaggaggcagaacctgtccagcaggcccccttcagcctcccagtgaggaactgggagtagagtgtgttggagtttccatttaggtacccagtgtcacagactaatgaacagaaaatgtatagagatttcttttgctcctatttctcagtgttttcacaacagtgtgaactgtgaaatagattgacctcacctatgatccaggaaagggcggaggcagtttgagcactggctcaagaaaagcatataataaagtagaattcccttcattgtatggaaagacaacaaatatggccataaagatggccactcctggtgccattttggagtgaatgctgagttctagagatgatgattttatcagcctagactttagacttccaaatccttctgagaggtacactaaaggttcccattcctagcataagctcaatgcattatgataaaagattcccctccctaccagtttaccagcagccaggattgctgggtaaaaaaatcttatatccattcatgacctaaccctgtcttccgttctcgcattggtaagctgatccaggtctgtctgtctatcatctaatcatggctctgggtttctctgtatcttgggcagggggtggggggtaccctaaagagtcatttatttctttcaagttgagactttcaaacactagcagtttgattgccatgacagccaagacccctattcccggaacactctcttcccttgctcctgtttgttgctgtactgctcccctggttttcaagtgatttctgcctgcgagagcagggtttgggttattctgcttagcccagctggtcctcaccttcccccagactctctgagctgtaggtgcaggatttgccctcctggtcgtttcccactgctcaggcctcatccacgttcagcacgtacctccttagatgttaaaaactcttaatgaacccaccatcagtgatgcccctgcagacaatgccaattgcctctctccagggacccattccagtcctgcacccaggccataataacataggagttaaaaagaaattatttaggcagatagtgagggtaaggaagtcctcgctgaggttttccttttaatgaaaagcagcccccaagtcatttcttttctaacaaaaagcagcctgtaaaattgagctgcagacatagataagcaagctggaagcttgcacgggtgaatgccggcagctgtgccaatgggaaagggctatctgggagccaggcatgtccaacacggtggctccatcttcccttttccttgccaaccacatgtacagtaaggagcagacaacatggtgctgaccaagtagaaaacccatttgcataataataagattagggtggggtggccaacttcctcctgtgctatgtaaatgtcacatgtggtccaaccaatctgtgggccctatgtaaatcagacactgcctcctcaagccagtctataaaatccggtgcattttggcgtgggctggaagacccacttgggcactcctctctctctgcaggagagttattcttttttctctttcttttgcctattaaacctccactctttcttttttttttttttttctgagacagagtctcgctctgtcgcccaggctggagtgcagtggtgcaatcttggctcactacaagctctgcctcccgggttcacgccattctcctgcctcagcctcccaagtagctgggactacaggcgcccaccaccacgcccggctaattttttgtatttttggtagagacggggtttcaccatattagccaggatggtctctatctcctgacctggtgatccacctgcctcatcctcccaaagtgctagcattacaggcgtgagccaccgcgcccggccaaacgtccactcttaatctcactccaggtgtgtccatgttcttgatttccttggcatgagaccacaaacctcaagtattaccccaggtgaacaacactgcttcaatttctcccatctgatccagctgggttccactctttcctgaaccctttcctccccaactggccagggagcctgcatcagctcaggactaccttcaggttatgatgtgggaggttttacatgactccaaaaggctgcaaaaatggaacaacaaaaaaagctttcttatcaggaatgactggaggaattacatgtaaaaatacattcccccctctagctgatagcagaaattccaccttggaagattcattcttagaaactggggagacattgtctcctggtgaagtgcagcctccctcaggagaggtagacttcattggcatcaacatctggagtgggtacatttctcagatgctttccaagctctggtagagccaggccttcagagcaagctcacattctgcaagtagttatgggagtcggtgggcggggtcagtcctggcaggtgccttggactctttgctttcctgccctgagccctgaggaccctgactgcttctctttcgtcccaaagctgctccaatggaactcctcccctcttgaaattaggtgtggggactatgggattcacaactctcctgtcattctatctcttctgtaattgtgacttagaaaaaatgcacagaccgtattcattttagcagtcattcccctatgaagtgacatgtgaaataatgaaatcaagaaggcactgtcttgctctcttcacctctggtctcaactgggccatttgaatctccagaaccatctagaacaaggaagaccacctggcgaagtccctcccagcacaggactccaggcaacctggcaccagtcatccccattggacaagaccagagctcagatgcattggcagaggggacacttttcccctttagcagctactggcgtctgatcatttacagagaggttgggtagaaccctgaggaacccatgatagccactttccagaagacagcccggggcctcaagcaaaaactcaatggtgaggacagtcacccagacctggacacaaggcccaagtatgagcagaaaggggtggttacacgtccaggatgtcagctgatactgaagcatctgacacactgttctgaaacagagtctgttggatgtggagttaaggttttgactcactaaatgctctgccctaggggataaagtggaaatgtccttatttcgcaagggcaacagcgaggtttccagccttcaggcccagcagtggttctccagcttccacaacccagaccttaagcactgtggttgcagcattcagaccccgggccacaactgtgcccagctatcaaggccgggattgaggggagctgactcagctgcccccatgacttggttcagaattgactcacgggcctatgaaagtgctctgggggtacctgtcaaagcttggtcttggccagtgaaagataagcattcaagttaatgggcatatgttagtactcaccagcaggaaaaaactagaggcttcagtgcatcctaggatcctgggggaagaattgtcatgtcctcctaagaaggcagaattggtccaaacaagggacagtgaggagggcagggtaaacaagccactccttgccacctacaagtgccaatttgccctaaattttcccagacagagcccacaggtcagattttgatgtttctgtatctggaccatgacccagtttgtattcatagccaatccctaatctcatcatcatctcagtttccagttcctcaaagaagtttacccttgaccccctaggcctggttctggctctgtggagggctcaggcagagcagaatgcatacagaggctttcccattctcccaggatgggcacaggacctagccctgagagcagcaggcaccctggacttctacaaaagtgtgccataggccaggcacggtggctcaagcctgtaatctcagcactttgggaggaggcgggtggatcacttgaggctaggagttcaagaccagcctggccaagatggtgaaactctactaagaatacagaaattagcccagtgtggtggtgtacacctgtaatcccagctacttgggaggctgaggcaagggaatcgcttgagcctgtggcggggtggcggaggttgcagtgagccgagattgcaccactgcactcctgcctgggcgacaggagactctgtccaccctctccctaccccacaaaaaaaaaaaaaaaaaaaagtgtagcatgctgttcaaccaccagagggcactgtgggcccctccagagacggaaaggaattgagctattaaagctcctgcaaggacaaggaactagcagaaagaagtagtgaaggctttgaaggggaggaagatgctctcagtggctcctatttcatgcagatggaggaaaaccaaccaagagcatgcgccaggtcctctccagatgagactggcaaagacgaagcagcaggcagtcacgtttaggcacatgcttgcgaggatttccttactgtgacaaaaggtcccttctgttgtttgtcacaagtgcaaaacctcacagctagcataatgaaacaactgagatgcactcagtaacgtgggctggaaaaggatccccagtttttcgtttcatagattggaatctggtaggaggcccgcctggggatggccggcagcaggcagagacctggattctagatcctcccatttgcaagaatgtcccaggtgacctcctctcggggatgctagaggatgaggacagggtgaagaagccagcctactgggggaaggggggtctttgggaccaatcaagagtgcttagagaggggtcctctgagatatctggacactgaccgcttcccaatgaattgcctatggcccgctgcttcagaatcacagggagcttgcctaaaatgcagattctgggatgttggctctgggtgggaatctctaggattcaggcccaggaatctgtgtttttaaccagttgaacaagttttctaggtgatttttgtttgtttgttttgttttgttttgccacaattaggtttgagatccactgccctacgactggtcctttatctgacttaaacatttgacaaaggagcaaatctaactaaggtatctgtggtgtgggcagcagtagagcctgcaacttaatcacaagagctgtccttgtcctgtgaggtgacaaccgagagtttattgtttggttgattgcttggtttgtttaattgtaatgttttgtagtttaattgtttatttattaacagctttcagaaacagtaataagaatagaatgtgaagccaactgcagaagaaaaaactaaactgagaagggaactaaataaaaaagcagctgggcagatgagatttgggggtgcagggagcaagcatgtggatggagggaggagattaatattgagccatggtcatgagaacttcagagagagatggatgagtggaggtggcccacacggtattctcttttagtgttaaagtctcaccaatgcaccacgacgtagcagtctctcgttgtgaggtattacctggagttctttgtctcatgacccagagaattaaggagtgtggacacaaaaggtgagattggagcaaaagttttctaagcaaaagaagaaagctttctgccatggagagggggcccagaagagggttgctgtctttacagttgaatgcaaaggcttttataagaaactgatgagggctgggcatctcatttgcataagacacaaatttctgttagctccaccccatcctccaagtgtgcatgtgggcccttagcttagtgactccatattgctttgttccccttactgtacatgtgttacgggacagaactttccactgcaggcgtgtctgggtgagtcacctgtgtagcttttcttatctatgtggctgtgggcgtgtcttaggcaagcccctctgtgcaagttggctgttcttttgtttgaaagaatttaactgagggcccaccctaactgcctgcctgactggcttcttcctttctcctctctcggtaggtcatggattggctcctgctttgacaccgccttgagggacttaagatgttggcatgatttttgaagctttttattggatattgggttgatattatatttgaacatgaagtcaccctgaggtgtgctgtcaggtggccccattgtatttggatacaggcagctgtgaaatgcaggggagcagttaagaatattaacaggtccccagttgaaatgctttaatggcagtggtacatggcctgttcctaccccacccaacacacgtcacaaccccaacccctacccccaaagcctattctcaatatggcagccagacttagcctgttaagatgagtccaatcctacctactccaccttcagggtgagagcaccccctctgaggcctgtatgaggggcttctcccctccctcgtaggtctgctgcacccactggcctccctggaacccaggccactcctgcctcaaggcctttacaccagcaatcccctgggtctggagcttcctccccctggaagtccccacagttcaccctcacatctttaatgtttttgctcaaatgtccctgggggagcctgctccaaccacgcctaatgctgcaacctcccacacctggctctcctgctccctctcacgtgtgtcctttcttcccccaaaatatcccatttatcatgttctaacacgcaacatgatttgtttattgtgtttggtgtctgtctcttgtcactatcatgtaagctccacagggacaaaattttttatctcttttgtttgttggtatatccctaccgtcaaactcatcagcgcttaatacagatttgtagaatgaatggatgaatgaatgaatgcctctaggctcccagtcagtctgagcaggctggtttgcaggtccggagcttctccgagcagcatctccccactcctggtccccattgggtcactggaatctcactccccatgcaccaggccacgtcttgatgtttgatgggctgggctcccgctctggttctgccccaggactcccttctgcatcctgccccgtggtgtccttgcctatgcccctctcatcggtgccactgccctcccgaatgcagcctgggcgtctctgctgtgagctcccgtcactgggctctgccctctgtggacacactgtgccacttccccttctatgtcactgacctggacccagtctgaaggttgccctcctgttaaagaaacccaggacctgacagtaggtaaagtaggaaaagcacattttattcaggaagtattgcaaagggggaaagaggcctcagtgcatatagaacggactcagtggttaattcaaccagaacgagtggggatttatagccatggagcaggctggcagtcgggatggaggaaattactaagagaaagcagcagggggaaggaaagcttctggttaaacaggcttaggattcttgctgaaggcaggccagggtggtcagatgcgaaggatgggggcctctctccacactgacttaggagggacttgctaaaactggctgatgcaggcccaacgatgacaggcacagaagcccagggttgaggccccgttgaaagagagcttcgaggagcctgacttaagtgcggcctcagagcgagtctttgtcctgggaagcgggaccttttgctggcaaggcaagcgcctgccctagcttgaccagggtgcggagcccgccctcccctgctgctgtgccttgagaatcaggcagatccagaacaggaccaggccagaaaatcctgcggctgtgggacgtgggcaggatgaggccttgctgtgaatgtccctgagaaaaatgtgcctccctccctttctaaaaaggtttcctgccgtgaaaatgacacccaggaaaatagaacaggagaagaccagtctcgggaaccacacctccgggagctcctctcagcccctagccagcggcccctctaggcccacagtccctcctggactggagctggggtcgttgttctctcaaggaagcagtgaggagtgtggacaggcccagggaagaaatgcctgactctgtgcttcgtggggaaggcggggaagacagcagggattggagctgagaaccagaggccagaggacgccctgagacaggacttcctgaaagaagccctgggacccccactgccaagggtccaggtgaggaggggagatggggtgggggctggggctttcaaaggatcaagttttcaccacccatactttttgggattcaggaggggggtgttggagtgaacactgggcttcagcttctgtcctaaaatacctaaaatcaaaataaacccagccaggcgtggtggctcacacctctaatcccagcactttgggaggccaaggagggaggattgcttgagcccaggagttcaagaccagactgggcaagatagtgagaccgccccccacccccgcacccccatctcttctacaaaaaaataaaaataaaaatttgctgggtgtggtggcgcacgcctgtagtcccagctactcaggaggctgaggtaggaggattgtttgagccaggaggtcaaggctacagtggaccaagatcaccccactgcactccagcctgggtggcaaaagggagaccctatctccaaaaaaaaaaaccttaccctgaaaatttaatttccttctaacacatcatcctgatccccaggagagattcatcatccttctacttgactttcttctgttgaactatctaacctggtctatttcaacaaatactatttcttgacaaccactaacctggcttgggctttattaggctaaagaaatgcctgcctccagaattagattctataaagttttcttttgcagacagatagtggaagtgcccaaattaatcattttaatttctcagaagggaagaaaaaatgccatttgatccaaccacataggcaaagtgcctcgcacacagtagctactcggtaaagctgagtcacggctgtggttgggaccagggagggtacccttcccttcacatgcagtgtcctgggtttctccctcccgacccttctcatcaggagtccctggaactgaggtcccacgaggcttcaggtgccacagcatgggtggcagcttctgtcatgccagccacaatcagtgaccccagataaggttggcagggtgatcccaaagagaacggtgacttcagccccagcacagggaggccgatggctggggactgggggaaactcctgtggacggggttcctgagaatggcctggaaagaaaaagctaaaaaggtggaagtcagacagaacacagctcatgccacttcaaataggaatttgcccacatctaggccaggccctgtcgcctcttgtctctctcagcagtattggtgcctgaagggatccattaagggatccagtgtgaaattttctggcttggctcatagaccgtcctgtctttggaatcaaagagcagacacagatcaatgcataaggtgaggagtcttgaattcttaactatttctttccttagtgaaagagagttgcactggctaagtgtactgagtttaaagcctcttgttccttctgcaaaatctgcaggcacagcagcctgaggcatctgcccctaagccagggtcagagctgggggcagcaacaggggctggggacccgagacagccccttgggtttcccttgcaggtgccaagaaccagcaagtctcctggggattgagtgccttgtggggcacttgggcctgtcccattgtcctcctccaaggaaacttttggggcactctggctctccagggctggggacggctctgccccatgtcaccaaggccctctgcagggtgtgggtgtggacacagctagtagcacgagccgtggtcggtctgcagttccacctttgcagctttgcccttccctgtctgccaatctgatcccaatcctgtctgtgcccatcccaaccccctatacctgaattacatcagcctagaattcacctgctacttccattcctgccttcaaattctgacctttacctgtctggccaaggagttttgtccctcctcgatgtgctgttgtttaaatgctcccaaggaaatgcctaccccaacccccaaaacaggatcagggaccagggtttttttttttttgctgcttccttctaccttcaccttcagtgttgcagagcacccatagcccgctgaaccaggggttccgtgccatctgcaatgctgtgtatgtgcaagaggtgaggcagagaacagggaagcatacgttcccactcctaaaaattcccagagaaaaatactttctgtgagtgtcaaaacatgatgggactgttcatgaaatcagtccgtgaagtcagctgtgatcatgatgaaacatgagccatggttctgtgggttctgaagctatacaaatcacaaattcttcatcatgatagaaactgaaaacctaacttgttcaacatatgtttcttgaattggatatccagacgcaaaaaaaaaaaaaaaaaaaaaaaaaagaggagaaagaaaaaatctcaatcataatccaagaatctgataccatatacaaaaattaatttaaaatggatcatagacctaaatgtaaaactgtaaagctcctagaagaaacaggagagaaaatatttgaggaggtggtaggctggatgctttcccaaaaatgcctacctcctagttcctggaacctatgaacatgttatgttacctggcaagagactttgcagatgcaaggaaagagacagatcttaaaacagggagtgtatcctgggctatccaggtgggccccacctaatcacatgaccccttaatagcagagaactttctctagctgcagcagaagggaaaattagatattccagtcatgagaagttctttaagagtttatgagtcaggattgccagctagcagagtgagggcctcattttcaaggatcagagagaggcccagagagaggatcagagagaattccaagggcgaccccagttgaccccagcaatgaagctggcagctgagccccacaacctcgaggaactgggttctgcccacaccctgagtgaacactgtagtggatttttcccaagcctcttggtaagagcccagacagccaacactttgactttggcctggtgagacccagagtacagaaaccagtcaaggagctcagacttctgacctacaaaactgtaagatcataaatttgtgttgtcttatgccactaaggttgtggtagtttttcacagcagcagtagaaaaataatagagaccctgggttaggcaaagatttcttagctagaacataaaacacataaaccataagagaaaaaaaaaagaataagctgaacatcaaattaaaacctgatttttggaagatacttttaagaaagttaaaaaagaaacaagaaaagatgaggacaatatttaaaaacacatatctcatgaaggactggaatccagaatatataaagaaatcctcagccaggtgcggcgactcatgcctgtaatctcagcactttgggaggcagaggtgggcagatcacctgagatcaggagttcaagaccagtctggccaacatgatgacaccctgtctcaactaaaaatacaaaaagtagctagatgtggtggtaggcacctgtaatcccagctactcagaaggctgaggcaggagaatcgcttgaacccagaaggcagaggttgcagtgagccgagatcaagccactgcactccagcctgggcaacagagcaagactccatctcaaaaaaaaaaaaaaaaaagaaaaagaaaaagaaagaaagaaaaacaaatcttagaactcaatagacacaaaatattcaattttttttaagtgggaagggaagatgatttgaacagatacttcatcaaagaagatatacaaatggcaaattaaacacataaaaagatgctcaacatcactagtcatcagggaaatgcaaatgaaagccctgatgagatactgttacacacctattagcatggctaaaattagaaagactggcaatactaagagcagacaaggaggcagagcaactggaaatctcatgcatgtaaaatggaacaatcacatcggaaaacagtttggtagtttctgacagaattacactaatgtttatcatttggcccagcaaccccttcccaggcactgaaataaaaacataggtccacgcaaagacctgtacatggatgatcattgcagctttatttgtaatggccaaaaactggaaggaactcacacaccgatcagcaagtaaattggtaagtaaattgtagcacatccatgtaatggaacattactcagtaataaagaatgacaagctactgatacatgcggcaacagggatgaactccaagagcattaggctaactgaaaaaagccagactcaacaggccggtaatgatataatttcatttatatgatgtccattatatgacattctagtggaggcaaaactacagggacaaaacatggattggtggttgccagggatggcacggcaaaagaggagtgactgccaaagggactgagggagcgtctggcacgatgggactgccctgggtcttgactgtattggtgtcatgtggttctacatttgtcaaaacaaaacaaacctacattttaaaagagtggattggcccagtgcagtggctcatgtctaattccagcactttgggaggccgaggcaggtggatcatgaggtcaggagatcgagaccatcctggccaacatggtgaaaccccatctctactaaaaatacaaaaattagccgggcgtggtggcgggcacttgtaatcccagctacttgggaggccgaggcaggagaatcgcttgaacctgggaagcggaagttgcagtgagctgagatcatgccactgcactgcagcctggccacagagcaagaccccgtctcaaaaaaaaaaaaaaaaaaaaaagagtggattttaccgtatgtcaattatacctgaatatatctgacttctataaaaactacatgatgatccccacttccactaaaaataaaaccccctatttggtcccacctggcccacatgatcccctaaattgatcattattattattcacacttttcgaagtaacacatgtgttttctagtcttttcctgcaattatcttttagaggagggccccttgaaagaagaagttcccaggagagatcagtgtatcattatgagcttgagctcttccccactttaagccagtgtaatgatttagaattaattgcctacttttctttctgtcatctgcgattaatattttattgccaaagtaaatgagaattgtttttaaagggacagcacagcctatattgactcagggcatttgtttctgtctattgtactggaaagccatggttggattctctgaagcgaggacactctggctatcatccttggaagtactgacagcagagaccacagaaaataaattcatgctcagcccagacctattttggctgcagtcacttttcttggtggagaggagcccttctcagaaagagcaggaaaagcacctgctgggcagtgctgctgcagatcccatccaggttctctatttttaatttttattttatttatttatttcagatggagtctcattctgtcaccctggctggagtgtggtggtgccatttcagctcactgcaacctccacctttcaggttcaagcgattctcctgcctcagcctcccgagtagtgcccgccaccacgcctggctaatttttgtatttttagtagacggggttttgccatgttggccaggctggtctcaaacccctgacctcaagtgatccacccacctcaggtcccaaaatgctgggattacaggcgcccagcccccatccaggtgctctaaacagctgaataaaatccaggaacaccctagactgaggacttcaggatgctgatgcgctaattagctatcagaccaggtgcacaaaatcggagctcaccaccttgtttattttgccaactgctaggggtagaataaatgaaacaaagacctactggccagatgcgttggctcacctgtaatcccagcactttgggaagccaaggtgggaggatcacttgaggccaggagttcaagatcagcctgggcaaaataatgagaccactccccctccccccaaccccgtctctacaggaaaaacttagctgggcatggtgacatgcaactgtagtcccagctaatctggaagctgaagcaggaggatcccttgagctcaggacttcgaagttacagtagctgtgatcttatctctgccctccaggctgggcaatagagtaagactctgtttcaaaagaaaaagagctactgactcagaaaggctgataatcacaatgagctttcaaaggcttttccagaggactgtttttttcactttttatcttctatgctaccatatatcattgcatccaggacaccatagatcgtataaggcaggaaaataagttgcaaagtaaactatgccaccatgctttttcatttcttaggagttgtactgtatatttattgaagcttattcggacagatgttcatcctatatcacctttggtcacattaaaatagagatgcaaagaaaatgagttggttagggtgttccttaaatttgtttcgtccaacttttctgaatcacatttcaactcaaagtcatcaaatttcatattttatcagactttcttgtcttctacagtcaagagttggcaaactttttctgcaagtttcagactctgccaggccctgtgctctctgtgacagccactcaactctgccgctgtgaggcaaagccggccatacacaatactgaaatgaatgggcgtgggtgtgttccaaaaacaatctttatggacacagaaatttgaattttatataattttcacgtcatgaactattttcttcttttgactattttcagctatttaaaaatgtataaaacattcttacggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagtcgagatcgcgccactgcactccagcatgggcgacagagcgaaactccgtctcaaaaaaaaaaaaaaaaaaaaaaaaacattcttactcgcaggctatacaaaacaaatggtaggctggatttaacctgtggaccgtggtttgccagccccgactgtatgccactgggagaattggtaatgcagtgtatcttttatttatttatttattatttatttatttattttgagacggagtctcgttcttgttgcccaggctggagtacagtagcacaatctcggctcactgcaacctctgcctcctgggttcaagcgattctcctgcctcagcctcctgagtagctgggattacaggtgcgtgtcaccacgcccagctaatttttgtacttttagtagagatggggtttcgccgtgttggcccggctggtctcgaactcctgacctcacgtgatccacctgcctcggcctcccaaagtgctgggattacaggtgtgagccaccgcgcccagccaagtgtatcttttaaaaagatatactgcagtctccaggattctctttgggccactgacagctgtttctcacatttggttgcaggagaatattcatcaggatagagttagttatgctgcagtaactatccccaaatctcagtggcttaaaacaaaggtttatttctcactcatacgagatccctggtgggtcagggctactttctagggcagccaccccgtgtaacagttcagctttagtcctccatgtgaacacgtgcaccctcaatattgacaggggaccagaatgtggaaaatcacacaccacctcttacaggctttccttcaaaagtgacaggtgtcacttcctatttgcaaaaccagtcacacggaccagtagtttaaaaatgtatctacccatcttcaaaaggtggagactaattccccttcccttgcatgtgggccagacctactgcctcgctacgactatggcagacattgaaatatgtgacccgagaggccaaatgcaaaaagaataccttcaactggtgtgggcccactttcagatggtgcattctggtgaaggccagccatcatgtcacaaggacactcgagcagccctttgagagcaccagatgaagagaagcctatgtggagaggaaccagttggccagtaccaacccactgggtgtgtgagtgggtccctcagagtggatcctccagcctccatcaagcctccaggtgatcccagcccctcagccttcaagtcttccagatgaggcacctcccatatgtctgtgtcctgtctgaattctcgatccacagaaacagtgagataataggcctctaggtttggagggtgatttattacacaggaatagacaatgaaaaaagtacacatggcttcacctaatctcaaaaagataggagaagttcgagtttcccattggcttaaagaagggactaattattggtaaatgtcttgatcttattacaacaaggtgtcaatgaggaattttcaaacaaaaacctggactcacattccttcctctaatggtttgtaaatggctgctgactgaaacatcaggggattgctcttgccctaagatgctccctggaataatgtctgaggtcatagacgcacaggccatggcacagaagctggacagcactttttagtctttttgaaaaacacatctagattttacattttacattaaaatgtaaaaagaatgagcacctggggatccatggaaataatatatcactgtctctcagtcacatgctctcttatttttgcctgtgttgtggttatttgcctttaactaggagatctgtggtggtagatatggagataacgtgagaacatgggcagaaaaagtccttatatccaaagcaaagcaaatgattgactgatgtttctgatttttaaaaaattgttagtgctacataaactgtaagtataataattacaactaaggttcatctgaccttaactcatggaaatagtctagattcaattggcccagaatggtcctataattgtatatatggacaggaatataaatttctctatacacatacatatgcatatacacatagcatctatactatacttagctttaggtaacatgtatacctatatatcacaactagaaataaaatttcctttcaaattagccattaacagattcttaatgatgaatagtgatcttgttagtagttaactggtaacctttatattgaaatagcaagacatactagaatgcaagcaagaaacagcttgattctttttcctggggcccattcaaaccctattttcaaatccaacctttacctccctaggatgaaatcttagatgagatcccatagttttgtctagtcactttttcaaaagactgtggaaaaaaaacgcagcataaaatgtaccatcttaaccatttttaggtgtatagctcagtagtgttaagtgcgtttacatggctatgaaacaaatctccagaacttttccatcttgagaactgaagctctgtgcccattaaagaactattcattctccctgctctctccagccctggcagttgccattttatattcaacttctatgaatttgactactttaaacacctctgataaatggaatcatacagtattcatcttttagtgactggcttatgtcacttagcattatcgtcctcaaagctcatccatcttgtagcttatgacataatttccttcctttttaaggttaaacaatattccagattttttaaggttaaacaatattccattgtgtgtatatagatattacatactacaatattacatatcatatcttattacatactatattacatatattataatattgatatatatcatatataagattacacatattacatacatatataattacatatataagatatatatcaattacatgttacatatattatatataagatatatatatcaatattctattgtgtatatatatcaacattccattgtgtatatataaatattccattgtgtatatatatatacacacacacacaacttatagtttgtttatactatatcttataatatgtaataagatcaagacatttaccaataatttgttccttctttaagccattgggaaattacatatatatatatatatatatatatatatatatatatatatatatatatacaatggaacactgtttaaccttaaaaaggaaggaaattatgtcataatttggtgtatatataggagatatatatatatatatctcactgcatttatccattcatccatgaggcatgatggacatttgggttgcttccacctcttgactattgcgaatgatgctacaatgagtatggacatacaaatatctcttcaagctctgctttcagttctttctggatatatacctagaagtgggactgctggatcatatggtaattttatttttgattttttgaggaaccttcatactgttttctatagtggtcatactattttacaactgcaccggcaatccacaagtgttccaatttctccatatactcagcagcccttgttattttctgtgttttgttttaatggtggctgtcataatggatgtgaggagataactcattatggttttgaattgcattttgcctagttattctaaataataaaagtcctttggtcattatcagctccaaagaacaatctcattttagtaaatataataggcagaataacatcccccactcccacaaagcttatggctgtgttatatggctatgttgtgctgcattacaagaaggaattaaggttgcaggtggaattaaggtttcttgtctgcttcccctacccacctgtgactccttcagtgttggaacagagcttggaagaacatgaaacgggcaggaaaggccatccttaacaaaggcagatgtaatatgacatttgcatcttctgcgtagggcagattcccagcggtgattctttcttttctataccacactgtgggatcctaggtctaagttatcccctttggactcttgggaaatccttgtctttagccaggtgcttctcactctattttcatcctctgctaccaatagtaacctccagcctctttcggctgaggcccctttcctttggcatgaagccctttggacaggtcgtttccaataacccaaagccagaccctacttgtaagtcctcttggctcacaagaacactctgacatcctctccccacctccaccaatgtgcagttttctctccactgcatatatatgtgtttgtatggccatcaggcaggtagttccagaaacagactttgaccttctcagaggagaaaaaaaaagcttaaaatccataagcatggctgattttacagtcttgaacttcttctaaacaatggcctgaattcattcaacattttcttatgatgagtattatgaactactacttttctattcttgcttttaagattttgcccaagtttattcttaaattagtcaatatgtgtttatatagcatatctacgtagaagccagaattagtttcatgcagaaataatgtgtttgcagttatagtaaataaaatattcataagaacttagaaattttgagataattcacattttatccttaaagcaatttattcttagagctttatgaaagctatatcttctctgaacatttgcccaaacctcccacactatctgactttaaactcactatcattgcaccattcaatatgagcaacgaacattttacaagaactctcaacaattgcaagtaactttacctaccacttcctctcttcccttcccttttgtatcttgcccaaagtttaaggttcccaggggtgcacaggattttcacatcatgaagttaattattgctgatatcatgaactctcatttgtgacataaattataactctaaataccagtttaaacaactttccaatctaaatctatgatatcaaaaccaaaattatcttacaaatgataaattctcaatactttgccttttgtagatcatctcttaaggaaaacacagaagaactgttaacattggttgactcttagagaagagtgggagacctgggaaaatggagaggaaaagatttttttttttttttttttttactaaatatcattttgaaccctttgacttttacaccacttagattcccaattcaaaatttttttaattttaaaattgataatttgtatttgaaagtatgaaactaccacttagcacttaatgttacaagcagaagtcacctttgagatcagaaaatagagttttaatagttttctacgttttaaggataaattaaatgacttatattagatctaggacttatatataagttaagcttggtaaatttttttactttttcttttactttctggggaacaaagatatcctttgctcttagatggcttaatatttcaacagttccctagcaagcagactcaggaaaaaaaaaatgttaaccaaaataaagagagagcttggcttttatggggaaggggtttgtagaaaggtatgttttattggttgatgaatccgtttcttaatctgagggcctacagtccaccaggccccgtgttgggtcccctgggggacaaaggtactaagacctgatgccttccctggaaagatacttgagcaatggaaaagaaaaagtgatgctttgttttctcaaagttggggttggagaggggcaagacttataacacctagagagaagcaagaaaacttgaagtcaaaatgtagtagaaaccactagagcctgaaaacaaggaaggcctgaggacaggagaatgtaatcaaaacaatgggtgaaaaaggctttcttccatgatccaggtgtccacacccaaagcacagtggagaatcgaggcctgaatctcccacgcaattggcccaactctcaacagtgaggaaatgatcaccttgggccaagtagtgtacaagacaaatgttaaagggaaggccccgacctcctaggtttatgtaaggccattgtaagcctcagctttttctcattttaaaatcagaaataatcatacctatatataaaattgttgtgaggatgtgacatattgtttataaaatagctcgcatcatgttagggttgccgttgttgctcaataaatgctatctgttgtttttgctgctgttgttgcctgtaggtaaaattaaatgcagtaaaggcagatcctatggattggctcattcaatcttcattttaccctccttttgtggtaacttccagcattgccaaatctatgaaactcagaactacatttccaagacttctttacttttagagttctggatgccacttaggttctaccagttagaagcaatgatgtaagatttggaagatggaagggagtggaggccgtctccctctcactatttcttctggcaagcaaattcacaaaggcatgagtgtcaaggggcaggaggagctgtggtggtggcagctgcttaacctccagatcatgctggttgcagtggtttactcttgacatcaatcaggcatggggtttggggtcccaatttcactccttcagctttctagggactttgtcagcatctgattcctgtattaggtcctttctgcttaaaatacctagggtgatgattcttattgctagaactgaatcctgactgattcagaaatggatgctttctctaaagaaatgccacacataaacttctgtgaaagaatatatttcatgctgctgcctcaaacttgcttaaagttattagtggatttccatgtttaaaccaggtcagtgttcttattgatgccattctctttgaaaactgtgaatataacacaactaaagttctctggcatcctgaacagttaactctgtatttgtatgtcatgctgaaaaacagagtatatgtttgtggtgaccataacccatccactgtctttctttatactttacttggttgaaaccaaactgatccttgaaataattttgcctcctgatacccattcttccttccttagtattaagaatcccaatttttggctgaggacacagctaaccagctaaaatttatttcttttctccatgtaagctagatgtattgtctgttcttacactgctataaagaactacttgagactgggtaatttatgaagaaaagaggtttaattgattcccagttccacaggctgtacatgaagcatggctgggaggcctcaggaaacttacactcatggtggaagggcgaaggggaagcaagcaccttctgcacatgctggcagaagacagagagagcaaagggggaagtgccacacaccttcaaacaaccagatctcatgagaatccactcactatcatgagaacagcaagggggaaatctgcctccaatgatccaatcacctcccaccaggttcttcccccaacattggggactgcaatgcaacatatgagatttgggtggggacacagagccaaaccatataattctacccctggctcctcccagatctcatgtcctccttacatttcaaaacaccatcatgccttcctaacagtcctccaaagtcttaactaattccagcattaactcaaagtccaattccaaagttttatctgagataaggcaagtccctttcacatatgagcctgtaaaatcaaaaacaagttagttacttccaagatacaatggcggtacaggcattgggtaaatgcttctattccaaaagggagaagttgggcaaaacaaaggggctacaggtcccatgcaagtccaaaacccagcagggcagtctttaaatcttaaagctccaaaataatctcctttaacttaatgtctcacatccaggacacaatgatgcaaggggtgggctcccaaggccttaggaacttctagccctgtggctctgcagccccttagctgctttcatagggtggcattgagtgcctgtggcactcaacttgtaggtgcacagtacaaggtgtcggtggatctgccattctgaggtctgaaggatggtggccctcttttcacagctccactaggcagtgccccagtgaggactctgtgtgggggttccaaccccacatttcccctctgcactgccctagtagaggttctctgtgagggctctgcccctgcagcagacttatgtctggacatccaggcatttccatacatcatctgaaacctaggcagaggttcccaaacctcacctcttgactttggcacacctgcaggcccaacacgacgtggaagccaccaagacctagggattgcaccctctgaagccatggcccaagctgtactttggccccctttagtcatggctggagctgaagcagctgggatacagggcatcatgtcccgaggctgcacagagtagcatggccctgagcctggcccacgaaaccatttttccctcataggcctccaggactgcaatgcaaggggctgccacaaaggtctcagaaatgtcctggaggcatttttcccattgtcttggctattaacatttctttacttatgcaaatttctgcagccttgaattcctccacagaaaaagaggttttttttttcctaccacatggtcgggctgcaaattttccaaacttttatgctctgcttcccttttaaatataagttccaatttcagaccacgtccttcttcacaaatatgagggtacacttttagaaatagccaggtcacatcttaaacactttgctgcttagaaatttcttgcgccagatgccctaaatcatctctctcaagttcaaagttccacagatctttagagcaggggcacaatgccacgagtctccttgctaaaggacagcaagaatgacctttactccagttcccaataagttcttcatctccatctgagaccactcagcctggatttcactgcccatatcaccatcagcattttggtcacaaccactcaacaagtctctaggaagttccaaactttccctcatcttcctgtcttctgagccctccaaactgttccaatctctgcctgttacctagttctaaagttgcttccacattttctggtatctttatagcaatgccctactttcctggcaccaactttctgtattagtccattctcacactgctataaagaactgcctgatattgggtaattagtaaagaggtttaattgactcacagttcagcatggctggggaagcctcaggaaacttacaatcatggcggacacataaagaggaagcaagaatcttctttacctggtggcaggagagagagaatgtgaaggggggagtgccatacaccttcaaacaaccagatctcaatagaagtcattcactatcacaaaaacagcaagggggaaatccaccaccacgatccaatcacctcccaccaggtccctccccaaacattgggaattatgattcaacatgagatttgggtggggacacagagccaaaccatatcactaggcatacccatgtgactaaatgttgtccagtttgacataagaaaaagtaagtattttgtgtaacttctaggaagtgtctacagaagaaaggtgccgacccttctttgctccttcctgctttctgttggagtgtgcctgtgatgataggcacactaacagccatcttgagtcatgaggtggcacagtaatcatggcacaacagaagagaatgagcttgttgactgtggagtggccacacaggcctggattatgtacctccaggtttgttttacataagaaaaaaaaaaacggctgggcactgtggctcacatctgtaatcccaacattttaggaggctgaagtgggaggatcactttagcccaagagtttaagaccagcctggacaacatagtgagaccctgttcctacaaaaaaaaatttatttttaattagccaggtatggtggcatgtgcctgtaagcccagctacttgtggggctgagtctggaggatcacttgaggctgggaggtcaaggctgcagtgagctgtgattgcaccaccgcactcaggtctaggtgacagagccagaccctgtcttaaagaaaaagaaaaaaaaatctatctctaacttttggaagccactgttattttgttgctgtatttttattatatgcagctgaatccacccttaattagtataatgggaaaagccaaacttcttcccttcacattaaccatggactatttctcagtttctaaaaacaagtatattcccaagacctgcctaactgctcatacacagtagagcacactactaaaaacactggtctgggtttaaagttaaagacattaaaaggatttcactgaagccaattcagtgtacacagtagtcaagtttgtaagccaaacaaataactttgacttactcatattcctttcaaaatcaaatgaaggcaccaattttaggttgagtgaaagacaggtcctcagccttagctgatgagaccattaggactagagttattgattcaaatggctgagttttttttctaaactagccctctgctgttgacagtgtgaccacaccatagctgacaacacatccaatggtgtaatctgctttgcagctctttattccagagcccatagatcagaggattaaaacactgggaaaatgcaaaaatgccaaaacccaccagatttaaagcaaagaaaaataccccacacactttcccctaacctatgaatatcagattctgggtgttatttatattaatatttcagaggagggacatatacacaaattatccacacacacgcaaaggtttgaaagatatactctttgtacttagaaaattgctcaaattcaggtcaaggttttaccgcttatgcatccttttctagtatctaggaagatactgggatctcagggttgctgagggaatgggaccaccaaaatgacaagctgtgcatggtaacttcataaagttttctcaagtgtgcacagcaatgccactgtgtggcagcctgggagaacacccaaattatagcatcattgttgttgccatgatagtctatgatgcagatactgactgttgcctgcccctccccacctgtaccccatccaaagtgatgtaccctgtaagcctttgctgccttgctccttcatcctcaactacagcatcaccttctcccccagcaaagttgattggcatctgactcactgcaagtcattcactagactgcactgagtcagaatatgtctctcaaaaacccaacacaaggtacacaaagaatgtagtctcagagtaatgtcatgcaattagcctgccagtcatgttgtgagcagaagacacagagggaggtaggagagaagcagagagaagtgagactatgaggcctctgagtgtccacaaaggcccttgcaagaagacaaaacaacctttgctcctgaatttccagttccactgagatgccctgcaatttctgtcctcggattctgaaaatatgatacacccctctattatttgaactatcttaaatgagtttctattccttcactctgtcctgtagacttcaaagtataaaaaatgggccctgaagaggcacaataaattatattgatttcctaaagggcatatcacaatggagatacaactattttaacttcctgagaatctgaaatgtcataactctttatgaaatccctcactgaaggcataattttcccccctgggtattgtgttatcctctttttgaggaaaactttcttttttctgatggatttttggtgccattgtcttgtttttgaactccaggcatttattttctcttctctccagctcttcagagaggaactgaattgtaatggtcattgtcattgtgaaagtcatcatctttgaactgcagatgtcttttaaggtcagactttttgatcaagatctaacacaaaaacctcttaatattaagcaggaaaatgcatatctgctcccatcaagtcctttttcctgaatcgctcactgtcagagcataccctgaaactgtcttggcaccaccatagaaactgagagccctaatgaagactgtatgaaaatcctggtaagttagaacaaatgctccgcccctggactaggcggatcacatgaatgtggcttgaagcctagatttgctgctaacaaggactgtgactttggatattgaagtcgctttgcttctgtggtccttggagctgtgcagcatcaccaggctccacatctgttctatttctacagtcatcctcactcacatcctcaaagccaactctgaacttgggcccagagcatctgcgcttttactttattcctgagaacaagatcacccctgccccaaccccaaaacaccctcatgatatttctccatgcctgagccttttcttgctgatctgaatagaagccctggctctctaggacagagcctgccttgtcctgcaatgtcccctccccggacctgaaacccagccgaccccgagatacatggaggtggctgccagcagagtccacaatagtgctggtctccctgtctgcttaggcctcttaacacacaatcctgggctcactgttgccagggttggcccagctgatgggtgatagtccccattatttggtcttgctcctcacccccattctgcccagaatcccagtcatcttttgaagcatccctgctggatttttcatttctgctcaaaaagactccctgtacctgcatgggggctcaccacctgccccccacacctgccccattccatttgtcagaaccctcagggccatgggttgggctttgcctagctgtgttccaagacccaaaaccctccatagggcatgcagtggctgtcattgtgtttctgttacaataaaaattttaaagctattcttttttccccttgaattactgcagatgcaactataataaaggctaagtcccgaaaaccccctccctctggatctgaaatggtttcaggcaactatttattgctgggaccagcagggactggttcctttagtgttctaatatgcttaacacattaatccacatggcacattgtttcatcattgcactcaacgaaccttcattgagcattgaaacatacaatgcataatcctaagcagtgaggttataaggtagtaaaacagtcactgagcccgggcacagtggctcacacctgtaatcccagcactttgggaggccaaagcaggcagatcacttgagcccaggagtttaagaccagcctgagaaacattgcaaagctctgtctctacgaaaaatagaaaaattagccagctatagtggtgcacacgtgtagtcccagctactgagaaggctgaggcaggaggatcacctgagcctagggaagttgaggctgcagtgagccatgattgcaccactgcaccccagcctgggcaacagagtgagatcctgtgtggaaaaaaaaaaaaagttgctgacatactgaagcttactgtccagtggaagatgcagaatatgatatagataaccaaaaacatcatgtatagttttacccacttaccaaaagaataagaaagtcaagtgtgctatgggagagttgttcagaaataaaaggaatcagatcaccatggtctgatacagtcagagaagacatcctggaggaggtgaggcttgaatcaggcctttcgtggataaaaaccagagcaaagcagggtcaggggtgagttggggagggaaaaggagccacgcagattccaggcaaaggaaaactgtgagagcccaagtgaaaccaaacttggtatgttcaggagacaatgagtatatatctgggttttgtgagagtaaggacttgtttagagcactagggacagactaaggccaggaccagatctggaggaccttgatactattccaagggtgaaaatccattttgtaagcagtaaagagacttgcacaattaaaattagtagcagcacatgccacgggttaagagccagcatgagatgcccacctgtgcatagtggcatttgaaacgagctctgtctgcagagcaggcagcccagcaaaggagaaatttgcacagtgaggacaatactaccacagaaagtggctcagaatactttttgtacacgtggtatctccaggagggttggatatctgcaaaatcgttgaggcctggttttattgcctttaatttatgtataagacctcaggaagattagtaatttattcagtatcatacatgcagaaagaatctcccagtctccaaattcacatttcttctcagaagcatatttgcatagatcaagagcttgtggcaaccaaacttatgtaattagctcccatctatacatgtttactccacttagccacattcttagagccttcttcttctgaaattctaaaatgggaaacacctgcttccttctggcccaaaatgttactttggtttcagctttgaaataagacctggagccaagagacttcagcaaaaaattacattatatccacaagtaccctgacaaaataaaaggcagccactgccattctctgcaaaagtcctgcaggaagcagatgggtgttaaggactggcccagatttatacacgaacaatgaagcctgagagatctccttgtaagagccctgtggacaacatgctgtcctccaagagaaactgaatatacaaacaaatatgaccagaccacatataaaaatagaactctgactcacaacctgcagcacccagcccaggaaaccaacccttatctccagtaaccacctaggaagccagcctgatgtaagtcagacttgcaggagtcagactgctatctctagtaacaatccaggaagcaaacaatagcccctgtaataacccacccccaagggccaggacttgattaataactgacagctttcctaaatccaaatttccaacttaggaccagtcagagagagctaaatatgctcccctaacctatcacataggatgtcctgtttctacttaactgcccacagcttccccacgttaacagcctccaatcaaggcacacctgaagccttcccttttttccattatgaagcttcctcactctgcctgcctttgaatctctgccaaaatccaagctctgaatacatagcctttgcttgttctcatctggttggtctttgtttctacatcagtatgaaaagatggctctggtggctctgcaacagtacatgcaccttgagtcatttctccaggaggctgatgaatctgtgtgctgagcccttcatagccattggatgtcgaccatcacttatgtggggactcctggcctggtgccttaaagagtgggctctctagttgaactgtctggtctaaattctagagccactatcatgacgtctctgaaagagactcctctctgtcctgtgcacctccaggccagcagcagagacgtgtcagggagtttgggcagagtgagacagcttccttccatggagggcaattgccaccttggtgtcatggagaacttctgccagggcagtgcagaagggaaatgtgagtgggggagccctactggggcactgcctaatggagctgtgagaagacggccaccgtcctccagaccacagattggtagatccaccaacagcttgcattgtgtgcctgaaaaagtggcagacacttaacactagcctgtgaaagcagccaggagggaggatgcagagccacaggggcggagtggcccaagaccatgggaacccacctcttgcatcagtgtgacccggatgtgagacatggagtcaaaggagatcattttggagctttaagatttgactgacttgttggatttcggacttgaatagggactgtagcccctttgttttggccaatttcttccatttggaacagctgtatttacccaatgcctgtacctccattgtatctaggaagtaaataacttgcttttgattttacaggctcataagcagaaaagccttgtctcagacgagatgttggactgtggacttttgagttaatgctgaaatgagttaagaatttggggactgttgggaaagcatgattggtttttaaatgtgaggacatgagatttgggaggggtcggggtggaatgatatagtttggctgtgtccccacccaaatctcatcttgaattgtaactcccacaattccctcatgtcatgggaggaacccggtgggaggtgattgaattatgggagatgggtttttcctgcgctgttcttgtgatagtgaatgagcctcatgagatctgacggttttaaaaatgggagtttctctacacaagctctctctttgcctgctgccatccatgtaagacatgacgtgctcctttttgccttctgacatgattgtgaggcctccccagcaatgtagaactgagtctgtaagtccattaaacctcttttacttcccagtctcaggttgtctttaccagcactgtgaaaatggactaatacacttggcctcatcacaggtgctggggcaccaggctggggaaatttctcacttctctcatctctgagggactgtaagggcactgtaagcccaccaccattgctaaagacaccccccttcaggagaaaaccaagggggcactggatgtgagagatggggctagactggaagagagcacaagaggttgatgacccatacaaaacataatcatagaaaatatgtgctgggttgtttactgtgacacagttttagtgagtgctgacttctttaatctgtacaacaagcctataaagtcagtgctactgtattagtcagttctcacattgctaataaaggtatgcccaagactgggtaatttataaagaaaaagagatttaacagactcacagttccacatggctgaggaggcctcacaatcatggcagaagacaaaggaggagaaagccacgtcttacacagtggtgggcaagatagcttgtgctggggaactcccatttataaaaccatcagatctcacaagacttattcactaccacgagaacagtatgggggaaccaccccccatgatacaattatctacacctgtcacccttgacaggtggagattattataattcaaggtgagatttcggtggggacacagccaaaccatatcagctatcatcattcccatttttcagaaaagaaaactgagggacagaggaaggaaatcacctagccaaggtttaccagctcatgacagtgactctggaatttggatcaggcagttcaactccagagcccactctctaagccactggaccaggagcccccacataagtgatggtcaacattgaacagccgtgaagggctccccacacatcttctcactcggtcctcccaacaggctgcagaggctggaaaaatgagtggtggtctcatccctgcttcatgagaggcagtgaccaggaacacggaggtgaagggagatgttggttaatggcgaagcctggcctcaaacccagctcttctgatttctgagaccattgcttttgctattgttgtttgtttagcttttttccaagtgtcatattggtgtgtgtgaatttaaacacagaaaaaagactgcaactgagtggttgttatagactaaattatgtctcccaaatttcatttgtggaagtcctaacctctagtacctcagaatatgactgtatttagagacagggcctttaagatgaaatgaggctattagggtggccccgatccagtatgactggtgtccttgtgtccttacaagaagaacatgaggagattaggacagagaaatacaccaggaatgcatacactgagagagaacaccatgcagagagggagcaaggggacagccgtctgcaagccaagaaaaggagcctcagggaaaagcaaccctgccggagccttgatcttggacttctggcccttgaactgtgagaaaataaactggtgctgtttagcccatccaatctgttgtattttcttatggcagcctgagcacacgaatatagggaaaagcatctaccagttactatcgtattgccaggaggctgagaatggcttacccatgggtccagctagactcctctagaacctacatgtggaatttctaaaggaggaaagatctctggtctctgagagggaggaggcctttggggcaggggcggtgcttacggtcattcggccagtgtctgccactaaggtcagggccagaatctgactcaccgctgatgggaagaacacatcagctgagaaagaactgcagaaatgagttcaaatgctcagcagctgctggccgaaggccattccaaaatggctgttacaatctaccctaatgatcagacctcctcctcgcccacagtaaacatgctcccttctcttcaaactcgtctttttctctgatctaattgtagacttacttatttggtattttaaaaatcactgcagtccatgaggctttggatttctcctcctcaaagcaggcaggaaggaagggagggaaccagtgtttactgagcgccaggaactcaacatcaaggtcaagcatttactaaatattcactgtgatcgttaatcctctggagacacttcagaggtgtgacacggagaactgggtgaaatcacaaagcctatttaggtatatcctgtaacttctgaagatagagaatggcacttttttctaatgagtggtttcccaggcagttggcttttatagtcttaacctgcctcttttcatataaagcgaattctccagctttctttcccattttttttctgaccaaaattttggtctacaggcattctttaagtactcataagattcgttcatctagagactcactaccttgttttaatagaacatcgtccttttctaaaatatgtttaaaaacatattttcaaaaacaatatgcacatgcatctttactgaacactactcgtggacagggcagggtgaaacaaattcccaaaccttgaatataaataaatattcaagaggggagtattggaaagaagtagctgctaataatggcagaaaagctcttctcattttacaattttgataatgatgagtatgtgtgattctaacttattacagtaataataacacctatatgaacagaggatacaatttaatgacatattttactatcctttatatatacatatatgtgatcaagcatttactatatatatagtatatatatgctattatatataatatatatgctcaagcatttactatatatactctatatatagatatattctctatatatatacagactaaattgtctcccaaaaaatatagagagtatatatacatatatacatatatatatatatagagagagagagagagagagacagacagacataagagaaataaggcataggggtcattccaagatttcagaaaaagattgttcaatattaactataatggtgtcatatgtaacaaataacatatttcatgaattcgaatagaaatttaaataatgcacttataagaaatcataatatactggctaaaagtcaatcaattctacttggatggatggagttctctgcaggcacagaaataaccaaggaactaagcacagaactaaccagggaacaaaagtagcaagctcaacagatgaacatttattcaatcaagtggtgaattccaactacctatgtgtccccagcatggatttaagtgctggggttgaccaacacgcaccaagtctctgatgtcatggagtttatacaatccaaaacctgtgacagtttcctggcatacagtaaacatatggtcttcctccttttctccttgtctctccagatgtcaaaggtcaattgatgtcaataaactacaaagagcaaacagcaagccatatgtggctgagcatatgattcattgccaataatatttcccaacatctgaaaggcttttgtctttggtcaattgccttgtctctattgagttcatcttccaacatttacttctaaaatatgctgaagctattttaatgttgccttactgcaattattaagctagttacaagttaatttgcctatgtaggacctttagattattagagcttgtaacacaacacagagcagccaagatggtgagttttgtgttgtgctggtaggctatcctccatagtcaaatggctttccctcacagcgtagttgagatagcggcctcatcctaacgcagcaagacacaatctttctgtctcagcaggccacgcctctccttagccataaaccagatgctttatcggaacaatcttggcaaagttgaaatccacgaagagtcttggcagattccacaaagctctttcattttctctctctgacttagcattggagactagtgtgaactttcttccaggcttaattctatttccctaaatcaaagcacaatttacacatagctatttttactaaccttttacacatgctgtgatttgtttcactgatgaaaaagaaatccctcaatttcgaaatctgcttgtaatatgtattgcttggttagaaacttctatctttattagatgtctctgcataatgcatattgtgtttgttcacaccatgcagagttgcctgcccagatctgaaagctgtatgattttaaatatctgaaactgaaaatccatggaataacttaaccttttgcctgctctgagaacttttacttagcatataattgattattaacttgaacttttacttagcatataattgattattaacttgaacttttatttaattgctgtttaattgatttatctcacttattggaagctgatatatttataaagtttttttggcagagttataagccgacctatcacagcgaattctattactatttgaatggacttgcatttttccatagcaaagtccacgtaagtcaagttattaatgtttttggttactttcattagcatttatatttgccttttagaatcagcatacaaatttgaatcatacatagagagaaaatagctaactcagtacttatccttgtgatttttttaaatcatcattatatttctcttttactttaataaacttattttcaagtagaaattatattactgttattagggctatttttgaaaacattatttgtaactatattttgtatttttcaaaagaacttacattctaagtattagtgacaaagaaaattactaactttgaaaactccagctatattatcattaaaccacttttgaatgagcaaataacttataatcaattacaatttttcaatatatggccccatctcaatgtctccatttatacattcactcatgcatttatccattcctccactcaataaacatgtattttgcacctgccatgtgtcaggaactacactaagcactggacctgcagagatgaatgggataggacctctgtcctcaaaaaatttatttcattgatttggggatggatcaggagtgaacactggtatgggttatgagagaggtggcaaaaacatatcaatttcctatttttttgaattggaggaaatgtatgaaaactgcaaaccttggattagtgaaaagcaagttcctttttccttttaccaagaagatttggggaaagtagtcttccttctcttgcatgaaaagccagagcaggaatattgggatgaatcctagtcagtacagacacaggctagcaagaaaagcctcctggaaaaagcaagggcaccacaaggttaataaggctgttttgaggaagacagaagcaggtaaagaggctctccagaaacccagaactgtgcaaagaggctggcactgtggataggaaatgacaggaaatctgacaaaaggaaacttataaatgatgcctgcagaagggaatcagccaacaaagaacctaatttaaggaaacacaggtgtttgaagggcacagttaactaaatttagattctagccaactttgtggtttggctcagtgacttgtcatttggggttttaaagccatcaggatgcaggttaagaaggacccgatcacagcacgaataaccagtcattacagggattctcagtgaacaacacaactgaacagatctaagtgacaacatgggtataagatgcaccttccctgccctgggaaaggaggatggcctttagataagggaacaatgactgggatgcctaaagctcatcatgtgcactcaataaatccaagactgtgtcactctggtctagtgagagttgcttcagtactgttctatcaaagacttttccaatagaactatgaagatcctattttctttttcaccacttccttggccacttaagccatccacatccatgggctcaggcccacataaattaacagagaatattaaatcctcggctgtggcaaactctgccaaagaatcaggcccacatgaccattctctggttattgccaattttatgtaacttgagtatctagctttttttcagactttaggctgccctcatcttaaatctgtttgccacttggtctatgtcttgatctttggatcactggtcttaaaacaatgaatattacttctggatgatccaagcctgtgggtcacatgaagctatttgctctttcagtgtgttcagagtggtgccatgcaaatccccacctggaccccaaggaagtgtggtctggtcaggcaagcatacctgtcagagggagtgtggtctgtggacagaggaccacagacaatagaagagaggggccaaaactgagtagggaccagattgggggcttctgtttgtgtgaccaaagctgtaagaagccacataaccccagaggaatgtactgtttcaaggaggtcccactagaaataagatgtcctaccctaagacttgcagatggtttgctgatgagatgaagtcgcctctttatgcaacaacaggagacgaccaatttgatcccagaaacgtaattcgctaaaatcattcagcacattttgtgggttcaacaaatatagatggtattgtaataacagctgaaaatagaagggtggttcttcccttagaagccatgaaaatcagggagtaagaacttgctaatgcatcaccaacactgaagcaggacaggagctctggttaatgtaagatcctgatctactttaaagtattttcacatgctgagagatatttatgaggcttccacagtattattattttaacacctatatactatgtgccaggctctgtgcaaaatgccaaaatgcctataattaaatgaaaaaattgctgcagaatcccagcacttgtagacactcagaggagggcatctaacttccataaaaatggttagagatgacttcccagaggacactgacccttgaaaaataaggattcatccatccagctaggcagcctttgattcatttgttcattacatgtgcactgagtatctctgcctgttctagatgctgtggatacaatactgaatgagacagtcaaggtccttactcttgtgaaatttacattctggtggggtggagacataaccaggagaaacaaaatgcttccttaagaccatccaatatccatcttctggcctcatttccttccccacactgtgttttcctactgagaagagaaaaagagcatgactgctcaacctagagcatttccatccttccggtaagtatagctcgcatcatgacactaaaatgccagtttattgcttaccatcacaacataataaattccagaagggcataggtcaggtaaaatcaaatttctcaaagtgcagagctgagaatcagcttcaagcagaaatcaaagtgagaatgcagatgcctaccctgacatgagatatccttacctcactttaacagtggggatcttttctgccagtgaaacaagttttctttcccaggaaaaagtatgtggaagaagagcaggagtttctttgtgaatcctaggaagaacttccaacactcagcatctaataggaggaaacaagaggcatgctccacttcatcttttcccaggaccttgagccttcagatttgagggtcccttccgtggtgcctgctgccagtgtctcactgtgattcactgtgtagagagctgcaggaagtctgagaaagccggggaccactggggtgaccacttcctgaaaaaatgctcagcgtcttctgtccaagaggaagtggaggagcctgaggccagcgcctctacttctgcatacaggggtccttctgcaacgaggaacacactatcatgccccacaagggaaagtgtctctaagggaaaactgaaaaatcttccccacccaaatataagagaaaattgcaagccgctgaaactggtagttttaagccagactagccttcagagatctcagattaagtctgtagaaacgacggaattgcctaacaggggcaagagaaaggcagttggaagcttctgcaaggcaccgttggtaccattctgaaaattcatgtttcctgtttgccaacacgtctgctttaaatccctcaagctgttaattacttgctagtgttatataccagcttttcttcatatttatagctttcatttctctttgaagttattcaagtaatatatgcttgttgtcaaaaatgtaaaatacagataagcgtaaaaaagaaaataaaaattccccataatatcaccacttgaaaataactgtcgtgggcactttgctgtatatccttcctgtcttttttccatggtgaattggatattagggtgagcttctcagcgtccgttccacccccacagcactggggaacatttaggcagttttgctggtatttgctccatcctcagctccagcataggtccaggtttggctaaattaaactgcaagtatatcctactcttgacacggtgtttatttcaggaaccagcgcataagccagatctaagccaatcaacgtaggacagtccccagccccaggaaaggcacatgatcaacatggtccaatcagagggaatcctagaactctgcccagtggctggggaggagacgctcactcctcgggttggaagaggtgtttctggagactgttggtagccatgtttcgatcactggaggaacccagctttgggatgaagcagatatcccagaaaagatatatgaaaagaaattcagtccttaaagaaatttctgagctgccaaattaaactaacaccaaaacttgtcttaacttttgaagtttctggctatatgaaccaacacatttgcttgttgaagccaattaaattgagttttctattccctgtaactgaatgcatcctaagtgactcatgtagatatttttataaaaacacatggccccagccgggtgcagtggctcacacctacaattccagcagtttgggaggccgaggtgggcagatcacaaggtcaggagattgagaccatcctggctaacacggtgaaaccccgtctctactaaaaatacaaaaaaaattagctgggctttgtgacaggtgccagtagtcccagctacttgggaggctgaggcaggagaatggcctgaacctgggaggcggagcttgcagtgagccgagatagtgccactgcactccagcctgggcgacagagcgagactctgtctcaaaaaaataaaaataaataaaaataattttaaaaaaagaaaaaaaacatggtcccatcttacacacacacacacacacacacacacacagactagcataagagaagataaattatatattaaagtgttaacatcaattaattcagggattgggattgtaggagtgtggggaaaatttataaacttttctttttaacattggaacattgatttttttaacatttttaataacgtttttaaaaaaaaagattggagtagccccaattcaataactcacattaccccagatggctaaacaccatatttttaaaaatagccccttttacttaaatgtcatagccctagtcactataggtggaaggaaagtgtaactgagaaaagggtataaaaattacaagtggaatagtctccaattctaacaggactggctgaaattgggactagataattaacagcaaatatgtgttttattactgtggaccaatattcaatgggcatctataatagggttctctagagggacagaacaaataggatatatacatatatttatttatatatttatatataatgtatatgtttatatataatataaatttatatttattttatatttatatcatatatttattacattatataaatatatataaatcatatgttttattatatatagtatttatagttatatattataaatatttttatttatattatatatattttacatatatatataaaacccccatatataaaaaactctcctttatatgtatatatttatatatatgtttaaatatatataaagaggagtttattaagtattaccttaatcacaaggtcctacaataggctgtctgcatgctgaggaacaaggagagctagtccaagtcccaaaactgaagaacttggagtctgatgttcaaaggcaggaggcatccagcatgggagaaagatgtaggctgggaggctaggccagtctctccttttcacgcttttctgcctgctttatattcactggcagctgtttagattgtgcccaccagattaagggtggatctgctttccccagcccactgactcaaatgttaatctcttttggcaacaccctcacagacacacccaggatcaatacttagtatccttcaatccaatcaagttgacactcagtattaaccatcacaagtccaccctttgtcaacttgaacccatacgcaactcctgagatcaatgacaataataaggtcaggtcataattacatctaaaataatacaattatcctttgtacaaccagaaatgcaccaatccccaacccaaatactattacacaaagttaacaatacacaaatgctgataccaagtcaataaatcttttgtcacatggtaaaaaaaggaaataaaataaagatattttcttaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 656 - DNA, 60194 bp, Human
ggcgacagagcgagactctgtcttttaaaaaaaaagaaaaaaatttaattaccttaccaaagaagatacatgaatgaccaataagccattaaattaaaacttcagtgagtatacacatatgccctgaagtagctaaactttaaaacactgccctatgtgtgtgtactttttagctaaaaaagtgtttgaaaacagtattattttgaaactcaaaattccaaatcctctcttcaaattaggtagtagtgtcactggaagtaaaagagaagttactttaactgctaaagagtatccactaagaatctacaacaaacatcatgtttaatgctcaaactttagaagaatttataccaaaagtcaagaataagataggatatctatcttcattattaagcaacattatattagaggccctaatcaatgcaacaaggcaataaataaaagacaaaactgtcataatcagatactacaaacatctaagaaaattcagggggatttacagtcatatattaaacagtccagaaggagtcctatacatcatcaatgaatattgagaataaaaaatagtttttaaaacccctccaatttataagggcaacaaaatgtacaaggtactaaaataaatgtaatgtgtatttgggtataaatacagcaacataatgaaaaggtttattggggaaaaaattacagggagaagggtcaacaacgtgaagaggttcccctgccatctggacttctggaaaaagacctgctggtctaggcacagctggatgcaccatggaaagtggttccaataaacactggcactgtaacaattgtgtatgttgatacaaaaagagggagccaatgaatacttggtcgattatttaacaattgcttctctgctgaagaaatggccttgttggactagagcttaactgtggttcacatactaatgctgctataacagctagaagccttactaagaaatttactaaaccaccaaaaagaggaaatgaaccttctaggacatctggattgccttttcttaaaaatctagtcttggctgggtgctgtggttcacgcctgtaatcccagcatttggtgaggccgaagtgggcggatcacgaggtcaagagatcgagaccatcctggtcaacatggtgaaaccctgtctctactgaaaatacaaaaattagctgggcgaggtggcatgtgcctgtagtcccagctgctggggaggctgaggaaggagaatcacttgaacccgggaggcggggtttgcagtgagctgagatcacgccattgcactccagcctggcaacagagcaagactcagtctaaaaaaaaaaaaaaaaatctagtctgtatggcagcacaacatcaggtaaaagtacagactagccagatcactggttaaccttaacccctatgtgcttgagtttccttatctgtaatatggagatgatatagcaatagctgattttggactgttaaaggaattaagtggacacatgtaaagtgcttagaattgtgcctggcaagtagtaggctgcaatattgtgatataataaatatatatatttgatcttcatccagttcctggcacagatctccagaaacccttgtaatttcctgagtgacaggggtgatagaaacatcttttattagaatacttggtcttggttcctgacacaagagcttctaagacctttggaatctccaagtgataagagtgtatgacagtgagctaactggtggctgggatcctttagacaacttcaggatgggggctatcccctgaaagactaaggcatgattagaggtctgggatttgcagccccacgcctcgacctccagagagggtaaaagggctggcgattgattaaccaccagttgccagtgatttagccaatcatgcctaagtgatggcacctccattaaaaaataaaccacaggtttggagagctttcggtttggttaaccccaaccacataccaagaaggcgatgcacctcaaactgcatgaagacaaaaggtcctgtgctcacctgggacccttctggacgttgccctgtgtacctcttcgactgcctgttcatctgtatcctttataataaagcagtaaacataagtaaagtttctgagttctgtgagccattataagaaacgatcgaacctgggattttcctttcggaagccgctctctctcacaagggagagagctgttctcctttttcttttgcgtgttaaacctccgctcctaaacccactcttcgtgtgtatcgtgtccttaaccttgttggtgcgagacgacgaaccccgggtattgaccccagacaacaatgccacttcatattggggacttcgtctgggattccaaggtgcattcattgcaaaggtgagtaaaggggcggacctcaactctgtcctttgatttcgaggctcttggcctccattttagaatcaaaccaaaccaaatactgggcccccttctgcttctgtgaatgagaaaactctgccttcaccaattagccatttaaaaattatgagcgtggctgccagccttacaagttttgggggacaggcttgctggggagaacatggagaaccccccaatacccacgggctgctgggcatattggccatgtttgaaccagtttcctttcacggaggaccaagctgtcgtgtggggctggaagaggtcctggagcaactgaggatttctggctggggctacctcctggtgccatccgaaggcttctggactgaccccagcctccgaccaccctaaggggtgtcggcaacaggacctccaactttcctatcataattccctcatttcctatccacgaccaccatgtctcctaacctctctctgtatgcagtactgagggagttttacagttcagggaagtaatcttgttaggcaagaacaaagactgctgtagtaaccagggatatagcacaggggcatgctgttgtgattttctaggaacagagggtctcctctcccaccacagtgagcgtcactctctgcccttgctctggaaagcacatggcatgtcaaggtcactctgccctttgtcatagtaagattagggtggggcgcccaaccttccccgcgtgctatgtaaacgtcacacctgttcaaaccaacctgtgggctctgcgcaaatcagacgccgcctcctcaggcctacctataaaatctggtgcagtccaccgcaggccggattttcctttcggaagcccctcacaagggagagatctgttctcgtttttctttcttttgcctattaaacctctgctcctaaactcccccaacccccaagaaagaaattatcgaacctgagggggttgcagatacccatgatttgtagtgaactcagacagaagtgtgggtaccctgaggtcctaatagttgtggctggcatctgaagtagggggcagtcttgggggctgagcccctaacccgtggggtctgcactaactctggttaattagcatcagaattgagtaaaattgtaagacactcagctgctgtctgtggagaattggagaattggttggtggaaaacccatatatttgatgtcagaaatgtgagtagagaaatggtttttccttgataggctctatgtaaattttagttcatgtttttggtaataaatacacaatattactgattcttaaaagtataaacccaggaaaattaagaaaacaagaatgtcaagtccaacagagtttaaaggtaaaaaaaaataaaatagaacagaaatgggaccagtagcacatagaatattttaacacattcttggaaagtagaaactatatggactagtagtcaggaaggaagcagctcaaggaaaccgcttcctgaatatggagtctcctatgagagactatctgccctatggagaagcttggagtaactgcggacacaggatgccagataggaaggagggctggagtgacatgaagggctgaaaattgagggactaattggaagcccgtgcacgggacagtcagctctctctaccccatgatcagaatatttgacacacaagtgtttaccctggggcaaaaaattacaggagtcttccctgcttcccccaaaattgaacacattgctttctcttagctgacctagagaaccagtgtgggcactggcaccccaaaactaagaatccttttaagaaatggtgattttatgtccaaggaacgttccaagtaagttttcggctgctagctttgtctttacaagtaacgggccaggcccagtggctcatgactgtaatcccagcattttgggggactgaggtgggcaaatggcttgaggtcaagagttcaagaccagcttgggcaacatggcgaaaccctgtctctactagaaatacaaaaattagccaggtgtggtggtgcatgcctgtagtcccagctattgtggggctgagatgagaggatcacttgagcctgggaggtagaggctgcagtgaaccgagattgtgccactgcactccagtctgggtgacaaagtgagaccccatctccaaaaacaaaacaaaacaaaaaaaaccccaagtaacttgaaatcattttctgaaatctttctctgacattctgacattagggtaattcttgttctccatagagtgaaaggctcaggttcaagtcccactcctgtggctcctgattttttaatgattagtttgaccaatgtgtttttaaatgacttaatttttaaacatgagttgaaaacccaggatcactacacatttgaggaaagttgataatatgaaaagtaaacaccaaggtaagtggtaaaaacctttgaggaaacataattcaggaaacaggaacttaaacattagtatcgtacagcagattcaggaagatggcactggttaaaaaaattgacactatgaaaataaggcacagagaaaagaaagagctgtgggaaattataattgctgaaattttaaactagattggagagccggaatataaaggagaggacagctgggtgcggtggctcacacctgtcatcccagcattttgggaggctgaggccggcagatcacttgagcccgggagtttgagaccagcctgggcaacaaggtgagacccccatctctacacaaaataaaatataaaatcagctgtgcatggtagcacacgtctgtagtcccaaaacttgggaggctaggtgggaggatcacttgagtccaggaggtggtggctgcagtgagctgtgattgtgccattgcactccagcctggatgacagagcgagacccttagaaagtaggaaaagaatatatgaaaaaaaaataagtgatcaattaattactcacctgaatagtgggaataccaaaagagtaaaaagagagtaacagacagtaggaagttatcaaataaataatagaaggtaatttcccaggcttgatgggagacccaagagctcagattgaaaatgcccattgaatacccagcccaatgaatgtagagaggtctacacttaggagaaaagatcctaaaagctaccagaaagatagaaactgttactataacagaaataagacactagcaccttaactattaaccaatcttaacaaactagaataaaggccggatgtggtggttcatgcctataatcctagcactttgggaggtcgagatgggaggatcgcttcagcctggaagcttgaggctgcagtgagctaggatcgtgccactgtactccagcctgggcgacagagtgagacactgtctcaaaaacaacagaaacaaaaaaactagaataaaatacttctggtgtgagactctgtaggtttcattactccttttgggtcctgattaaatcctgttgactcaagaccttagagcatttactggtaaagtctctgactgcgcgatttttttttgcattttagttccttaaatattttctcactgcttcctactaaaggacggacagagcatttgttcttcagccacatactttccttccactggccagcattctcctctattagactagaactgtggataaacctcaggtaagtaaattactatccctggcaaaggtgcttttcttccacacctaaacctatggtcccttctttgtcttgctattgtttctctctttggaggcaggatggtatggaggaaagaggacagacactggagtcacacagacttgggtttaaatcctagctccatggcacagttgcctcaatggcactcttagcactgtagtcaaagaatattagacctggaaagggccttggaaattacttctcctcccccagaaacagcctctagactggcatgattgaccaccaaacttcgttgtgtcagacaggatcaatgtctgctggtctgctgcaactctgtactcatttatctctggggaggcctgaagccttggtgctgttccttggccaaacctaaatgaaatgtactagccagtgattaatagagtcctgtgctggggtgggagacagaccagggagcagcctgtttcttgcttctttctttctttttggagatgaaatctcattggctttgaacttctgggctcaagtgatcctcccacttcagcctcccaagtagctgggattacaggtgcatgccactgccccagcttgactataccagcttgtttctggttttgagccctggtatgcaagctagtgttggctacctgatcagaggagtataaaagagcctcagatgaggttacagttctcttgagaccaaggtgtcttgcatgtatcatctagctggttcattgcttaaagatgaagcacatcttccacatcctctgtggctgcaaaaggaccctaggaactgggtgtggtgtttcacttgccttttggtttgttgggttttttttttttttgtatctatcctttacctttattaaagccttatgtgaggatactatgcggagtcttctaagtcttttcaatgatccaaacctgtgtaattgatgaagagggtactgtgaataggatcattactttttttttgtttttgagacagggtctctctcactctgtcacccaagttgagtgcagtatcttgatcacagctcactatagcctcaacctcctgggctcaagagatcctcccacctcagcctcccgagtagctgggtctataggcgcacaccatcacggctgcctaacttttaaaaaaattattttgtagagctggagtcttaccatgttgcccaggctggtctcgaactcctgggctcaagtgatttgcctgccttggcctcccaaagtggtgggattacaggtgtgagcaactgcgcctggccccaggtttttttttttctttttttttttcgagacagggtctcacactgttgcccaggctgtagtgcagtggcactgaagcctgaaacctctgcctcctgggttcaaacagttcttgtgcctcagccacccgagtagctgggattacaggcatgcaccaccacgcccggctaatttgtttgtatttttagtagagatggggtttcgccatgttggccaggctggtcttgaactcctgaactcaagtgatccgcccgtcccagcctcccgaagttctgggattacaggtgtgagccactgcgcctggccccccagttttttactttataatttaaatgatagctaaggctttgtttgggagaaagatgaaaagtggggaaagatttagagccactggtgccaggctagttgctggggaatccctgtttgaatttgctgaagtgctacaactctcaatgggaagaaagggatgacaatggaacttgaaggtggttgatgcagagcaagaggaaatcgctaaatagatttaaaaagaaatccagacacagaggaagtcagccaagaatacagttccctggctggttaggctgctttggcaaaaatgaaagtaactaaaaaagagcctgtgttgccaagtccaccaatttccttctgtaaagggaaggaacatgatgccaaagaggagttgggcagatatttcttctgatgggaatgtgaccctcatcgggtagataatcaccaacgaaactacagtgggagggcatcaagagacaactgaaacagggaactacacaagagtgaagttgcctgtggactgacagagcttcctgcagaaccactgctgggttggatatacatgaatgacaaaggagctcttttccttgtattaggtactgtcaaatgtaccttcaaatgaaagggtgtgtttggtcttaattagctgaattcgttgaagatcttcaattagctgcagcttttgccggaatgtggttagctgggcaaattccaaatcggttgagctgcacaaaggtggcagtacataaaacatatcttgtaaaggggaactgcccaattccacccataattgttagaagaaatactccctagaggttactgaaatgttgagaatgcaaacaaacacatttggactggttctgtgatgaaactaaggtatcccttaattttatgtctttgacttaagtgatgattgttgctgtgataagagggcctctaccttcgtagactttttgtatgaccctactactgggggagcaggatgaagtgaaagcctgttgaagacttactagttcctttgctccaaattgtgctgaatgatgaacagattaatatcattcaaaagaaaggaggccgggtgtcctggcttacacctgtaatcccagcactttgagaggctgaggcaagaggattgcttaagcccaggaatctgaggctacagtgagctagaatcatgccactgcacttgtactacagccttggcaacagagtgagcccttgtctcctattaaaaaaaaaaaaaaaaaaaggaaagggctgggcatggtggctcacacctgtaatcctagcacattgggaggccgaggcgggtggatcacctgaggtcaggagttcgagaccagcctggccaacatggtgaaaccctgtctctactaaaaataaaaaaattagccgggcatggtggcacatgcctgtaatcccagctactcaggaggctgaggcaggagaattgcttgaacctgggaagcagaggttgcggtgagtcaaaattgtgccactgcactccagcctgggtgaacagagcaagactccatctcactttgttgcccaggctggtttcaaattcctgggctcaagcaatcctcccaccttagcctcccaaagtgctgggattacaggtgtgagccactgtgcccagtcaagatttctaatgtatcctagtcttgatgaattaaacaaataaacctttaggatgatgcaaaagcagaatctacagtcactttaaagcagtgtgatgtaaagaaaagggtggcagagtctcttggtgctatgggacccaaggacatttacattggtgtggataaaatgcccggagtggtgaaaaactttattgtcattgttggaccatggtgcataatgtattgttatacctgctaataaaaaattaaacggcaattaacttagtttagtatgacaatacaactgtaagtttaagagtgaaaaatgggccaggtgtggtggctcaggcctgtaatcccagcactttaggaggctgaggtgggaggatcacttgagcccaggggtttgagaccaacttggcaacatagtgagaccccccccaccaacacccccaacacgcttgtctctataaaaaatggtggtgtgctcctgtcgtacgagctgcttgggaagctgaggtgggaggatcgcttcagcccttgaggttgaggctgcaatggatggtgatcaagccactgcactccagcctaggtgacagagcaagaccctgtctcaagaaaaaaaaaaagtgaaaaatgtccatataaaaacttgcacactaatgtgcacagcggtattatttataatagccaaaaagcgtaaacaatccacacatccatcaactgggttgaggaataaaatatggtatatgtgataataaagtgtggtatatccacataatgaaatattatttgacaatgaaaaggaatatgaagtactaaaacaatacaacatggatgaatttcgcttcctttttttgttgttctttttattttattttttaagcacctctaccaacatgaacattttgcaaagtgaaagcaaccagacacaaaggaccacgtactgtatgattcaatttatatgaaatgtccccagtaggcaaatctatagagacagaaagtaacatagtagttgcctagggctaggagggtaatgggggacatggaaagcaactgctaatgggcacagcgtttctttctggggggatgaaaatgttctaaaattgattgtggtggtggttgtgcatgtttatgaatatgctgatatttattgaactgtacattttatttactttttttagagacagagcctcactctgttgtccaggctggagtacagtactgcaatcatagctccccgcagcttcatattcctgggctcaagagatccttccacctcagcctcccacgtagttaggactacaggcacatgccaccatgccctgctaagttttcgttttctttaaaaaaaagttttttagagacagggtctagctatgttgcccaggctgatctcaactcctggtctcaagcaatcctcccgccttggcctcaagagcattggggttataggtatgagtcaccgcaccctcagttgttcattttaaatgggtgaattttatgatgtgtgaattatatttctttctctttttttgagatggagtttcactcttgtcgcctaggctggagtgcagtggtgcgatctcggctcactgcaacctctgcctcgtgggttcaagcaattctcctgcctcagcctcccgagtagctgagattataggcatgcgccaccatgcccagctattttttttgtattattagtagagatggggtttcaccatgttggcaaggctagtcttgaactcctggcctcagccccccaaagtgctgggattataggtgtaagccaccacagccagccccaactagctgggactacaagcacgtgccaccacacctgactaatttctttttttttttttttttgtatttttagtagagatggggttttgccatgttggccaggctggtctcaaactcctgacctcaggtgatccacccacctcggcctcctaaagtgctgagattacaggcatgagccactgctcccgatggattatatttcaatataattcaattatgcaatataattgcataattgttatcatctctccctgatatattatcggaatggatgtgacatctgaatggggatgctgttgaggaaagagatttcatgaaatgtacagtgagtggcataattgtggctcactgtaaccttgaattcttgggctcaagtgatccttctgcctctgctccccgagtagctgggactacaggcatgtgccaacacatctggctaatttttaaaattttttgtagagacaaggatctcactaagttgcctaaactggcctcaaactcctagccacaaacaatcctcccaccttggcctcccaaaatgctgggattacaggtgtgagcctccacacttggccacttactttctttttgattcctatttcaggagaaaatcataatcaatttgcatttgtgtggaaaggccaccaatgcacatttaagctgctcccacaggacatttaaattatcttgcttattgctacaacctaatgaggaacaacttagatttgattgcactggaaaatactatatcttttttttgtttgtttgagatggagtctcactctgtcacccaggctggagtgcaatggcgagatcttggctcactgcaacctctgcctcccaggttcaactgattctcccgcctcagcctcctgagtagctgggattacaggcacccaccatcatgcccggctaattttttttatttttgtagagatggggtttcaccatgtgggccaggctggtcttgaactcctgacctcaggtgatctgcccgcctcagcctcccaaagtgctgggattacaggcatgagccactgcgcccagctaatactatgtcttattatattgatgataataatgttaatctctcaatccaaatatccagctaagactgaattggaagtgcttgttaatcatataaccaccagggagggatgattaactggctaaaatgcaaggcttagaataaatggtaaaattcttagaaattacttgggctaggctgggtgtggtggctcacgtctgtaatcccggtgtgggagctgagattgcgccactgcacttcagcctgggcgacaaggacaagagtgggaagccaaggcaggcggatcacttgaggtcaggagttggagaccaagctggccaacatggcaaaaccttgtgtctactaaaaatacagaaattagccgcaattggtggcacgtgcctgtaatcccagctactcaggaggctgaggcaggagaattgcttgaacccaggaggcggaggttgcagtgagccgaggccacgccactgcactccagcctgggtgacagagtgagactgtctaaaaaaaaaaaaaaaggaggaattacttgggctagagccactagaaacattcccaaacaaccaaaattaagttgctagctacaagacagaggaaaaaggcacgaaaattagttcaatttcttggttcctggagaaatcacataccatgtttgggaattttatcaacccttattctcgaagttaagagggaatggggagctaatttacatggggctttgaaaaatgaacaaatgggagactttttgggaacttcgaagagattactttggggccatagcacctcagtgttcaaatgatgttagcaatgtcagcaaccgactcacgctgatggagcttcttaccaaagcccgtgactgcccctcagggatggtcatggggatttgacactagaaagttacccgaggcttctggcaggtatatgtcctttgaaaaacagtcattggcctgttactgagcttctttttttttttttttttttaagacggagtcttgctctgtcacccaggctggagtaccgtggcgcgatctcggctcgctgcaagctccacctcctgggttcacgccattctcctgcctcagcctcccgagtagctgggactacaggcgcccgccaccacgcccggctaattttttttgtagttttagtagagatggggtttcaccttgttagccaggatgttctccatctcctgacctcgtgatccacctgcctcggcctcccaaagtgctgggattacaggcgtgagccaccgcgcccggccagagcaccgagacttaaaacatgaacacaaaataatgattttttaaaactgagtaattcgatcaaattgttgctgccaggctatacaattttgtctatgtttttctttaatataaatgttcagtatatgctcatgttaccacattgtgtccataactgatatctggaaagcttcatgaatggaggcagatgggtgtctgtcttgttggttgctagatccccaatgtctagcactgtacctgatatatagtaggtgcttagtaaatatttgttgattaagtagatgaatactgatgtttcataattttccaacaatttatcttttgtgttgaaattccaggcattcctttaattcctggtttcttcggaaacagtgggaaatgctcttctaagaaaaatcttactataagggatcaacctgctttattttccttttcagaaaatggccacccagcagaaagcctctgacgagaggatctcccagtttgatcacaatttgctgccagagctgtctgctcttctgggcctagatgcagttcagttggcaaaggaactagaagaagaggagcagaaggagcgagcaaaaatgcagaaaggctacaactctcaaatgcgcagtgaagcaaaaaggttaaagacttttgtgacttatgagccgtacagctcatggataccacaggagatggcggccgctgggttttacttcactggggtaaaatctgggattcagtgcttctgctgtagcctaatcctctttggtgccggcctcacgagactccccatagaagaccacaagaggtttcatccagattgtgggttccttttgaacaaggatgttggtaacattgccaagtacgacataagggtgaagaatctgaagagcaggctgagaggaggtaaaatgaggtaccaagaagaggaggctagacttgcatccttcaggaactggccattttatgtccaagggatatccccttgtgtgctctcagaggctggctttgtctttacaggtaccttgaaattattctctgaagtgtttctctggcgttttaagtttaggttttatttttcaattgcttttgcaatattttgctaaactttcttcactggttaaatgtgttatattaggtataaggtctagtttattaaaattcaacatcaatatttttatttttgcttcattttctatttagtacagcctgtgttaatttgtcaaatatatataaaataagaaagttacgtctccttaaacttggaccttagaaaatactggctgtattcttaaggtcctgaaaagattaaataactcatgcggtcatcctgatcccagtctcctcacccaccctccttctactgctcttacatgatctttctttgattcttctcattgctgcagtattggagggttttgtttgtttgtcctagccccgccataggggttatgatatataaatcagagttctaacaataacaacgatcatttactgagtactgtacctactttatgctaggcatagagtgagtactaattcttatccaatgaatttacccctttctctcccatttcacagctgagttcatggaggctcagagactttaagaaacatgcctatgtttctaccgaaatgtcatggcaaggctaaaacgtaggttttctaattgcacgttacttcagctggtcctggtgttagtcggcttccctatcactttgaccctgagagctcaaagagcaacataccagctctggggggcagctggggcaggatattgagttacacagcttagggttctgtacctagagcacggctgtggtggaggggcccattttgggtggtgggattgaggatggagactcaggccaatgagatcgggagtgcacagccacgctggagcttgtcttgctcctgaacaaaacaatcaactctgtgtacataccccctggtgccactgccaggcaatctaaatattttccttcatatataggtaaacaggacacggtacagtgtttttcctgtggtggatgtttaggaaattgggaagaaggagatgatccttggaaggaacatgccaaatggttccccaagtaagtagataatttttgcttaaatgtttctttcttttttttttgagacagtcttgctctgccacccaggctggagtatagtggcatgacttcagctcggtgcaaattctccctccctggttcaggtgattctcctgcctcagccttctgagtagctgggattataggtgtgcaccaccaagatgggctaatgtttgtatttttagcagagatggggttttgccatgttgcccaggctggtcttgagctcctgagctcaggcagtccacccacctaggcctcccgaagtgctaggattacaggcgtgagccactgtgcctggctaaatttttcagttctttaaaagacaaaatgaaagacaaaagagccacctttctggagtagcaccttcagttttgatctttccctattcaaaattggaccactccaggatttattcaagcaggaaaggcctaattacattgtgaaaagtttgaattatagaattttaaacagtttttaagtatttcattatcccaaattctaagataggttttgcccagtagaagtttcatgatctgccttaattaataaataaggctggaagtggtggcccacacctgtaaccccagcactttgggaggccaaggcaggaggattgcttgaaatcaggagtttgagaccagcctggcatgtagagaccctgtttctacaaaaataaaaaaaattggccaggcgcggtggctcacacctgtaatcccagcactttgggaggctgaggccggtggatccgaggtcaggaaatcaagaccatcctggctaacacggtgaaaccatgtctctactaaaaatacaaaaaattagccgggaacggtggcgggtgcctgtagtcccagctacttgggaggctgaggcagaagaatggtgtgaacccgggaggcagagcttgcagtgagccgagatagcgccactgcactccggcctgggcgacagagtgagactccgtctcaaaaaaaaaaagttagccaggcatggtggcgtgtacctgcagtcctagctacttgcgaggctgaggcaggaagattgctagagcccaggtagtcaaggctgcattgagccgtgatcaagccactgtgctccagcctgggtgacagagtgagaccctgtctctaaaactaattaaataagtaataataatttccataggggtggtgtaaaatggtgtatgctggaaggtaaaaaatatttaaacattattacaaatggtttcatgtactgctaaatatataccaaatgaaaacactgtatttttaaacctcagaaagagtttttattactgcagtggtctttagttcctggcttagaaaaggaagtacattttaattatttttaatgctatatttactagtattttctacatgactttctttgtttctaccaagtacagattcattcctttaacaagtttttaaactttcactgtgtaaaatttcatacaaagatagaatagtgtaataaatacttgtcaacacatagccaaatcatatttcatccatctcctacccaccttttttcctggaaataataacaataactatatttttattttattttatttgagacagagtctcgccctgttgcccagtggtacgatcttggctcactgcaacctccacctctcaggtacaagtgattcttgtgcctcagcctccgagtaactgagattacaggcatgcaccaccacacctggctaatttttgtaattttagtagagatgcggtttcatcatgttgcccaggctggtctgaaattcctggcctcaagtgatccacccaccttggattcccaaagtgctaggattacaagcatgagccacctgtgcctgaccaagatttgttgttttctttctttcttttcttttttttttttttttgagagtgagttttgctctgttgcccagactggagcccagactggagtttagtggtgcaatctcagctcactgcaacctccacctctcagactcaagcaatcctcccacctcagcgtcctgagtagctgggaccacaggtgcctaccaccatgcccagctaattttcatatcttttatagcgacaaggtttcactttgttgcccaggctggtctggaactcctggttctacaaactcctgggctcaagtgatcctcccacctcagcctcccaaagtgctgggattacaggcatgagccactgtgctcagccccttaagatttttaattcgtagatttcctctttatccatctcttttttcttgtcacttatttgttaaagaagccatgtaatctgtcctgtaaaattccctctactctagatttggcagaatgtgttcctctggcatagtctaacatgttcctctaccttctgcatttccaggaacctgacacttggatctagcagtttggtcaggctcagattctattttctttctttctttttttttttgtgacagtctcactctgttgcccaggcttgagtgcagcggtgcaatcttggctcactgcaacctctgcctcctgggttcaagcgattctcctgcctcaccccacccaggtctgggattataggtgcgcactgccacacctgactagtttttgtatttttagtagagacggggtttctccatatttgcgaggctggtctcgaactcctgacttcaggcagtccacctgcctcggcctcccaaagtgctgggattataggcatgagccaccgtgcccagcctcagattctattttctttaacaaatatttgtcacacacctactacatgcaaagttgttggttggatactaaattaactacaaaactggacacagttatttacatttataagtcatcttgcacatggacagccatgcccacaaaagtgaatggaggcccggcatggtggctcatgcctgtaatcccagcactttgggaggctaaggtaggcggatcatttgatgtcagtagttcaagaccagcctggctaacatggtaaaaccctgtctctattaaaaatacaaaaattggccaggcgtggtggcaggcgcctgtaatcccagctacttgggaggctgaggcaggagaattgcttgagcccgggaggcagaggttgcagtgagctgagatcgcaccactgcactccagcctggtcaacacagcgagactccatctcaaaaaaaaaaaaaaaaaaaaaggctgggcacagtggctcacacctgtgatcccagcactttgggaggccaaggcgggcaaatcacttgaggccaggagttcattcaagtgatgaactctcctctcccctcttccctctctcctctctcctctcctatctcccctcttccctggccaacatggtgaaaccccatctctactaaaaatacaaaaatgagccgagcgtggtggtgcgtgcctatggttccagctactcgggaggctgaggcaagaaattgcttgaacctgggaggcggaggttgcagtgagccaagatcactccactgcacagcagcctgggcaacagagtgagactccatctcaaaagaaaaaaaaagtgaatggatatctttggtatgttttgatacgttgtgtgggaaagcaatatgcacaataagtgcagtgtgagactttgaaaatgtttaaaaccactcaaactatatatggagttgcttgaaaatatatagaaaaccttatgaaaatatgtaaaccaaactgtagatacttctggatctggatttgtcagggggtgaagtagtgatggattttcacatttattttgttcattgctgtcttgtttaaatttttggaaacaagtatatattactttcatagttgaaaagaaagtgaggagattaggagggaggaagtaaacaagggaggagaggagaaaggcaggaagaggagagagagaaagttagacaagtagatgagatggttatagggacgaatgaagctagaattgtgaaatcatttgacagtcactctggctccctgacgaatcaaaacagccacccaggcagtccttgtccatgctgacagtgcaccatatatgcatatgtaacagggaacagcagccccggctggagcacaagccgctgctcgtgggcacctgtctcagctctagcctcagctcaggcttcacttagcctcagggtcactgtgtttagtgtcgctgggttatacactggacaagtaccagtggcaccactcacacatgatcacattatcatgtgactagcacctactagagccgcacatcctgtctgcaggggccttcatatgccttctctaacatagtcagagggtaaggtaataagcacagggaggggagacagcagtccagcaaccactcctagagaggaaggagttcaggccagcaaacaagggcagggggtagtgcagaggcttaggagatagagccaggcttgaatctgctgctacctgactaccagaccctaggcaggtgactgaccttgtctgaatctcatatgtaaaatgcagtgtcaacaacaacaaaaaaattagagacagatatccccaaatatgtcaaatttattcaggaataagaaaagagggttatgatttggaatgcactactgtaaaccacaggcacgtgcagtgagggaagagtaaagggaatttttcttggcaaaagggagaagttcacataagctgcttagaaacagagttcatagctgggcatggtagctcatacgtgtaatcacagctatgtgggaggctgaggcgggagggtctttggaggccaggagtttgagaccagcctgggcaatgtgatgaggctccagtttctttagagagagaggagagaggggagaggggagaggagagagaagacaggggacgggggagaggggagaggagagagggcagaagagaattccttggttctgaaggctcaaagccagagttcttgtgtgttcattggtggagatgctgttcctgggcaggtgttcttttgacagcatctcatctcatgttatcttatctgaattgctgcagtccaaaagaatgtgcagtgataaaccttgccatagaaatatgtgcgtacatgcaagcaatgcaaagcaggagatgcgtgacaggcgtgaagggatttcttatgggattcttagaaagtctttggaaccgttcctgtcttggacatgaaagcctgaaccccactccttcgtgccttcccagccctattttgtgtgggtctgataaaagtgatttcatcttggtatctgcgacttccacagcagataataatgtacagcttgtctggtggttgtaaggatgagaaacaaagtatatggatcaaatgctttgtaaaaattaccatgtataatgtgaggatgacagatgaccaactgttttgcctttcatttgtttgtcgtcataagcacatggtcagtcaataaaatctaagagctggaattagagcaagaatccccaagtttcttgttgggttactctgtctttagctttctggacttcaatttgttgcttctttttatcaactgtcaacaaaatgagtatacccttacactttttaaaatgtggcactccataaatgtaagatgattttatggtaactttttaaggtactgagttcctcctcaatccatataaatcatgaggacagggaaccaccccgtgcattgtgtgccatgtaggttatgtgcagacttacggcaatccttggaaacatttatacacctgaaaactggggaccctggctgcctatcacatagaatcatggccctggggaaatatgcagatcatctgatggcatccatgttctcctgtgattataagagaacatggcaaggttggtcacatccccactggtggaagagcgggtactaatgctccagcctttgggttcccagcccattctttgctacagcaccatagaaagaaaacttaaatttgaattggagggatttttatttttatttttattttttttgagacagagtctctctctgttgcccaggctggagtgtagtggtacaatcatgactcactgcaaactctgcttcccaggttcaagtgatcctcccgcctcagcctcccaagcagctgggattacaggcgcccgccaccatgcctggctaatttttgtattttcagtagagatggggtttcaccatgttgaccaggctggtctcaaactccaggcctcaagtgatccacccgcctcagcctccaaaagtgctgggattacaggcatgatcccccatgcccagctgaattggaggaaattttaaaagttaattttaaaactgcttctcttttatgggaaaggaatatgtttttaaatggtattcagtgtgctcttttttaaaaaaatcaaaaattatccattaacatccgttactttttttgtttttggttttttttgagattgagtcttgctctgttgcccaggctagagtgcagtggcatgatttcagctcactgcaacctccacctcccaggttcaagcgattctcctgcctcagcctcccaagtagctgggattacaggcgcccgccaccacacccagctaatttttgtacttttagtagagacagggtttcaccatcttggccaggctggtctcgaactcctgacctcgtgatccacctgtctcggcctcccaaagtgctgggattccaggcgtgagccatcacgcctggcctaatagccattactttttaatgcatggtaattttttgttcagtagataaatatattgttatcttaaaaagattttttgtatttacttttgagactgggtctcagtctgttgcccaggctggagtgtagcagcctgatcatggctcagtgcagcctctacctccccgggctcaggtgatcctcccccttcagcctcctgagtagctgggactacagaggtgtggcaccatgcccggctaatttttgtattttttgtggagatggggttttgccatgttgcccaggctagtcttgaactcctggatgtgagccactgcgtctggcctattattttaaatatagttctctttactgccagtagctttcatataaccctagcgactagatttagtcaccactgcttaattccaaaaaacaaaagctccatcctatatttactgtaaatcagtctctttgattgtattgcatgttttatttcaagaaaaaagttaacctgaagatttaattttaaataactacacatgttgtcactaatagaaataacaaataattatatgagaataatggtaattctcctaagttttgtggtaaattttttggcaattttattgaagtataataaaattcaacaattcaatacgtctttataaatgttcattgtgatataggacagctctatcacagtactggggtaaattttaattatatttattaattacagatgtgaatttcttcggagtaagaaatcctcagaggaaattacccagtatattcaaagctacaagggatttgttgacataacggtaatgtataacagcaatttttttctcaagtttttggattacctgtaagtgtctgactcagaagggcataggcattctttttatgtcatgggtttgatttctttcttcctttctcctttcattcccctggctcccatcttcaaagtgaaaaatatcacattcacttgctgacctagagcctttttctttttccagggctggcttctgacgggctctgcttgccttcctgatagtcttcccctttatgaatgaagccacttgccccagcttccctctgctgcccctatctgcaggcttgctaagatctcctgacctaggcgctgtcacccacagtgggctgcagagctggctcttcctagctggctaactatcctgaatcagtaaaaatttcctagtggagagtgatgggaaatcgaatccaaactggcttaaacaaaaatgagaatttattgattaacatgactcaggagaccagaactctatagagaacatggcctgacagtgggggaagagaggtgtttcctcaaaaagaaactgggtgcagctttcccagaagaatcagttgctcaatatataataccctgatgaatttagttaccattctatgtctcttacttcctcattcgtcaaagtacatctgtgatatttaaatgcaggtctgttttcaaggtcagtttccggaaacagtgaccctgagaaggcttcctcctgagtatgcataaacattcacagcttgcatgcgtgtgtgtgtgtgtgtgtgtgtgtgtgtgtgtgtgtgtgtatgtttgcttgcactgcataaaaacaattgcaacatcaacagaaataaaaattaaaggaataattctcctccgactctgccgttccatccagtgaaactcttcattctggggtaaagttccttcagttcttgttcatagataggtatatacttcataagtcaaacaatcaggctgggcgcagtagctcatgcctgtaatcccagccctttgggaggccgagctgggcagatcacttgagatcaggtgttcgagaccagcctcaagacctccaacatgggccgggtgcagtggctcacgtctgtaatcccagcactttgggaggccgagacggacggatgatgaggtcaggagatagagaccatcctggctaacatggtgaaaccccatctctactaaaaatacaaaaaaaaaaaaaattagcccggcatggtggcaggcgcctgtggtcccagctactcgggaggctgaggcaggagaatggcgtgaacctgggaggcggagcttgtagtgagccaaggtcgtgccactgtgctccagcctggacgacagagcgagactctgtctcaaaaaaaaaaaaaaaaaaaaaaaaaaagacctccaacatcgtgtctgtctctactaaaaatacaaaaaaaaaaaaaaaaattagccgggtgtggtggcacatgcctgtactactcgggaggctgaggcaggagaatcacttgaacccaggaggcggaggttgcagtgagacgagaacctgccactgcacttcagcctgggcaacagagtgagactctgcctcaaaaaaaaaaaaaaaaaaaaaaaagtcagataatcaacaacttgaattttaatttccctcagggagaacattttgtgaattcctgggtccagagagaattacctatggcatcaggtaaaaactcaaacattttccaaaggctttgcttgtttatttcttcttttgattttttgtccctatctctttttgtcgtcccccccgccccgccccgtttattttgaagcaaactctagacatcattccatctgtaactgtgaagggacaacttgaacgctgatacttgcaatatcaaagcctactggtctctttaatttgtgcagcagcaataaagatatagaaaaaaaaaagactaaagcctgctggtctcaccttgtgctttttattcaagcttattgcaatgacagcatctttgcttacgaagaactacggctggactcttttaaggactggccccgggaatcagctgtgggagttgcagcactggccaaagcaggtcttttctacacaggtgagtcagtaggttgtgcccacttgcttgcttgacctttaattcccacatagactttatgctcctgggcttacgtttagctacactcagcaatgtccactagcttcagcgtttctttttcttttctttttttttcccccttggagacagagttgcccaggctggaatgcagatcttggctcactgcaacctccacctcccgggttcaagagattctccttcctcagcctctggagtagctggaaccacaggcgcctgccaccacgcccagctacttttttgtatttttagtagagacagggtttcaccatgctagtcagaatgctcttgatctcctgatctcgtgatctgcccgccttggcctcccaaatgctgggattacaggtgtgagccatcgcgccaggcctctcttcagcatttcttatagattcgttttcttttctttctattttttttgagacatggtcatccaggctggagggcagtggcgagatcatggctcactgcagcctcaacctcctgggctcaagtaatcctcctgccttggcctcccaaaatgctgggattacaggtgtgagccactgcacctggcatacatctcttttctttcctgcatcataaatcctctcccagttttctattcctcccttaggtggtaaaccttcaaatttgaaaccttaaggtctggactaacaatgaatacaagtattctatttgtgataattatcatgtcttttctttctacacattactctcctcacctcttgtcccctgacaaagtgctcctagaaactgtcacaggacacttctgcttatatttctttaatcagaacttagttggatgggccgggcatggtggctcacgcctgtaatcccagcactttgggaggccgaggtgggtggatcacctgaggtcaggagtttgagaccagcctggccaatatggtgaaactctgtctctactaaaaatacaaagaattagccaggcatggtggcgggtgcctgtaatcccagctacttgggaggctgaggcaggagaatcgcttgaacctgggacgtggaggttgcggggagtcaagatcatgctattgcactccagcctgggcaacaagagtgaaactctgtctcaaaaataataataataataataattattattattattattattattattagtcagatgaccatacctagctgtaagaggagctgggaaacctaatctttttcctgggtgacaatgtgcccagctaaatattgggatttctattagtatggaaggatttgagataataggaacatggatagcaatctttgccacattctgcctgcaggagaaaatcaggaaattaattttcatgattcctaaacatgtagagccttccaccagattgtggcattttctctttagctgctggtcattaggaagcacctctgcaatctataaatgatgggctggttcctgtcagctaaatctctgcctgaaatacaagatgatcagggaaaggttcctaggtaccttgctggtcttgctcaaaccgaacacatgcataagttacagtggaggttaatgcagatctttaactgagagatcaagtagttgtcacaaataccatagagcaacacagagaagcagaatatagttgtcactctacctaacagacatgtgccattggaaaaaaaaaatctgactgcctcacaatcttaagcctttggaaagagtgtttgccatttctccctactctactgtgtcttcctcttgtcagccttccgcaagacccctctgaccagtgtgctccccctcttcctttccaatcctccaccactccacacaaatcctaatcatctctgactgttttcagatcttgcaagctctaggatctcatatttctgggaggctttcctctgccccagctttcccagagtggaaggaagatgagaaatgctctgtttctagtttgatccttttgcagagctaaataccaatttctttccaaagaaatataatttcacaaagagacttaatcctatttctggtgtaataaacatggcaataatgtggtaagaggcaattaattcttcatgcattcacttacataagggctgctagatttgctggtatttttttttccgtgagctctaaatatattctttctgattcattcattaaacgaatactaattgagtgccacatgagtgtcaagcacttttctaggttcatgtcattcattagtgagcaaaaacctctaccctcatagagcttatttttatttttattttttgagacagagtttcactcttgttgcccaggctggagtgcaatggcgttatcttggttcactgcaacctccgtctcctgggttcaagcgattcttgtgcctcagcctcctgagtagctggcattacaggcatgtgccaccatgcccagctaatttttgtatttttagtagagacagggtttcaccgtgttggccaggctggtctcagactcctgacctcaggagatccgctggccttggcctcccaaagtgctgggattacaggcatgagccactgcgcccagccccctcatggagcttcaattccagattctggttgccaatctgtttgttgatcaaaggagaatggggcagagggatggtgtgcatcaaagtgcatggtgtgtaggagcattcaatgactacttgccagttaccccattggtggacagagtcttatatagaaaattgcctcactggtaaccaacttctgactgtcacaaaacccaactggagactgaataggctttcactattacaggtctggtggttattatctgcatgttaatggacagatgcccatgccagtggcactgatcaagtttccttacttttaggtataaaggacatcgtccagtgcttttcctgtggagggtgtttagagaaatggcaggaaggtgatgacccattagacgatcacaccagatgttttcccaagtgagtggaatgaatgttaaccatctgcaactttggatgcacttcaacagtttttttctttttcctcatttcctgccttattttatctttagattgagtctttatccactcctcggattcaggctatgaaggatgagtcttcatgtctttcatccctttgctccatgacccccttcctgtactagccttcccctctttatagttatggcatagttttggctagattcatatattcacattacatgtttacattatcatgactatacaaatgctatgtggagctgaagcttgtggtaaatttttatttatttttcccttcctgtatatccttttatttttttaggaagtaataactgtcctgttggtatgttagcttatttttttttcctgaggtaaaattcaggtagtaaccattttatttatttatttattattttttgtgacaggttctctctcttgcccaggttggagtgcagtggtgcaatcatggctcactgcagccttgacctctctggctcaagcaatcttcctcgctcagcctcccaagtagctgggactacaggcacatgtcttcacacccagctaattttttttttttttttttaagagacagggtctctctatgttgcccaggctgctctcagacttctaggctcaagcagtcttcccatcctggcttcccaaagtgctgggattataggcgtgagccaccatgcacagcaattaaaccattttagagtacacaattctgtggcatttattatagtacattcacaatgttgtgcaaccaccccctctatctagttccaaaacactttcatcgcccccaaagaaaactctgtatccatcaagcaggcccccctcctctctccaccccactccatgcccagcccctgggatacaccaacctaattggtgtctatggatttatttgttctgactatttcctctaaatggaagcataccgtttgaccttttgcatttggattctttcacttggcatattgttttgaagtttatccatgttgtagcttgcataagtacttccttccttttgagaccaagtaatattccatatggatacactgcattttatttatccattcatctatttgtagatatttgggttgtttctaccttttggctaccatgagtaataccgataggaacatttgggtacaggtatctgatggagcatgtaactgtattcaagtctctggggcatatacctaacaacgatattgctagctgtatagtaattctatgtttttactttttttttttttttctcacacagagtctcactctgtcgctcaggctggagtgcagcggtgcgatctcagctcactgcaacctccgcctcccaggttcaagcaattttcctgcctcagtctcctgagtagctgggattacaggtgtctgccaccatgcccggctaattttttgtatttttagggtttcaccatgttggctaggctggtctcaaactcctgacctcaagtgatccacctggcttggcctcccaaagtgctggaattacaagcgtgagccacagcgcctggcctgttttaactttttgaggaaatgctaaactgttttttccacagtgcttgcaccattttaaattcccaccaacaacaatgttgtgcaaccaccccctctatctagttccaaaacactttcatcgcccccaaagaaaactctgtatccactaagcaggccctccttctctctccaccccactccatgcccagcccctgggatacaccaacctaattggtgtctatggatttatttgttctgactatttcctctaaatggaagcatacagtttgaccaacaatgtatgaggtttcccatttctcatcaacacttttctatttttaaaaaaattatagccatctgcttaatttttttttttttttttttttgagatggagtctcactttgtcgcccaggctggagtgtaatggcgtgatctcactcactgcaacctccgcctcctgggttcatgccattctcctgcctcagcctcccgagtagctgggactacaggcacctgccatcacgcccggctaatttattttttatttatttttttagtagagacggggtttcaccgtgttagccaggatggtctccatctcctgacctcgtgatccacccgcctcagcctcccaaagtgctctgattacaggcgtgagccaccgcgcccggccagccatctgcttaatttttatgtacattgcttatttttgtttcttgagataaaattcatgtattaataattttatttatttaaatgaaataaatgaagacgaacaccagctcatcttcaacttatcccaaatgtttaaatctcctcttaagtcattcagacctaccagatatctcatcattttcatttcttgaaagagtcatcattttttttttctttttcttttttttttgagacggagtctggctctgtcacccaggctggagtgcagtggcatgatctcggctcactgcagactctgcctcccaggttcaagcaattcttcctgcctcagcatcccaagtagctgggactacaggcatgcaccactatgcctggctaatttttgtatttttaatagagatggagttttgccacgttggccaggctagtttcaaactcctgacctcaagtgatccgcctgcctcagcctcccaaagtgctggtattacaggcgtgagccactgcggctggtccattttcatcttgaaatgagtttccctggaagtcttctggcctgctggattatgaacaacttgtcctataatcatcctgggatccagggatctttcttcacaggcatcctggagattatctcctctgttgtatctcctggatctaatgtcatcctcttcttggttcactcgctcattttgttggaacacttcatcggagttccctgggaaagactgcataagaaatacacacttttagttgcatataatgcatatacagacatatagatctatctagatatatgtttttcctgtattctcacacttatttgatagtttagctaggtgtagaattataggttggaagtcattttaattctaaattgtagaggcactgctacatttctactggttcctaatgtgctgtcgagaagttccatgcctttctgcttgtcaatccttttactgcaaacaaaatttttttttttcctgtgctggaagctttcagaaaaatatctgttctaaaattttatgaagaaatatttcttttctatgaatctttaaacttaatttttttttacccatcaaactctttagaaatgtttaattgcaagaagaaatttgtgttttcactatgtaattagtaagagttttttttttagaaatgaatatgaacacatacagattttaaaatgaatgcttcctgctcatttgtatagtggtaaaaacaaaaataaaacaaaatgaatacttctatctaattttattgccttgaaggtattttgatagcagtagttacctcatttttctttcttatttgggcttagtgtataataaattattgagaacaatggggacattctacttaattcttggaaggataagctaggatgcagtctagtcttatttagaacttactctggaatcgatcaactcccttttatactattattattattattagttttagtgttttgttgttgttgtttttgagatggagtctcactctgtcacccaggctggagtgcagtggcgtgatctcggctcactgcaacctccgcctcccgggttcaagcgattctcctgcctcagcctcccaagtagctgggattacaggtacctccccaccatgcctggctaattttttgtacttttagtagagacggggtttcaccatgttggccaggctggtcttgaactcctgacctcaagtgatcctcctgcctcagcctcccaaagtgctgggattacaggtgtgagccgccacacctggcctttagtgtttttttgttaagagactgggtctcggctctgtcacccaggctggagcaagtgcagtggtacaatcctagctgactgtagcctcaaattcctgggctcaagtgatcctcccacctcagcctcccaagtagctaggactacaagcatgtgtcaccatgcccgactaattttttaaagtttttttttgtagagatggggtcttgctttgttgcccaggctggtctcaaactcctggctccaaatgatccttctgcttcagcctcccaaagtacttggattacaggcatgagccactgctcccagccaactcctttttggatttttactcttcctttgcctcttaaaaaaactgcaaaccagtatgtctccaaatgattacctaaaatttttatgtatgctttaaagaatgaataaaaagcaacctatgaacctcctagtaaagtcaagaaattggacattatcaatgccttaaaagacccctgcggccgggtgcagtgactcacgcctgtaatctcagcactttgggaggccgatgtgggcagattgtctgagctcaagagttcgagaccagcctgggcaacatggtgaaaccccatctctgttaaaaaacagaaaaatttaaccgggcctggtgacacacgcctgtagtcccagctattagggaggctgaggcaggagaatggcttgaacctgggaggcggaagttgcagtgagccaagatggcgccattgcactcctgggcgacagagcgtgactctgtctcaaaaaaaaaaaatcaaaaaacaaaaaacaactctgcatgccaaccaccccctaattctgattatatccctgtccctccaatccagaggtaaatgtgatgctcagtttgggttaattattcccttgcttctctttgtggttttaccaactacatatacatccttaaacatatttagctttgtctattcttgaagttcaaataagaagcatactgcatgattcttcttgtaattggctggttttactccacgatgtttttgagattcatccatatttatatgtactacacagttgtagttcacttgttttcattggtaaatagtgtattattttatgaatatataataacttattttactgttgattaacctcgtgggtcgttttcagagtgttgcaaattcaaataatgccctatgaacattcttgtacatattttccagtgctcatgtgtgtttctctaggatacataacaaagtaaagaattgcagagtcatagaactttgcgggtgttcaactccactagataatgcaaagctttttcccaagtggttgcactgatttacattcccattggcctagatgcgtttctattgatttgcttcctcactaacttggtattgcccaaattttaatttttgtcagtgtaattactaataatgttaagcttattttcttcttctttttttctttctttttttttttttgagacggagtttcactcttgttgcccaggctggagtgcaatggcacgatctcggctcaccacaacctccgcctcccaggttcaagtgattctcctgcctcagcctcccgagtagctgggattacaggcatgtgccaccacgcccagctaattttgtatttttagtagagatggggtttctccatgttggtcaggctggtctcggactcccaacctcaggtgatccacccacctcagcctcccaaagtgctgggattacaggtgtgagccaccgcgcccggcagttgagcttattttcatattttcctgcagaatagtcttgttctttctcttcaagagtgtgtcttagctatttttttgccctttggtctttcatattccagagaatatattaaatatcccaagcaggcatggtggttcacacctataatcccagcactttgggaggctgaggtgggaggagtgcacaaggcgaggagtttgagactagcctttgcaacatagctagactccatttctacaaaaaatttttaaaacaaacagggtgtggtagcatgcatctgtagtcccagctacctgggaggcagaggcaggagaatcgcttgagctcaggagtataggttgcaatgagctatgattgtgccactgtactgtggcctgggtgacagagtaaaactttgtctctaaaaaacagaaatatccctctttatccttgatagtattttttaggcctttattagttttttcatgttacatcttttagattattttctttttaatctatctgtgactatatttaaagtcaattcttgttttttccttttcctttttgtgggtaacggggtctcactatgttgcccaggcagatctcaaactcctgggctcaagctgtcctcccacctctgccaccctaagtgttgagattacaggcatgagccactgcacccagccttaaagtgaattgttataggcaacaacacagtggggtcttttattttattttttatttgtttatgagacagactcgctctgttgcctacgctggagtgcagtggtgcagtcttgactcactgcagcctggacttcccaggctcaagcaatcctcccacctcagactcctgagtagctgggactacaggcacatgccaccaagcctggctaagtttgttagttttttatagagacaaggtctcactatgttgcccagtctgatctcgaacacctagccacaagcaattctcctgccttgtcttcccagagtgctgggattacaggtgtggaccactgaacccagcaggtcttgctttttttttgagatggaggtgtgagccaccacatccagccaggttttctctttttttttttttttgagacggagtcttgctctgtcgcccaggctggagtgcagtggcacgatcttggctcactgcaagctccgcctcctgggttcacaccattctcctgcctcagcctcgcgagtagctgggactacaggcaccccgccaccacacctggctaattttttgtatttttagtagagacggggtttcaccgtgttagccaggatggtctcgatctcctgacctcatgatccacctgccttggcctcccaaagtgctgggattacaggcgtaagccaccacgcctggccaggtcttgctttttaagagtctgacaataactgctttctaattggaatgtttagaacgtttaaatttaatgcaattatgaatatggttggatttaaacctattttaccatttgctttctatttatttcatcacttctttgtttctttttcttttcctgacttcctagggtttagggtttttttttttttcttttttctaccccctccttgagtatttttttttgtactccattttatttctgtcagcttattagctattaatccttattttacctttttactacttgctctagagtttaccatatgcctatttaacatatcatagtaatcttcaaaaatattataacagctgggtgcagtggctcatgcctgtaatcccggtaatttgggaggctgaggcaggcagatcacttgaggtcaagagttccagagcaacctgggcaacatggtgaaaccccgtctctactaaaaatacaaaaaaattagctgggtgtggtggcgcacacctgtaatcccagctgcttgggaggctgaggcacgagaattgcttgaacccaggaagcagacgctgcagaaagctgagatcgtgccactgcactccagcctgggtgacacagtgagactctgggtcaaaaaaatatataacacttgacataaaatgtatgaaccatacaatagtatatttccatttctcccctctcatcctttgtgctattgtcatacattttatttccatgtactttaataaatcttacaatataatgttatatctttgctttaaacaatttaagtacatttttacaacggcaaaagtctttcatatttgccctcttagttatcttatcattcctggtacttttcattcctttgagtagaaccaaatttccatctgctatcattttccttttaaatgatgtgcttcctttcactttttttttttttttttttttttgagatggagtcttgctctgtctcctaggctggagttcagcgccacgatctcggctgactgcaacctctgcctcccgggttcaagtgattctcctgcctcaacctcctgagtagctaggattacaggtgcccaccaccatgccaggctaatttttgtatttttagtagagatagagtttcaccatgttggccaggctggtcttgaactcctgacctcatgatctgcctgcctcagcctcccaaagtgctgggattacaggggtgaaccactgtgcctggtccctttcacattttttgtagtgcagttatgctggcaactgactttatttggcatttgtttgtatgaataagtttatattttaccttccttcatagttcttttccttgatgggcctattaaaatattttttttcttttgtaagccacttcaccccttccctatgggtttgtttttatttacctctacatggctgactttggacagaaacgttaaaagttctacttgttgttttcctgaagctatgcttctatttctggactcatcgccaagtcacctgaaggcaatacaaatgaagtatctgggccacatgcagtggctcacgcctgtaatcccagcactttgggaaactgaggtgggaggataccttgagcccagaaaaaaaaaaaattagcctggcatggtggcacgtgcctgtagtcccagttacttgggaggctgaggtgggaggatcacttgagcctgggagttggaggctacattgatccttggtcgtgtcactaccctcaagcctggacaaaagagtgagaccttgtctcaaaaaaaaaaaaaaaaaaaaaaagtgtccctttgctttactcctgctctccagtgattctacagcatggaataggccactgacttactcacatgtatagttctcatctgtccattttaataattgcaactagagctctttttgaactttctctcttgttcttcaagcatacatcaaacctgagtttagagggtatttgcgtcctagtttcacgagattggcaagtagtttttagagagtatgtttgtggccattcttttcttttgatactgacggagggtttcttttttaattttttgtttgtttaagacagggtcttactctgtcacccaggctggagtgcagtgatgcaatcacggctcactgtagccccaacctcctggcctcaagtgatcttcttgcctcagcacccccaagtagctgggactatacatgcatgccaccctgctagctaatttttagaggaggtctctctatgttgcacaggttggtctggtcttgaacttctgacctcaagtgaaactcctactttggcttcccaaagtgctgggattacaggcatgagccattgcacctggcaatggagtggtttgtggttggttagttttttgtttgtttgtttgtttgtttttgagacagagtttcactcctgttgcccaggctagagtgcaatggtgcgatctcggcttacttcaacttctgcctcttgggttcaagcaattctcctgcctcagcctcccaagtcgctgggattacaggcgtccgccacaacgcccggctaatttttgtatttttagtagaggtgaggtttcaccatgttggtcaggttggtctcaaactcctgacctcaagtgatccacccgcctcagcctcccgaactgctgggattacaggcgtgagccaccatgcctggccttgtttgttttttgttttgttttgagacagagtctcactccattgcccagactagagtgcagtggcacaatctcagctcactgcaacctccgcctcccaggttcaagcgattcttgtgccccagcctcctaagtagctaggactacaggtgtgcgccaccactgcctggttaattttggaattttctttttaatagagacagggttttgccatgttggccaggctggtctcaaacttctggcctcaagtgatctgcccgcctcggcctcccaaagtgctgggattttgggtgtgaaccaccgcactcacagagtttttttctttttttaataaatttttatttgaaattatttagatttgcagaaagtgcaaagtaatacaaagagttcctatatattgccatacccaatttaccctaatgctaacatcttacactagcatatttgtcaaaatcatcagtgtaccaattcatatactgtacattactatttactaaaatccagagtttatttggatttcaccagtttttccactatgttgttttttgttccagaattcataaatagagggttttttttttcctatttttgattctttaagttcatttttgttggttgcatggaggagtgtcatatacgcactcattccaccaaattcccttgatatcctttaccattactttataaaccatttacatttctcttgcagagagccacaacctaagtgccttacctgatgacactgacagagagaatcactggaaatgatagttttatacttaattcttgtcactaaaactctaatagtgtttttaaaaacctaatacaaggccaggcctggcggctcacacctatcatcccagcactttgggatgcctagggaggagaattgctcaaggccagaagtttgaaaccagaacagcctgggcaacatagtgagaccctgtctctgaaaaaacaaaacaaacaacaacagcaacaacaacaacaaaaatacctaacacaaatacttaaatgcatacaactatttttataacttttaacttttacacttagttgtccatttctccaaaatatgaagtcctctgcggaagtgactccagaccttcagagccgtggtgaactttgtgaattactggtaatgaacaccgtcatcttgtctgttttaccagcacatgatcatataattgaaaactgttttgaacaggaatgtctcatcataaataagttaataaattctacaaacatctactaaacatctgttatgttctaggtacagattggggaaatcacaataaaccagtcgggcacaatacctagcttcatgaaatgtatagtcaatctcttctacttcaaggcccagactctcttagactttgttgattagcatccaggctaaatggatcctctctggatcttcatgtggagggcaataaggctggatttgctacttggcctttttaggggttgagaagatgttactttaacaaaagcaagtgcccaacaaaatcataaacccaggtaataggctgaccactttaagctgagaaatcctacctagttctctgggatataagccactactaatttaatgcacacatataccaccttattttgaggctgtgtgttaggtatgttatgtttgtcatccccccacccccaacacacacaaaaaccaacttgctattcacgtgattcattttctatatgaattgaaaaatggcactaaagaaaaaagtttggggatatagaaatagcttattttttaaggaagaaacataacctttctaagtactggatgtgtaatattaaaaatgtagttaaccaaggacagaggctgcacctaatgacttttggaggaaccttcttgctcaagacactatgattctcgttacctggatagtatcacccatggattgtatcatatatgaaccactgaggaacacacattcctgcagatgtttgcagattattaattgctttatatttggagcacccctcccttcaatcagcataaatatttgagggtgggctgtgtttagaagatgtttagtctccaatgattacaacatgatgcaccactctcctatacaaattttgatttaagaaaagattttatttttcaaaggaaaccacaagtgaaagcaatcttgaagattcaatagcagttggtcctatagtgccaggtaagaactttgaagtagcacgtgggattatatgtatttgtaaatatatttgtatacagggcagttgcaaaaaaaagagtatttataattgtccaaagagcttccaaagaggagcagcattgcaacagtgtcgtgtatgagcaaaagtcaagattcttgtggcttctccagagtgcaggcaggaccaaactgatagtaggcaacgtgtctcaggtacaagcaaaccagtccttagaagcaccaatcagtaaacttctttcctgagatttttatttttattcattttattttattttattttatttgagacagggtcttactttgtcacccaggctggaatgcaatggcaagatcatggctcactgcagcgtcgacctcccaggctcaagtgatcctcccatctcagcctccccagtagctgggaccacaagcatgtgccaccacacctggctaatttttgtattttttgtagagacagggttttgccatgttggccaggctggtcttgaactcctaggctcaagcaattcgcctgcctcggtctcccacagtgctgggattacaggcatgagtcactttgcctggcctctttcctgagatgcatggtgcttatgataagcacacattatgtctaggtccctgcttcaagtgtggcactttggacacatgcttcccacattccgattttgtgccaaaacctatgagatgatcgcaatgtgggaatcatggatggctgtggaaaatcctaacacattcgtagtagacaggcagaatcatggaatgaaaaggcatggcgttcagactgagggagatgtgactatgaatccctgttgtgcccccctttctttctctccacagaaatggcacagggtgaagcccagtggtttcaagaggcaaagaatctgaatgagcagctgagagcagcttataccagcgccagtttccgccacatgtctttgcttgatatctcttccgatctggccacggaccacttgctgggctgtgatctgtctattgcttcaaaacacatcagcaaacctgtgcaagaacctctggtgctgcctgaggtctttggcaacttgaactctgtcatgtgtgtggagggtgaagctggaagtggaaagacggtcctcctgaagaaaatagcttttctgtgggcatctggatgctgtcccctgttaaacaggttccagctggttttctacctctcccttagttccaccagaccagacgaggggctggccagtatcatctgtgaccagctcctagagaaagaaggatctgttactgaaatgtgcatgaggaacattatccagcagttaaagaatcaggtcttattccttttagatgactacaaagaaatatgttcaatccctcaagtcataggaaaactgattcaaaaaaaccacttatcccggacctgcctattgattgctgtccgtacaaacagggccagggacatccgccgatacctagagaccattctagagatcaaagcatttcccttttataatactgtctgtatattacggaagctcttttcacataatatgactcgtctgcgaaagtttatggtttactttggaaagaaccaaagtttgcagaagatacagaaaactcctctctttgtggcggcgatctgtgctcattggtttcagtatccttttgacccatcctttgatgatgtggctgttttcaagtcctatatggaacgcctttccttaaggaacaaagcgacagctgaaattctcaaagcaactgtgtcctcctgtggtgagctggccttgaaagggtttttttcatgttgctttgagtttaatgatgatgatctcgcagaagcaggggttgatgaagatgaagatctaaccatgtgcttgatgagcaaatttacagcccagagactaagaccattctaccggtttttaagtcctgccttccaagaatttcttgcggggatgaggctgattgaactcctggattcagataggcaggaacatcaagatttgggactgtatcatttgaaacaaatcaactcacccatgatgactgtaagcgcctacaacaattttttgaactatgtctccagcctcccttcaacaaaagcagggcccaaaattgtgtctcatttgctccatttagtggataacaaagagtcattggagaatatatctgaaaatgatgactacttaaagcaccagccagaaatttcactgcagatgcagttacttaggggattgtggcaaatttgtccacaagcttacttttcaatggtttcagaacatttactggttcttgccctgaaaactgcttatcaaagcaacactgttgctgcgtgttctccatttgttttgcaattccttcaagggagaacactgactttgggtgcgcttaacttacagtactttttcgaccacccagaaagcttgtcattgttgaggagcatccacttcccaatacgaggaaataagacatcacccagagcacatttttcagttctggaaacatgttttgacaaatcacaggtgccaactatagatcaggactatgcttctgcctttgaacctatgaatgaatgggagcgaaatttagctgaaaaagaggataatgtaaagagctatatggatatgcagcgcagggcatcaccagaccttagtactggctattggaaactttctccaaagcagtacaagattccctgtctagaagtcgatgtgaatgatattgatgttgtaggccaggatatgcttgagattctaatgacagttttctcagcttcacagcgcatcgaactccatttaaaccacagcagaggctttatagaaagcatccgcccagctcttgagctgtctaaggcctctgtcaccaagtgctccataagcaagttggaactcagcgcagccgaacaggaactgcttctcaccctgccttccctggaatctcttgaagtctcagggacaatccagtcacaaggtatacctgtatatattttggatgactattctgatgtataatttctttttcttactttaagtggttgaaaacttctgaggccatgaaagcatgcatgctcattgatagaacagatataaaataaaccttcactaattttttttgacagtagcatgaattagtgaaaagtccttgaataatagaatggttttcaaataactcagacaaaatgaataaaatatttatattaaattattgaaggttcttaataaagacatgaattatctgttattagtaaaagaattagctatatgtaagatgatgcttagaaattaccttcaccctagctgcctaaaggaagaaaggcctgtagtccctgggaaataaataaattaatgggaaataatatcttcatctatttgtgtcttaactcctctaagcactatttgatagttttcagtgtagacttaacccatctttcattaaatttattcctagatactcatatcttttgaaagtattgtaaatgtcattaaaaatattttttcattttctaattgttgctagtattgctttggtcttaagcagtttgactgttatatgcctaggtgtgctttgctttgtatgtatcttgcttgaggtgcactgaacttttttggaatgtgtgggttgacatttaccaaatttagaaaatttttcatcttttttcaagtactgttttattatggtaaaatacatgtaacaaagcttacattttaatcattttaagtgtacaactcagtggcattaagcattcactatgttgtacaaccatcaccactatccatctccagaaccttttcatcatcccaattaaacaataaattgggccgggcgcgggggctcacgcctgtaatcccagcactttgggaggccgaagagggtggatcgccagagctcaggagtttgagaccaccctgggcaacatggtgaaaccacgtctctactaaaatacaaaaaattagctgggcgtggtggcatgcgcctgtagtcccagctattcgggaggctgaggcatgagaatcacttaagcctgggaggcagaggttgcagtgagcccagatcatgccactgcactccagcttgggctaccgagtgagactccgtctcaaaaaaaaaaaaaaaaaaaaaaaaatcttccctcccaccagcccctgataacttctcttctattttctgtctctatgaatttgcctcttctagatattgtttataagcattatcacttgtctggcttatttcactttgcatactgttcaaggtacatcatgttgtagcctatattggaatttcattccttcacatgtactccataaatatgtacaattattatgtatcaactttgaaaaggaacttcatcctttttatagctaatattccatggtatgtatatagtacattttgtttatccattctgctgctgagagacacttgggttgtttctaccttctggctatcataaataatgctgcaatgaacactggcattataagtatcggtttaagttcttgcttttaatcattttgggtatatacctagaagcagaattgctgattcatatggtagttctatgtttaactttttgaggaacttgcacagtagctgcaccatcttacattcccactatccatgtacaaaggttccaattactccacatcctcttcagcacttgttaatttttgtttttgtggagacagagtctaattctgtcacccaggctggagtgcagtggcgagatcttggctcactgcaacctccacctctcgggttcaagcaattctcctgtctcagcctcctgagtagctgggactacaggtgtgcaccaccatacctggctaacttttgtatttttagtagagatggggtttcgccatgttgcccaagccggtctcgaactcctgagctcaggcagtccagccaccttggcctcccgaagtgctaggattacaggcatgagccacagtgcccgacctgtttttgttttcattgttgtttttcagacagtgtcttgctctattgcccaagctggagtgctgtggtgcaatcatggctcactgcagcctcaacctcttgagctcaggtgatcctcctgcctcagcctcctgagtagctgagactaccagcatgcaccaccgtgcctggataattttttattttttgtagagacagattcttgctatgttgcctagtctggtcttttttctttttctttcttttttttttttgagatggagcctcgctctgtcccccaggctggagtgcagtggcgcaatctcggctcactgcaagctctgcctcctgggttcacgccattctcttgcctcagcctcccaagtagctgggattacaagctcccgccaccacacccagctaatttttgtatttttagtagagatggggtttcaccatgttggccaggctggtcttgaactcctgacctcaggtgatccacccacctcggcctcccaaagtgctgggattacaggcatgagccaccgtgcctggcccctagtctggtcttgaactcctgggctcaaatgatccacccaccttggccttccaaagtgctgggattacaggtatgagccacctcacccagcccattttgttttgtgattatcataaagccgttctagtagttgtgaagtggtatctcattgtggttttgatttgcatttctctaatgcaaatcatgaaaatgatgttaagtatcttttcactttttgaaaaaatatctgtttgctcatttaaaaattgttgttgtttttgttgcattgtaagagttatttgtatattctggatttcaacctgttatcagatacacagtttgaaaatatttttcccattccataggttgtcattttactttatttataatgtcctttgtgcacgaaagttttaaattttgacgaagtccaatttatctgtttttttcttttattgctggtccttttggtgtcctatctaagaatccattgccaaatccaaggtcatgaagattaactcctatgttttttctaagagttgtgtgatttcagcttttatatttaggtcgttgatccattttgagttgattttttttacatggtgagggataggaatccaacttcattctttcgcatgtgcaaatccagttgtccccaaccgtttgttgaagagatgctatatttcttttctcttcttttttttttttttttttttttttgagacggagtctcacactgtagcctgggctggagtgcaatggcgcgatcttggctcactgcaacctccgtctcccaggtttatgtgattctcctgcctcagcctcctgagtagctgggattacagatgcacaccaccatacccagctaattttttttttgtatttttagtagagacggggtttcactatgttggccagactggtctcaaactcctgacctcgtgatccgcccgcctcagcctcccaaagtgctgggattacaggcatgagccactgcgcctagccgagatgctgtatttctttttgtgagtctgaagagtagcacagggcttcccatacagtgcataagctgcaaaaagcaatatcttcatatatgtattctttaaaaaaaaaaaagaatgttttatggtatgtggaaggtttgcatgtgaaaatagctggatgaatcaaaatgacagttttaaaatgtccattcagaactctttagattaataatgggaaactgtgctgctttccagaccaaatctttcctaatctggataagttcctgtgcctgaaagaactgtctgtggatctggagggcaatataaatgttttttcagtcattcctgaagaatttccaaacttccaccatatggagaaattattgatccaaatttcagctgagtatgatccttccaaactaggtaaggatggcactttaatatacttgtttttacgtaagttggaaaagctacttggccaataatttatttaagagttaaagtgcctgtggttctaagggtgtagcctgtatccatggtaaattgtgaggaatagcactctttctcattaagaaagcagagtgctgtttgtaattattgagcctttactacacactaggaagtatcctaagcacttcacaaatatgaactcagtcttcatacccactctatgaagtaaagtactattattattattattattattattttttttttttttttgagacagtctcgcgctgtcgcccaggctggagtgcagtggcacgatctcggctcactgcaagctcctcctctcaggttcaccattctcctgcctcagcctcccaagtagctgggactacaggtgcctgccaccacgcccagctaattttttgtatttttagtagagacggcgtttcaccgtgttagccaggatggtctcgatctcctgacctcatgatcttcccgcctcggcctcccaaagtgctgggattacaggcatgagccaccgtgcctggccaaagtaaagtactattattaatgctattttgtagctgggaaaactgagacataaagagataaagtaattcgtaatatccagctaaggaaatgtatatctgtgactcaaatacaggaattttgactccaaaatctgagttcttaatccctaatataggccgggcctggtgactcacacctgtaatcccagcactttgggaggccgagaagggcagatcacctgaggtcaggagttcgagaccagcctgaccaacatggtgaaaccctgcctctactaaaaatgcaaaaatttgctggcatggtggcatatgcctgtaatcccagctacttgagaggctgaagcaggagaattacctgaacctgggaggcagagattgcaatgtgagccgagatcgcgccattgtactccagcctggggaacaagagtaaaactccatggggaacaagagcaaaactccatggggaacaagagcaaaactccatctcagaaaaaaaaaaaaaaaaagaaagaaatccctaatataatgttgccactccaaaataatttgtagggttattttattttgtttttggttaggctggtcttacattgcaacttacagatctggcagctcagcaggaaggaaatctgctaatccgtagtcattggaagtatttccctgtttctcaccagcctatcctaatagttcatggaaaatggtgcagccatctttcttaaatacatcatttagctaaatgacttaggcaccatcattccttaacttagtaaacactgaacactaaagattgaagaaatatacaactctatggaattgacataaagacttgcatgcaaaagcttcattgttggccaggcacagtgactcacacctgtaatcttagcactttgggtggccgaggcgggaggatcgcctgagagcaggagttcagcaccaggctgggcaatatagcaagacatcgtctctactaaaaaaataaaaaattagccaagtatgatggtgtgcacctatagtccccagctactcaggaggctggtaggatcacttgagtccagaagttcaagcttgcaataagctatgatcatgccactgcactccagcctaggtgatagagcaagaccctgtctcaaaaaaaaaaaaaaaaatatatatatatatatatgtgtgtgtgtgtgtgtgtgcatacatatatacaccgaagctggaggtggtagttatatttgtcagcaaattttgcaacaaatttaggttttgcttcagagttgtcattccttttatgtttcttttttttttttgagacagagtctcaatctgtcacccaggctggagtgcagtggcaccgttgtcagctcactgcaacctccgtctcctgggttcaagcaattctcctgcctcagcctcccaagtagctgggattacaggcgcccatcaccatgcccggctaattttttaatatttttagtagagacggggtttcaccatgttggccaggccagtctcaaactcctgacctcaggtgatccgcccacctcagcctcccaaagtactaggattacaggcgtgagccactatgcccagctgtttctttgtatagtattctttttttttttttttttttttttttggagatgcagtcttgctctgttgcccaggctggagtttggtggcgcaatatccactcactgcaacctctgcctcctgggttcaagcgattctcctgcctcggcctcccgagtagctgggattacagctgcctgccacccacgcctggcaaatgtttgtatttttagtagagacagggtttcaccatgttggccaggctggtctcgagctcctgagctcagatgatccacctgcctcggcctcccaaagtgctgggattacaggcatgagccacagcacctggcctctttgtattcttattgtgtaaatgtcatgtacaaacttagagttattaggtgttaaagctgaaggtgatgctactgagtcaatgcttgtattttatagaagagaaaactgttacccagagagggtcaataatgtgtcaaaattcacattacttgctagttgcagaacctgaacccaagcccagtgacctgattcttagatcatgagatcgtggtacctggttttaattaagtattattgaaacaaaataataaactacttggctaattttgatagaaatttgcagtattttctaatttctgaaaatccttgatcttttacagtaaaattaattcaaaattctccaaaccttcatgttttccatctgaagtgtaacttcttttcggattttgggtctctcatgactatgcttgtttcctgtaagaaactcacagaaattaagttttcggattcattttttcaagccgtcccatttggtaagagttataatattacaatggtggtttaaaatgtttctatggacacagagtcatattaagcactctttaaaaagggccatattttgaggctgggtgtggtggctcatgcctgtaatcccagcactttgggaagctgaggcaggaggcttgcttgaggtcaggggtttgagaccagtctgggcaacataacaagccctccacctctaaaaagctttaaaaaaatcagtcgggcacagtggtacctatagtcccagctactagggaagctaaggcaggaagattacttgagcccagaaggttgaagctgcagcgagctgtgatggtatcactgcactccagcctgggtgacacagaccttgtctctttaaaaaaagaaagaaagaaaagaaaaattgtttctcaaataataaagtataggtgtttccagaattttcttttttacctttacgctcagttggatttgaaatttctagaattttaacaacatttctagttatcagaattattttctgagcaaaaatttgttttatctacttagtcatatgaattcaatctgaattattacattaatttctaatttcttcattttaaagatgttacactttgctgtgagagatgtagctgacataactaaatttttattttccctttcatagttgccagtttgccaaattttatttctctgaagatattaaatcttgaaggccagcaatttcctgatgaggaaacatcagaaaaatttggtatgtttacaaaatagtgctttttacgtattcttattctctttctgcccagaatcctttttctcctattctgaattagccacaaggaagcaagatatgcattagctacccttgcttaccagaacgaagtgatagtcatgctcaacttctacccaccaaatgccttcactacagttttacctgcagacttgatctcattcaaagcagaatgacttcttagagtacatatttggtcattatagcactatgcaatataattgtcaggtatctgttccaaatataagacctcatagtttcaaaggttactagaatataggtaaaaatctatcttttaaggttaggaaaactcaatacgtgaaaacgtgtatttcataaaatgatagctatagaatttaaatactttttgatttttaaaaaacgattatgaaagtaatgtatgctcatggaaaacattctaacaggaaaaaaaaaaaataaagggaggcagtggagatagggactgtagagctgtgctattcaaagtgcttctcaaacataagcgtacataaagattgccaggatcctcctcttcccttccttggaggcagctaggtgggtgggggctgaggtggcagaggtaggatcagggccaaggggatggctggcatacatcataggttgattaagcaaataatacagtgagtatagccagatgcagtggctcacacctgtaatcccagcactttgggaggccgaggtgggtggatcacctgaggtcaggagttcaagaccagcctggccaacatggtgaaaccccatctctactaaaaaatacaaaaatttgctgggcgtggtggcacatgcctgtagtcccagctacttgggaggctgaggcaggagaatctctcgaacctcggaggcagagattgcagtgagccaagatcaggtcactgtactccagcctgggtggcagagcaagactctgtctcaaaaacaaacaaacgaacaaaacagtgagtataatgagagccacgtttcctcacagttggaaaaggaacttacaaatattgaaaggtgaggctagaaagagctttgaggtgttggattagaattggaaatattggtctggcctcatggttttttctaacctatgaacatacatagagatctccatatatatacattgatctccacatgtctatagatacacacatacatatttctcagctcaatggagagactagaaggcactgcagtaataatgaacacaccaagtgcctagatactgatttctaaatcctgtccttccgtaaaggaaccagggtccttgcaaaattggctgattcaagaactgagacagggaaagaaaatgataagcctgggacattgatttatgctagaaattattcaatatatttccatgtgtgaggcctcagaagttacctttctaatgatcaaatgatctatcgtgtgccatgctaggaaggagtcgaagtgaaaaggaaggttctaagagtggtggactgtgaggctttagggccaggaggccggtgcagaatcactgagcatgacagcgggaggtggaatgggaaaggaggtggctgaaggcattgcagagctgggaaaggaacctgcaggtcaggaaaagcttcattctaaacgaggaatggagatttaattggcagcctggactttagtgcaggagagattggttggtagggtgtggtggaggaattgtctggaggagcgaggaagacggaagcatgtgctggcccttctcttgcttcctggactgtgcatgatgtttagaccatacatgattttcagattactgttgcataggaacaaaaagtacaaagagaatagctttttggtcttttctgacagcctacattttaggttctcttagtaacctggaagaattgatccttcctactggggatggaatttatcgagtggccaaactgatcatccagcagtgtcagcagcttcattgtctccgagtcctctcatttttcaagactttgaatgatgacagcgtggtggaaattggtgagctagtgtttcagcttgcatggaagccagtggtatagccaagctttctgctgcaacatgtctatgtaaacatttgcccctctagaaattttcaacccgcttcctcattttcactatcatactgttccttctagtgtccttctgtggatttaggcgcattctggtcagatttggaagtacaaaaaggtctcccatttgtggatatacaagccctcaaatctgcgttcttgccacctggtgttttagacacctggccacatactctcctaagtactcctttttaaaactgaagatgaatatacacacagaaaagtacaaaaatcatgtgtactgctcactgaattttattttcttattttcttcttttttttttttttgagacagagtttcgctcgtgttgcccaggctggagtacaatggcacgatctcgggtcactgcaaactctgcctcctgggttcaagcgattctcctgcctcagcctcccaagtagctaggattacaggtgaacgccaccacacctggctaattttgtatttttagtaaacacagggtttcaccatgttggccaggctagtctcgaactcctgacctcaagtgagccacagtgcctggcctgaggaactgagatttctgtcgagacctgaagggagaatggcccaggcatagttggtagaggaggaattgagacatcatttcaaacagaggtaatcacttgtgtcatagcctggagttaaagagaaccagatatatttgaagaacttgggggaaaaaaaggaatgtctggagcaagaggcaggagtgagttgtgagaagaagactggagaggaaagtaaaagcccaattggagaggctttgtcgggtgtgttacaagggctggatctcattttcttactgctcagcactgttattttacgttatttaaaacagctgggagcggtggctcaagcttgtaatcccagcactttgggaggccgaggcggatggatcacgaggtcaggagatcgagaccatcctggctaacatggtgaaaccccgtctctactaaaaatacaaaaaattagccaggcgtgatggcgggcacctgtagtcccagctactcgggaggctgaggcaggagaatggtgtgaacccgggaggtggagcttgaagtgagccaagatcatgccactgcactccagcctgggcaacagaacgagactccgtctcaaaaaaaaaaacaaaaaacaaaaaacaatgacaacttacaacgtttttcttaaaggccttgtttcttcctccttatgaggaagaatttaataacattaaattttgtggtctctctcatcctcatttactataaattatttgtgttttattcttctcactacattaggtcaaagccttccttagaacttcaatctcacacacagatttgagccagtaacccctgtcgctctccctcctgagagcaggtgttttctcttcccggcgcccagcagagtatgcctggcctatagtgggaactcagtaaatatttgttgactgaataaagaaaacttacttttctgtagcttcttctgatggacagctgagaggccattgtttgcctatagtcagtaatgcttaaactttacctgtaggagacagcattcagacacatcacagaaccggctaatcacacaatatgaagtgggagttatgctgaaacaggggaaagaagggaatggatgtgaaagacctgagtctttcttcaagtccctccagaagtgtctttcatgtgggggaatgagaaatatctcttgaatgttactgaagatacctattcaggacatagctgaagacattttctcagtacctctgttgtttaacctcagtcaagctacagccatggattctagattgaaaccaaacttaacctttgcccaagttagaaaaaaaaagaggtttagcaattaaaaacaaggctgggcatggtggctcatgcctgtaatcccaacacgttgggaggccaagatagaaggactgcttgaggccaggagtttgagacaagattgggcaacatagcaagaccttgtctccataaaaaattgaaaaattagccaagcacggtggctagtcctgagtagctaggactcaggaggctgaggcgggaggattgcttgagcccagaaattctaggctgcagtgagttataactgaaccattgcactccagcctaggcaaccaagtgacaccctgtctcaaaaaaaaaaatttttttttttttaaaaacccctaaaccaaacaacaagaactctgcttggtacccattccaaagtctagtcagcctgtgttcattgagaacacagggtgtgcccggcttccatttccttcagagcccttagtctcaaaaacaggagggtcccttctgggcaacagaaatagggcatagcagtggacagtcggatgacatggctttaggaatgtcacacccccttctctataaaaggggaagacataattgctacactctttgaagtcccttgtaatttagtctggatttttttttttttgttttctctttttgttttttagacggagtcttgctctgtcacccaggctggagtgcagtggtgggattttggctcactgcaacctctacctcccaggttcaagctgattctcctgcctcagcctcccgagtagctgggattacaggcatgtaccaccatatccggctgattcttgtatttttagtagagatggggtttcaccatgttggccagcctggtctcgaactcctgacttcaagtgatctacccacctcggcctcccaaaatgctgggattacaagcgtgagccactgtgacttgccaatttagtctggtttgtaggcatgatgtaccttggcatgtgacctcctgtgagaccaaaagagaagctcatatttgtccaggatggtgaaactctcagcacaatggcgtcagtgctttaggcttggctgtacttctttggtttctgcttctcccttagatttttgccaggtggttctttattaacccatcagctctttggggtttttaaggagatattttcaaaatattatattaagctgggcacagtgacacgtgcttgtaatcccacctacttgggaagctgaggcaggaggatcacttgagtccacgagtttgagaccagcctgtgatggccaggcgcggtggctcacgcctgtaatcccagcactttgggaggccaaggcgggtggatcacaaggtcaggagatcgagaccatcctggctaacacagtgaaaccccgtctctactaaaaatacaaaaaattagctgggcatggtggcgggcgcctgtagtcccagctactcgggaggctgaggcaggagaatggcatgaacctgggaggcggaggttgcagtgagctgagatcatgccactgcactgcagcctgggtaacagagcgagactccatctcaaaaaaaaaaaaaaaaaaaaaaaaaaagaaagaaagaaaaagagaccagcctgtgttaacatagcaagaccccatttcaaaaaacaaaattatattgagtacttcctactagcagtagtggtgggagaggaggctggttcaaataaccttgtctaccattattgaaatggaagtccttatgattctattttcatgaatgttttgttcttgtagccaaagtagcaatcagtggaggtttccagaaacttgagaacctaaagctttcaatcaatcacaagattacagaggaaggatacagaaatttctttcaagcactggacaacatgccaaacttgcaggagttggacatctccaggcatttcacagagtgtatcaaagctcaggccacaacagtcaagtctttgagtcaatgtgtgttacgactaccaaggctcattagactgaacatgttaagttggctcttggatgcagatgatattgcattgcttaatgtcatgaaagaaagacatcctcaatctaagtacttaactattctccagaaatggatactgccgttctctccaatcattcagaaataaaagattcagctaaaaactgctgaatcaataatttgtcttggggcatattgaggatgtaaaaaaagttgttgattaatgctaaaaaccaaattatccaaaattattttattaaatattgcatacaaaagaaaatgtgtaaggcttgctaaaaaacaaaacaaaacaaaacacagtcctgcatactcaccaccaagctcaagaaataaatcatcaccaatacctttgaggtccctgagtaatccaccccagctaaaggcaaacccttcaatcaagtttatacagcaaaccctccattgtccatggtcaacagggaaggggttggggacaggtctgccaatctatctaaaagccacaatatggaagaagtattcaatttatataataaatggctaacttaacggttgaatcactttcatacatggatgaaacgggtttaacacaggatccacatgaatcttctgtgggccaagagatgttccttaatccttgtagaacctgttttctatattgaactagctttggtacagtagagttaacttactttccatttatccactgccaatataaagaggaaacaggggttagggaaaaatgacttcattccagaggcttctcagagttcaacatatgctataatttagaattttcttatgaatccactctacttgggtagaaaatattttatctctagtgattgcatattatttccatatcatagtatttcatagtattatatttgatatgagtgtctatatcaatgtcagtgtccagaatttcgttcctaccagttaagtagttttctgaacggccagaagaccattcgaaattcatgatactactataagttggtaaacaaccatacttttatcctcatttttattctcactaagaaaaaagtcaactcccctccccttgcccaagtatgaaatatagggacagtatgtatggtgtggtctcatttgtttagaaaaccacttatgactgggtgcggtggctcacacctgtaatcccagcactttgggaggctgaggcgggcgaatcatttgaggtgaggaattcgagaccagcctggccagcatggtgaaaccccatctctactaaaaatacaaaaattagccaggtgtggtggcacatgcctgtagtcccagccactagggcggctgagacgcaagacttgcttgaacccgggaggcagaggttgcagtgagccaagatggcgccactgcattccagcctgggcaacagagcaagaccctgtctgtctcaaaacaaaaaacaaaaccacttatattgctagctacattaagaatttctgaatatgttactgagcttgcttgtggtaaccatttataatatcagaaagtatatgtacaccaaaacatgttgaacatccatgttgtacaactgaaatataaataattttgtcaattatacctaaataaaactggaaaaaaatttctggaagtttatatctaaaaatgttaatagtgcgtacctctaggaagtgggcctggaagccattcttacttttcagtctctcccattctgtactgttttttgttttactttcgtgcctgcattatttttctatttaaaacaaaaataaatctagtttagcactaaaatattaactggagctacctctggagggcaagagtactagaaggtgggatggattgtcttcttgcttgtctgattttatatgtaatacctttgtaattagaaaggttgttaagcattatatcagaatccagtcaggagacagaaaccacacagaaatttgaatggggaaagtttaatatacagatgctcggcctgacgcagtggctcacgcctgtaattccagcactttgggaggccgaggtgggcagatcacttgaggtcaggagttcgagaccagcctggccaacatggtgaaatcctgtctctactaaaaatacaaaaaaaaattaaaaaaaaaaaaaaagccaggcatggtggtgtgcacctgtagtctcagctacttgggaggctgaggcaggagaattgcttgaacccaggaggcagaggttgcagtgagccaagatcgtgccactgcattccagcctgggtgacagagcaagactccatttcaaataaataaataaataaataaaataagatgctcctcaacttacaacagggttatatcctgaaaaacccattgtaagtagaaaatattgtatgtcagaaatgcatttaatatacctaaactaccaaacatcatcgcttaacctgacctaccttaaacacgctgagaacacttatattagcttacagttgggcaaaatcataaacacaaagcctattttataataaagtattgaaaatctcacgcaatttattgaatactgtacagaaagtgaaaaatagaggtcgtatgagtacttgaggaacagtttctactgaatgcggatcacttttgcaccattgcaaagtagaaaaatcctaagtcaagtcatcatgagttggggactgtccgtaagagttattaacagaggattggaatggggattgggtagtaaggaataaagagaagcctgggcagatgcagggaacagccgatatgggcttttcaccccaggctgagacagaacaactcaaagaagaaagctcagggctgagatccgggctgagatccagacttcgtgtgagaggacacagctgtgaaagacagaggtttgctgaggctgtggagttgcagctggagaaggtgctgggcttggggcactttgcagagaagggaccttgtgcatgtcaagggaagccattcatgtgggggtactgtgcgctgctgaccattgggtgctgctgaagttaggcaccgcccaagaagtgtgcagccagaacgaggtgctgcagaggcagagtgtatgtgctacaggagctggtattgcagatggcacaggtgttgcaggtgtctgcctagaggagcacaatggaaccaggaaaagcagcccttgccccttcagtgtgtcagcagcaccctcgattgacaaagtttcactctgtgcttactgtcatgggagaggtatttacagggcccagatctattattacagaacagacaatgaagactgaatgtggatataagaggcaacaactagcataactcattaaatctaatagtgcacacataaacacaaaataacctagtaatttcttaatattgactgacaggatatatgcacgtgatgtatttataaattcatggaaaacttatataaaaaacaggcaaccataattgagtttagggaggagaacaggatggctggtggacagaaaagggagagagggaagtttgctttttttctcctgcatacccttttataccagttgagttttgtcccatgtgtgcatactattaaaaaaccataatacttgaccaggtgcagtggctcacgctggtaatcccagcactttgggaggccgaggcgggtggatcacctgaggttgggagttcgagaccagcctgaccaacatggagaaaccttgtctctactaaaaatacaaaattagccacgcatggtggtgccttcctgtaatcccagctactcgggaggctgaggcaggagaattgcttgaacccaggaggcggaggtt

SEQ ID NO: 657 - DNA, 20936 bp, Human
ccaagtagctgagactacaggcacgcgccaccagtccagctaatttttgtatttttagtagagacggggttttgccatgttggccaggatggtctccatttcttgaccttgtgatctgcccgcctcagcctcccaaagtgccaggactacaggcataagccaccacgcccggcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttggctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgatccgcccgcctgagcctcccaaagtgctgggattacaggcgtgagccaccgcgcccatccttctttttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtagaaatggggtttcatcatgttggccaggctggtcttgaactcctgatctcgtgatccacctgcctaggcctcccaaagtgctgggattacaggcgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaaggagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatataataactggaaggccccgcccctctggtgcatttccccgctccaaccacctcctcaaactcacggcaaagggatgcgagagctggaactcttaccaggcctgcggaaactcagccctccggcagctaatcccgcccgccagcccccgtcctctctttctccctagctgaaggcgccacgggccgtgtgtcgttgccttccacttttggcgtcccaacgtctctccgctcccatctttctactaacgtccgacgcacgctccgcctctttctcccacattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtataaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggtgagtctgggtgaaccgtgcgctgacgcccttttccggcgcgggagaggtggtggcggtggcggtggcggcggcggcggcggtggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctgttcctcgtctcctttctcccccaaccccgtttttcttcttgggcctctgcccccttacttcgttgtctacatcctttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgaagatggctctggccttggccctctgttttctggcccatggttacagggtgctaaggtggctccataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaaggtgtctgggggaaaggagggaacatggcatttgagctatgagggagctaagtagatcatggttgcttaagaagagtgggcagtttacatagactggaggaaaagacaccagagggcctcatatctgagtccctaatgataatgcaatggagtttttaagtttctgttatggtctgtacaggggacagagactgagacacttgctgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccagaaacccgctggtgagagtcctgcaaagatgcttctgatggttgaaagctaggcatgcatggggcatacgttttagagctctttaaagggaagtggctgtagtagaaataccaaaagactagaggagatttcccaactttacactgggtcctttaaagggggtgtgggctctgggtgaacaccagttatcctcctacaaaggcgtgtctgtggttccctgtctttggacacgtaagaattggaggaaaataaatgtggatttgggaaactttgaggccagcttgcttcttgcaggctcatgatcaaccaatctcacataaaagtattgaatgttacatatctcagccttcttgatagggatttcatagatttttttttttttttttttttttgagaccaagtttagctcctgttgcccaggctggagtgcaatggtgtgatcttgacttaccacaacctccacctcctgggtttaagcgattatcctgcctcagcctcctgagtagctgggattacaggcatgcgccaccacacccggctaattttgtatttttagtagagacagggtttctccattttggtcaagctggtcttgaactcctgacctcaggtgatccgcctgcctcggcctgccaaagtgctgggattgcaaagtgtgagccaccacaatcagcgcgatttcagagattattaagggcaggggaaggaatcccttctaagagaagtttggaggaagtaggtaataaaatattcaacatgtataaatgtgtcccaggataggaggccatcagatctcccacatgaggcattttcgaccctctctccgtcttgttctccagttgcccctcgccatggcctgcagagtctcgggaaagttgccattgcccggcgtatgccacctccagccaaccttccaagcctgaaagccgagaacaaaggcaatgaccccaatgtctcactagtgccaaaagacggaacaggatgggcaagcaaacaggagcagtccgaccccaagaggtagacagaggcttgggggacctagagtgatgggtattttaacttgaacttcagggagcattggggcttggtttagtccagccacgtctgagccagagacgaagaggtccctttcttacctattgcaggttccttgttaaatgactaaggaatggtactaaactttagctttttgtcttggagagagagcatgaaaaaatagacaacagcctacaaaggatgacaaaattattttgtccttatatttgtaaatggtagcaatgggcatgatttcagtcctgagtctccaccagttggagaagtcagggaggcatctcaggtgtgaataaccttcccattctgtcccctcagttccgatgcctcaaccgctcagccgccggaatcgcagccactgccggcttcacagacgcctgcctccaaccagccgaaacgacccccagcagcccccgaggtacctggagaactggaggggtggggaggaagaatggttcatagctgccccacccacatcatttatcatctttctgaacacttccccagaacactcctttggttccaagcggggtaaagtcctgggcacaagccagcgtcacccatggagcacatggagatggtgagtgcagcacttaattggggagctgtgtctgggcaccatgggatgcatgaaccctgcactgtattttcagccaagtgaccttggtcctctttggctaaatcaaggaccacccatattcagtttcatggaggcacatgagcaagtttaagtctcagtcttatatgatggagtgtagtggtgccagaactgacctccttggggaataagcagttattctgtaggggggtgagtttgaaggcgggaaacctgatggtctggtacctgtcagagccttccactttttttttttttgagacggagtctcattctgtcacccaggctggagtgcagtggcgcaatctcggctcactgcaacctctgcctcctgggttcaagcgattttcctgcctcagcctccagagtagcgggactacaggcacacgccaacacacccagctaattttttgtgtgtttttagtagagatggggtttcacatgttggccaggatggtctcgatctcttgacctcgtgatccgcccgcctcagcctcccagagtgctgggattacaggcgtgagccaccgcgcccagccagagtcttccacttttatagcatgtcctcaggaaatgtcttctgtctcctgttctgcatccccatcctaataggtggaagggcatcaagcctactgtcacgattctctcgagaggaatttccgaccctgcaggcggctggcgaccaggacaaggctgccaaggaaagggagtctgccgaacagtcgtctgggcccggaccaagcctccgcccccaaagtgagtggctgccttttggccaagacattacctattgcatctcagagctaggtgctggcttattcaccttcctccccatcactttcagctgtgttcacttgtcctccaatcattgatacctctctctaccttttccaaaatacagattctacaacttggagggacggaggtgggcgtggccctgatgagctggagggcccggactccaaacttcatcatggtcatgatccccggggtgggctacagccttcaggcccaccccagttccctccctaccgcggaatgatgccgcctttcgtgagtcttggtgtcttgtcttggaacgattacactggaagctggagagctaggaatcaggacttagtctttgacctatgagatagaagggagggtgggaggatgattgatagcaggcttaaggagctagaagggtatatgactgtccctctgagcagctactgttggacccttttacagatgtatcccccatatctcccgttccctccgccctatggaccccaggggccttaccgataccccactcctgatgggcccaggtgagcaatccaggtctgggtttgtggctgggggcaggggaagcttattgggggaggagatggttttctagccaggaggctcagtctaggatcagtctcgcatgtggttatacaacatgccatatttcattttcttttttgtgtacagccgttttccccgtgtggcgggcccccgaggctcagggccaccaatgcgcttagtagagcctgtgggtcgtccctctattctcaaagaggataatctcaaagagtttgatcagttggatcaggagaatgatgatggttgggcaggtaagtggatattaagggtcaagaatttggatcttgaaaggcaaaacctaatgaggaaaaaaaaatacagggttatgtgggtgaaaggcagacattgaagtgtaggaagaccaggcccaatggctcacatctgtaatcccagtgctttgggagtgttaggtgagaggatcgcttgaagccaggagttcaagaccagcctgggcaacacagcaagaccccccacctctacaaaaaaaaaaaaattttttagttgggtgtggactgtgcatctgtggtcccagctactctggaggttgtggtgggaggatcagttgagcccaggagttggaggtcacagtgagctatgatcgtgccactgaactccatcctgggcaacagagcgagacttttaaaaggaaaaaaaaaaaagagtaggggaggatggatggggaataccaagtccttgcaaagtggtgagaggagtaagaatgacaagacttcattggtggatctagacttcggagggaaggatattggcattggtagtccatcttgttacatagttccagactacctcccaagattggagggcagaatgcttgggttactaatactcatatttcccctcaggggcccatgaagaggttgactacactgaaaagctcaagttcagcgatgaggaagatgggcgagactctgatgaggagggagctgagggccagtgagttagggccatcaggggagaagaggagggggtcttggtttgtattttggtaatatactcttagaggagtatattagttgcagctgattttaatttcactgttgatctgctcacagcagggattcccaatcagcttctggtgaggaacggccccctgaagcagatggcaaaaagggcaactcccccaacagcgaaccgcccactcctaagacggcctgggcagaaacctctcggcctccagagacagagccgggacctcctgccccaaagcctcccctacccccacctcaccggggccccgccgggaactggggcccccctggggactacccagtgagtgtctccaataagggattgagagggtcagctgtgggaaattggtgtcagctgagtaattgaagcggttgtgatatagaggaaggggggtgctaaaaatgggctgtgtgaagtgccaggctgcagaacatcctgggaagcttttaaatatctttggtaataggggagtctgggtaagaagtgagaaactgggatgctaatgaggaaagaagaaaaaggagccctgggtgtttgggtttcggaaggagagagggaacagaaaaataaaaagactagggtggctagatagctggatctgttagtatgcatcagtagtccaagctactcagcaggctgaagcagaaggatcacttgagcccaagttcaagaccagcctgggcaacatagcaagacgtggtctcaaagaagaccaggataatgagtttgtcaccacccagagagatcaaccccaaagcctgggtcgttgcatcctgcaagtagcgacagttgatttgttgtaaaagagatgatagaaagcatagtaactgattcccctggccctgctgggtcttgccaattgacaggatcgtgggggtcctccctgcaagcccccagcacctgaagatgaggatgaggcatggcggcagcgacgaaagcagtcgtcatctgagatttccctggcagtggagcgggcccggcgacggcgagaagaagaggagcggcgcatgcaagaagagcgccgggcagcctgtgctgagaagctcaagcgactcgatgaaaagtttggggcacctgacaagcggctcaaagcagagcctgctgccccacctgctgccccttctaccccagctccaccacctgcagtccctaaagaactccctgcacctccagctccacctccagcatcagccccaacaccagagaaagaacctgaagagccagcacaggcccctcctgcccaatctactcctactccaggtgtggctgcggctcccactctggtgagtggtggtggcagtaccagtagcaccagcagtggcagcttcgaagccagcccaggtatggagatggggataggtactaccagatgtcagatcactgcttcaaggtgcttaaaggtgcagggtggtaaggctggggataaatgaagtagaaggcagttgttttggtttattggactatcagtgatagtgttctatcatttgtatatctgaaggagggaaggttttgtctggaatcttaggttgtagtctaataccatttcttggcagagtactgtagctcacgcctataatcccaacacttagggaggcttggggtggaggatcgcttgagcctagggagtttgagaccagcctgggcaacaaagcaagaccctgtcggccaggcatggtggctcacacttgtaatcccagcactctgggaggccgaggcgggcagaacatgaggtcaggagttcaagatcagcctggccaacatagtgaaacccgtctctactaaaaatacaaaaattagccaagtgtggtggcatgtgcttgtagtcccagctgcttgggaggctgaggtagtagaatcgctttaacccgggaggcagagatttctgtgagccaagaccatgccattgcactccagcctgggtgacagagcaagactctgtctcaaaaaaaaatcctgtctcacaagaaatacataaataaaaatgaaaactatttcctataggccaagactgaagaaagtactgttgttctaatggtttcatagaaagttaatgccaccaccataggctcatgagaggccatgaagtgctttaatgggtcttaaatgggaggggcttcaatagaatagatgttgaatagaatattttagtcttaagggagctagagatgagacgtgagattcctggggtgttcatggagtgtctattgttggactagatcactctgttgtgttttttccgatgcagtggaaccacaactgccctcaaaagagggtcctgaaccaccagaagaggttcctcctcctaccacacccccagttccaaaggtggaacccaagggtgatgggattggtcccacccgccagccccctagtcagggcttgggctaccccaaatatcagaagtcgttgcctcctcgtttccagcggcagcagcaggtgaaatcaagttgtttaccctctaagggctgcttttcttcctggcttcggtccctaattctcttcataagttaccttctgggtccctttgcttctttgtccagttgtctccattgtcacgccaatttcccctagtccaagttttttctttgctgattcctttgtccatgtgtgctttgagcctctctcatcttgtctttcctcctttcctaggagcagctcctgaagcagcagcagcagcaccagtggcagcagcatcaacagggctctgcccctcctaccccagtgcccccatcaccaccacagcctgtgaccctgggggctgtgccagctccacaggctccacccccgccccccaaggccctgtacccaggtgctctgggccggcccccacccatgcccccaatgaactttgatccccgatggatgatgattcctccttatgtggacccccggctcctccagggtcgtccccctctagacttctaccctcctggtgtgcatccctctggtaagggggcatgggaggagtgagaaacaggaaagtcccctcagtcttaggcattggatattagggtcttactgtgactctggtacgataggttttgcccatcatagtgatgagggaagggcatatgcttggcactgctgagatagctctgttgcaaaaatgggcttagttaagaaataagcagtggttggccaggcattgtggctcacgcctgtaatcccagcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttgtagggaatctgagtggataaccttgttatataagagcaggcaaggcccggacctactgggaacaagagatggaagagctgacttgaccgcgaggggagatgctttttgggctggagggcttgtgacatgaataggattatttttctttttctttggtttcttcaggcctagttccccgagagcgttcagacagtgggggctcaagctcagagccatttgaccgtcatgcacctgctatgttacgggaacggggcactccaccggtggatccaaagttggcctgggtaggagatgtcttcaccgccacacccgctgaaccccgcccacttacctcacctctgcgccaggctgcggatgaggatgacaaggggatgaggtgagtcttggtcatgagaaatgggtgagttcacagtgaaaggatctaggcctgggagaaaggtactttgggttagtggtagggatagggatgaacgggaaaggagaggctggatggagtggctcatgcctgtaatcccagcattttgggaggctgaggcaagaagattgcttgagcccagcagttcgagactagcctcggcaactggatgccatctctgccaaaacaaacagaaaaatagtaaaagagagtctgcatcataataaagtgttcttttcccacctagttctggttttcctgagatacttatttccattctttctgtctgtctcttcaggagcgagactcctccagtacctcccccaccaccctatctggccagttatccaggctttcctgagaatggagcccctgggcccccaatctctcgctttcctctggaggaaccagggccccgtccactcccctggcccccaggcagtgatgaagtggccaagatacaaactccaccacccaagaaggagccccctaaggaggagactgcacagctgacggggccagaagcaggccgaaagcctgcccgcggagtcgggagtggaggccagggccccccaccaccacgcagagagagtcgcacagagacccgctggggccctcgtccagggagcagtcgtcgtggaatccctccagaggagccaggggccccaccccgccgggctgggcctataaagaaacctccaccacctacaaaagtagaagagctgcctcccaagcccctcgaacagggggatgaaacccccaaacccccaaagccagacccactcaagataaccaaggggaagctagggggccccaaggagaccccacccaatggaaatctttcccctgccccaaggcttcggagggactattcgtatgaaagagtgggtcctacctcttgccggggtcggggccgaggcgagtattttgccagagggaggggttttcgggggacctatgggggacgagggcggggagcccgaagccgggaattccgcagttaccgagagtttcgaggagatgatgggcgtggaggtgggacagggggaccaaaccaccctcctgctccccgaggccgcactgccagcgagacacggagcgagggttcagagtatgaggaaatccccaagcggcgccggcagcggggctcagaaacaggcagcgagacccatgagagtgatctggctccttcagacaaggaggctcccacacccaaggagggaacactcacccaggtccctctcgctcccccaccaccaggagccccaccttcaccagccccagcccgcttcactgcccggggtgggcgagtcttcactcccagaggggtgccatctcgccggggccgaggaggagggaggccccctcctcaagtttgcccaggctggagccctccagccaagtctctggctcccaagaaacctcccacaggccctttgccaccaagtaaggagcctttgaaagagaagttgatcccagggcctctgtcccctgtggcgcgcggaggcagcaatggaggtagcaatgtgggcatggaagatggggagcgaccccgaaggaggcgacatgggagggctcagcagcaggataaaccgcctcgtttccggaggctgaagcaggaacgggagaatgccgcaagggggtctgagggcaagccctccctaacccttccagcctccgctcctggacctgaggaggccctcacaacagtcacagtggccccagcacctcgccgggcagctgccaagtctcctgatctgtcaaaccagaactcagaccaagccaatgaggaatgggagactgcatcagagagcagtgacttcaccagtgagcgccgaggggacaaagaggcacccccaccagtactgctgacacccaaggctgtgggaactcctgggggaggtggaggtggagccgtaccaggtatttcagccatgtcccgcggagatctgagccagagagccaaggatttgagtaaacggagcttctcaagtcagcggccaggcatggaacggcagaatcggcgccctggcccagggggcaaggctggcagcagtggcagcagcagtggaggaggcggtgggggtcctggaggaaggaccgggccaggacgaggcgacaagaggagctggccctctcccaagaaccgaaggtgggtaggaacaaacaaatttattgtggtttaaaaattggaggagggggaaaaagcctgagggaaagataagtttgggtggagtggagattgtggcctgaggggccatgggctctagaatgtcagtaggatttccatgtctggctaaggcaactggaaagcggttggtagggtgttagagtcaagaacacccacctatgtattcattgctggttctttgctttccagtctgtgcatctgtatgcataggaacccttagaaggactcaaaaacacctggactttaatagggaagagaataggttgtaagcagaagttgggaaacataacttgtgggaaaaagtaacgatttagtggatactggagctaatgctctgttttctccagtcgtcctccagaggagcgtcccccggggcttcccctgcctcccccacctcccagcagttctgctgtcttccgcctggaccaagttatccacagcaaccctgctggcatccaacaggctctggcccagcttagtagccgtcaagggagtgtaactgcaccagggggtcatccaaggcacaagcctgggcctccccaagcccctcagggcccctctcctaggcccccaacccgatacgagccccagagggtcaacagcggcctcagttctggtaagctggaggggttatgggtgggaatatctccatccccagagaaggtcaagtgctggagggagcgggtggagaacctggcctaggggcccctgctgctgggtgcgtttctgcagggagcaagggtagaagaattgggaggtggagtagagaggaaaagttagggtcagtggcagagccaggcagatgctgaccctttttctctttcccagacccccactttgaggagccggggccaatggtgagaggggtgggtgggactcctcgggactctgccggggttagtccctttccccctaaacgtcgggagcggcctcccagaaaaccagagctgctacaggaggtaagggatgggtttgagattgtgcttcactgcactcttactcgtgaaaattcttctgggttatgttttctctgttttctttcctgtttctttcactgtgtttttactccagaattctcagtattagtctcccatgtgtctcccttgttgtccccacaccctgtgtcaccccactctgtcctggcttcctataattcccaattcccacccaattcatgttttgcttctggcccttctcatctgtaggaatctttgccacctcctcatagctctggattcttgggctctaagcctgagggcccaggccctcaggcagagtccagagatacaggcacagaggccctgacccctcacatctggaaccgtttacatactggtgagtaaagctgagtgaaaggactatggtagaagggttaagaatgagaggggcttctgaactgtcatctcctcacttctcttctggttggtgctcccttctccagccactagccgaaagagttaccggcccagctccatggagccttggatggagcccctgagtccttttgaggatgtggctggcacagaagtgagtgagggtgggagggtgtgtctgagctgggacttttttgagcactggtcataccccccacctgctctgggttgagtctggagctgttctctcacttggctgtcccctttctgcagtttgtatgtgtgcatcagtcaggtattggggtgctttctaccctgacttaactagctccttctccactcctctcagatgagtcagtctgacagtggggtggacctgagtggggattctcaggtgtcatcaggtccctgcagccagcgaagttcccctgatggaggactcaagggggcagcagagggaccccccaagaggcctggaggctcctcacccctgaatgctgttccttgtgagggtccacctggctctgaacctcctaggagaccaccacctgccccccacgatggggacagaaaggtaaaagaccaaaaaaggataaggggaatgtttccaggaatctgactttggccctacctttttctgctttttctctctgcgtgtgtgttctgggcattccaatttggatttccctttccctcccccaatgcactttactgtgtgcccaatccaggagctgccccgggagcagcctctgccccctggccccattggcacagaacgatcacagcgtacagaccgaggcacagagcctggccccattcggccatcccatcgacctggtcccccagtccagtttggcactagtgacaaggtctgtgtgggctggatctgggtatcctgagttgggtggagagaagggaaggactaaaggtgggacatagaggacacatgtctgtcacgggacaatgtctcctgccttcttgtgatcacaggactcagacttacgcctagtggtaggagacagcttgaaagcagagaaggagctaacagcatcagtcactgaggtaagtgggagtaagagtttggtggaaaggcccaagatttctggggaagattgctgggagtgaccagggcgtccaggatgccagacatccctctccacgaggcctctccttcccaggccattcctgtatcacgagactgggagctgcttcccagtgctgctgcctctgctgagccacaatccaagaacctggattctgggcactgtgtcccggagcccagctcctcaggccagcgcctgtatcctgaggttttctatggcagtgctgggccttccagttctcaggtaggccccgcttcccattgcatgaccccttcagtgaataataatttttttctgcctggtatgtatttataatcaagcctttctacgttgcagagttgtgagataccactttgtcacatcatttttctccctactttttgcttctatgggtgggatggtgatcttttttcttgaccacagatactaaagctgtttcaaccgtgctcctctcctgcagatctctgggggagccatggactctcaattacatccaaacagtggaggcttccgccctgggacaccctcactgcacccttacaggtaagactcgatgcctgtggatcacagaagtacttggagatgtgtttcggggagagggaaggggaagacacagttctagggtactagaagctagtggacttaaggcattgctaggactctggcttcctaacagcttttctccccacaatttattttcagatcacagcccctatacctaccccccggcccagcccctccctcagcactgctctctggggtagctctcaagggccagtttctggatttctccacaatgcaagctacagagctggggaagttgccggctggaggagttctctaccctccaccttccttcctctactctccggctttctgccccagtcctttgcctgacacatcgttgcttcaggtaagaggggggcaggtattagatattgggggatagggtagggagaatgattttgtgggggttgatatatttctccctgtttcccgacaggtacgccaggatctgccatccccttcggatttttattctactcctctgcagcctggtggccaaagtggctttctcccttcaggggctcctgcccagcaggtatattgtatcttcacacttccccttcatttgatttctctgtccagttgctggctttgattttccctggttttctgacattcctccctgcccccaacatgcacacccaaatttcttgttacagatgcttctacccatggtagactcacagctgcctgtggtgaactttggctccctgccgccagcaccacctcctgccccacctcccctttctctgttacctgtgggccctgctctgcagccccccagcctggctgtgcggcccccacctgctcctgctactcgggtgctgccttcacctgccaggcccttccccgctagcttggggcgagcagaggtaaggtacaggaactgaggggctagggagcgccaagacttgggagtagggattctgtatttcaaggtaggcagctcatgatttttttcccctcagctgcatccagtggaactaaagccgttccaggattatcaaaaactgagcagcaaccttgggggacctggatcatcacggactcccccaactggaaggtgaaacggaatagggatgtggactttccaagtgcttccttactttggaaccagggtctggatcctaggcttgccttagacgcccttcttcccttaggtccttctctggcctcaattcccgtctcaaggccacgccttccacctacagtggagtcttccgcacccagcgcgtcgacctttaccagcaggtgaaggagaaacccttgtggccccaactctaaattcgagttgccacctgatttcctgtccttccgtctcatcgctgacctctcactgtgactcactctttaacacatgcctgtcccctaggcctccccaccagatgccctgcgctggatacctaagccttgggagcggacagggccgccacctcgagaagggccctcccgacgggcagaggagcctgggtcccgaggggacaaggagcctgggttgcccccaccccgctgagggagttcctcttgccccctacccccggggcttgtatatagattataaatatataagggggaaaggggtgggcggggaggggttgtggggctggggcctcacttcccctcctcccccttcccctggtcccctgtccctggggctgtttgttaaaaaagagtaataaaaggatttaaaaaaaaaaacttctacaatgatttgggggatgagttgtttgcattgtcttaaagcatggtgctgagtgatctgtagtttcagtcagggaaatattcattacttattccagtgagctgttgaaactaaaaacatgaccatcgtattggatctttaaatttttgtgagtctggaatttgggctgagctcagctggataaatctgcttttttgtgccagtgagcgaggtcaactggttatcagtctgcagctgacacctgggctggtcccaatatggcttcctttgcatatctagggccttggtgggacatctgtaacattactgggttatcaaccagtgtcttcacatggactctccagcaggcctgttaaatgtccgtgagctcatgttccaagaggtctagctggaattttctaagcttatgccatgcttagttgatagagcactaaactagccaaggtaggggatgggggggtttagaagggacttcaactgcatctcaaagggactagcaaagaatttgcagccatgggacttcagttctttatgatgaactaaggggaaatctctgttaaggcctcaatgttggagcacacttaaggggctctttgaattggatagaccaattccagcattgtcaaactaagtgggatttcacatggtaacgctgcatgctagttatgctaaagactatacttaggtctgcagctgctcagaaactttttttgatgggtaatttgagagctctatgctagtgtgcacctggaatatgctcccaactcaaaatacaggttttttatttatatataaagtgctttcgcacaaaaaatacaaacaccaggctgggcgcggtagcccacgcctgtaattccagcactttgggaggccaaggcgggtggatcacaaggtcaggagttcgagaccagcctggccaatatggtgaaaccctgtctctactaaaaatacaaaaattagccgggcgtggtggcggacgcctgtagtcccagctactcaggaggctgaggcatgagtgagaatcacttgaacccgggaggtggaggttgtagtgagccgagctcgagatcgggccactgcactccagcctgggagacagcaatactctgtctcaaaaaaaaaaaaaaacaaacatcaaaactggcttgtacaatttagcgtgctgagtagaacacaacagtgttccaaggaagtattaatttaaaaaagttcacacaagattaagggacacactacctaatggagacaatgtagagagaaagcagccagaaaaatccgacttttatttcttaaatactgtgaaggaagaggggggaaacggtcccctgatgaggaagggccatagagcaaagagctaaggatcatcagcaaaggcccgctgggcattggggaagcgctggggactgtagttggggtcttcctgcagtcgtttttgtatatcagaccggagctaaagagaaaaagtaagcaggttggagaaacgctggccaagtccctatgatcccagcaagcacacaaggccatccctcagaagctaacatttccccccccaagcacactgtcaaatagcccggggtggcactgtcaagccttcccagatgccaaaggggaaaacaaatggtagcaccaggctgaccagttcatcgctgaagggatccagggaagagggaccctagcccaacccctcccactagaccatccctattctgcttcaaggtggcacctgctgcctgtagctctcctgaacctctggtgcctccaggtcccggctcaggctctcggggctcgtcaggggccgagctccggctgccttagctgcccggctcacagcctctgagagaagcagctgggggccctcaccctgcatcgtctgggggacagggggttgggagggaaaagaggatcaacgtcagatccagtgccaccatccggctcaccctttccatgagtcaaccactccactgagtctccatgctagtggagag

SEQ ID NO: 658 - DNA, 17591 bp, Human
tttaagacagggtctcactctgtcgcccaggcatgactttgacttccccggctcagatgattcccgagtaggaggtataggtgcacgccatcacgcctagctaattttttgtagacacggagtttcaccatgttgccccaggctggtattaaactcctgagctcaagcagtcggcccaccttagcctcctaaagtgttgggattacaggcatgagccaccacacctagcttgataaatttatatcccatggactgccacaaaaaatttgccgagggctgaggcttgcgatttagttaaaaaacaaacaaaatttgggtgaccagtatattagagtttattaatactgttctattttggtgtaatgtttgaatttttttttttttttttttgagatgggagtctcgttctgttgcccaagctggagtgcagtggcgcgatcttggctcactgcaatctccacctcccgggttcaaagcaattctctgcctcagcctcccaagtagctgggattacaggcgcccgccaccacgccaggctaatttttgtatttttagtagagatggggtttcaccattttggccaggctggtcttgaactcctgacctcgtgatccacccgcctcatcctcccaagtgtgagtcactgcgcccggccgaaaatttttgtaataaaaagctaaaatgtggttaggcacagtagctcacacctataatcccagcactttgggaggccaagtctgcaagaccaggctgggcaacatagcaagaccccatctctataaaaataaaattagccaggtgtggtggtgtgcatctgtggtccctactagggaggctgaggtgggaagatcggttgggctcgggaggcagaggctacagtgagttgtgattgcgccactgcactccagcctgggcgacaaagcgagaccctctctcaaaaaaataagctaaaatgttaacagctttttattggggcagtaaagtacaagtgctcgatctggagtcctgtaggcctggatttgtcaattctgacacttatgttcgtctaagtgtactcacttaaaaaatgttaaaagctcgttaaaaggctttttaaaataatacacaaaacccgtagtatatgggctggcacaagtgctcattaaacagctgcttattagaactcttaactaaaatataaccaggacctgggtataaactacgaatcccagaaaggttggacaccccaacagcgatgtgtctttctggaggactcgcagtttcgcggggccgaggcccttggcccagggcaggttaagagaagagggcacggagaggcggtaatgcctccacccccggccttcggaagcacgctggccggcctttaaattccccacggtcagggtcttgtctttctgtccactcggactccatttgctcccaattctcaaactcggaagcgcctcttttcttgacaagtcgtgcaacttagtagcacgtttacttttcctaaaacgtgtcatgtccccttggccacacaccgacgaatgtgacgcccacagcccttaaaacgcccacccggcagaaccgaaatctagcccaaccaagcaaccgagaacaaaattgaccagtgccgcccccaaacgcctactgaaagagtaacttccggaggcacagaagaaagggcgcagcgagggcaatagggtggagaagagttttagctggctaggacagtgccgcctgaaattatcagcctgccaagatttaaacatagatgaatgtggcataatcccccatctccaaagtccaaggtccatacgaccgtccatagcccctctcgaggcagtggtagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtgctcggctccctcccacctaggccggccccggcccgactcgccctcagaaactcactgtttggggctgcggactttctcgtcgtgccccacaaaagtaaagcttggggacctggggggagccggaagtatcgcttcgagatccccaaatactatcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtttggctgtgggttagttgtgccgttctgctggaacaccgtgggaaggcagtagacgcgggcagtcagctagcaggtccgtcgccccgtgagtgccgtttcgggtctatagtgagttaggagggttcgatgggcgtggcgcgcgtgcgcgaaaccactttctccgcagagtgtggggcgaccaccgctttcgcgttgtcccaggattttccgacctctggggcgcttgtcctgccgtgaccggtgatgacactagtctctggtctcgtgcttccttcctaatctgactggctccctgcttattgtgattggcgtcgtggagcccctcccacctctcgtcctccagctccctaagccgtcgatctcctgccctttgtgtttctctccctgtgccccggaatcagaagggggatggggacaggtgtgaatgtgtgtgtgtgcaggagaaactttttaggtattggggcagggattaatgctagggagtctttcgggtacactctggtctgggcaacagcgggccttccttccttcgttcttctttagagacctgtcggccatggagcctaatgatagtaccagtaccgctgtggaggagcctgacagcttggaggtgttggtgaagaccttggactctcaaactcgtacctttattgtgggggcccaggtgagacacctcactagttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctcagcctcctgagtagctgggattataggcgtgtgccactatacccagctgatttttgtatttttagtagagacggggtttcaccatgttggtcaggctggtctcgaactccttacctcaggtgatgtgccctcctcggcctcccaaagtgctggtattacaggcatgagccaccgcacctggcctcagattttctttttattgatccctttgttcgtattccagtagaacgttttctgatgttttgtgagtgaggctgattttgttctgtcctccacatggatagaacttaatgcagagggaaatacagaggaaggaagaatctgtgtgtcatcatcatgggtggaccccaacccaaagggacaggcatggctctggcctttgggaagggaaacagcacaggaaccctaagcaagtgtgtcttactgatagacattggtcaggtctatgctgtgtttttaaagggtagaaatcagaacccataatggagataggtccttgatagactgttgagtgaaattactaatttttatggcatagcttgagtctcttgagcttaaagccttggacatagctatctgtgtctttactcctgtaatacttggagacaaattgcatgtggggtggtccatggttttctaaaatgtgatattacctggatataagaaagccatatatagacttgtgattagatgtatataaatactctggtacttcccaagagtcagtttgtagttaggaaaaatatttctctttttgcttttttttttttttttgagatggagttttgctcttgttgcccaggatggagggctggggcgcaatctcagctcactgcaacctctgcctcctgggttcaagcaattttcctgcctcagcctcctgagtatctgggattacagacgacgcctactaccacgcccggctaatttttgtatttttagtagagacagggttttaccgtgttggccaggctggtcttgaactcctgacctcaggtgatccacctgcctcggcctcccaaagtgctgggattacaggtgtgagccactgtgctgggaccttttttgctttcttatcttcttagtctttcttcattaacctgataccagaccccatcttctttgccattttttaatcttggaaatcacaggagagtctggtaaataaactggtatcatcttgtgtttggaaaggggtcactgatgtctctagacacatactcccttggatgccagacagataatataatgtccatgtgttttttttttgtttttcatccgtgttatttttcctggatctataacctgagcttcattaagtttatttatttaattttttgagatggagtccctctctgtcacccaggctagagtgtagtgatgcgatctcggctcactgcaacctccgcctcccgaattcaagtgattctcttgcttcagcctccctagtagctgggattacaggcgaccaccatgcctggcttatttttttgtatttttggtaaaaaaggggttttaccatgttggccaggctggtctcgaactcctgacctaatgtgatctgcctgccttggcctcccaaagtgctgggattacaggtgtgagccaccgcgccaagccaaatttattgtctgtattttgacagctgttactttagtttaagggtttgcacagtaatgatctcacggtcaagacaaacgggtagtgattctgtggtggtttttacccctcacctccacaactcggttgtctgtctttgttcttcctctttcctccattctttccattcctgtgcatgcctcttcttttcagatgaatgtaaaagagtttaaggagcacattgctgcctctgtcagcatcccatctgaaaaacaacggctcatttaccagggacgagttctgcaagatgataagaagcttcaggaatacagtaagggggctggggaggcagttcagaggttggggctactgtctggagggatgaactgaggccatgggtttacctgttcatactatgttttggtgtgtgtctatttttctgcagatgttgggggaaaggttatccacctggtggaacgggctcctcctcagactcacctcccttctggggcatcttctgggacggggtctgcctcagccactcatggtgggggatccccccctggtactcgggggcctggggcctctgttcatgaccggaatgccaacagctatgtcatggttggaaccttcaatcttcctgtaagcttatgttccacaggggagggcttttgtgggtagctttggttgtggtagcaccagggaattaataagatagatgcttccatctttagattgggttcagggggccctgtggtgtgctattggtctcagtctttaaggagaaaaggaggtagggctccagggaatgaattggaggtgtggaggccttagtgttggcttctcccagaacaacttcccttaccctttccccagagtgacggctctgctgtggatgttcacatcaacatggaacaggccccgattcaggtattgaggggcctccgagggtcagggaaggggatctgggagaaggaggctgggaggtggggtggacctggctgagagatggctgggacctgatttagtaggtggtagaactcatggcttcatctgtaacctaccctgataaaccttctctcattgtagagtgagccccgggtacggctggtgatggctcagcacatgatcagggatatacagaccttactatcccggatggaggtaagtgggcaaggctggctagggtctctctccaccctccctctcccttttctctcagcctgggagttagggcttcactggccacatccacagggtttggccttcataatctagtcttctctgcagtattcattcttttgggcagaaaaagtatctttgtgaggctctctcatttctgccaatcctcttggtgcctggtatctggggagtttgtttcagacttagtctcatggcatctcttttcaattaaaggattctactctcttaacttgtggaggctgggaaaccaacttgtggaggaaaggaaaccacaatctctactctttgttagaaatttatttacaaatattacagatgctgtggccgggtgtggtggctcctgcctgtaatcccagcactttgggtcgccatggcagggggataacgtgtggtcaggagttccaatccagcctggccaacatggtgaaaccctgtctctactacaagtacaaaaattagttgggtgtggtggcacgcgcctgtaggcctggctacttagaaggctgaggcaagagaatttcttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagttaggatactttctctgttcagtctcctgtagagtaatcctctgcagcagtcttaccctgcctttggtatcctgactctcccctaccttcagtgtcgaggagggccccaaccgcagcacagtcagccgcccccgcagccaccggctgtgaccccggagccagtagccttgagctctcaaacatcagaaccagttgaaagtgaagcacctccccgggagcccatggaggcagaagaagtggaggagcgtgccccagcccagaacccggagctcactcctggcccagccccagcgggcccaacacctgccccggaaacaaatgcacccaagtgagagatggagggaatctttagtgggtggggaatcctaagtgaagtatggggagaaggaaatgaaccatggcaagggagggaaaggattacttggaggtcttagttgaagggttagcattgaggggcgaggaggggctctctcggtataggtaaatgacgctaggacaggcagctgagaagaactgctgctctccctatggcaaggaaatccaaatggtatctcctgagcctgatcggaattctcctctgagttcacgaaggcctgctctctttcttagaattagtctttcaccattgtaggtgcaggattgtggtggggagggtgggagcagttcattttcttctccctatcctctcatgggtgggagtaaagaatagaagctttggctgggtgcagtggctcatgcctgtaatctcagcactttgggaggcagaggcgggcagatcacctgaggtcaggagttcgagaccagcctggccaacatggtgaaaccctgtctctactaaaaaatacaggccgggcacagtggctcacgcctgtaatcccagcactttgggaggccgaggcgggtggatcatgaggtcaagagatcgagactatcctggctaacatgatgaaaccccgtctctactaaaaatacaaaaaattagctgggcatggtggcgggcacctgtagtcccagctactcgggaggctgagtcaggagaatggtgtgaacccaggagacggagcttgcagtgagctgaggtcgcaccactgcactccagcctgggtgatagagcgagactctgtctcaaaaaaaaaaaaaaaaaaaaaaaacaaaaattagccgggtgtggtggcaggcaacttaatcccagctacttgggaggcagaggcaggagaatcgtttgaacctgggaggcggaggttgaagagaatagaagctctgctggtccagagaaggattgggccagggctctgggagaccagggagaaagagggcacatgtggtccctgttgactgtgagggtgggaatctgaggaaggctttggctcattgccccttgggtttgtccacagccatccttcccctgcggagtatgtcgaggtgctccaggagctacagcggctggagagtcgcctccagcccttcttgcagcgctactacgaggttctgggtgctgctgccaccacggactacaataacaatgtgagccctttgatggccctgccctttctcctcagccccagtactcccaaaacagaacaggctgaaatacagataactctttccctccctggaaaaacattgcaacagggccaggtgcagtggctcacgcctgtaatcccagcactttgggaggccaaggtgggcggatcatctgagatcgggagtttgagaccagcctggccaacatggtgcaaccccatctctactgaaaatataaacattagctggatgtagtggtgcacacctgtaatcccagctactcaggaggctgaggcaggagaatcgctagaactcgggaggagggggttgcagtgagccgagattgcactactgcactctagcctgggtgacagagcgagactgtctcaaaaaacaaaacaaaacaaaaaaacacacattgcaacaaaacaatttctctctaaacctgtaagtgattttgtcctcccttacagagaaggtgataatctttgctgtaagcactgtcctcgtatcgtaccccttgtgcccctgaatgaatttagaaaatgtaaagtacaggagatcagtatatgatgacttactgattcatagtagtgttttaataggatgttccttatgtgaataagatataatttatttgcaaagatttggtctacatgtaaacttccaaggatataactgaaagttttggaggacatggtattctcagtaggcattattgcttttattagtgagatggactccagcttgatattttctgcctttttgtgtttggctggttgtgcgcagcacgagggccgggaggaggatcagcggttgatcaacttggtaggggagagcctgcgactgctgggcaacacctttgttgcactgtctgacctgcgctgcaatctggcctgcacgcccccacgacacctgcatgtggtccggcctatgtctcactacaccacccccatggtgctccagcaggcagccattcccatacaggtgggttagggggagtctggcctgagggagagtgaggggtgttgatagagtgacccagggtagctactgggcctgaaggaggttaggaaaggaggagactggaaacatggtgatgaaggctggagatactttagaggtttatcatgaggttttcttggttaggctcttgtatttttctcacatctgcctgtccatctgtctttttcagatcaatgtgggaaccactgtgaccatgacaggaaatgggactcggccccccccaactcccaatgcagaggcacctccccctggtcctgggcaggcctcatccgtggctccgtcttctaccaatgtcgagtcctcagctgagggggctcccccgccaggtccagctcccccgccagccaccagccacccgagggtcatccggatttcccaccagagtgtggaacccgtggtcatgatgcacatgaacattcaaggtgagaatagttgctggcgagaagagcaggatcagcatgatgagggaggttcatgctgaggtgtgagggaacagggtggggaagggagaggcacatgctggtggtggtagcctggggaccagagcagaagcttaagtagacagatgtggggggtgtgggggttggtttgtctttggaggtgtgtttgtgtggtgaagggagtacctctccctgtttagatggagggaaaggcaggctttctgattgggggattatgggcctgaagtatgcctgatctcagaaggatatagttaggccttggccctacctacctcagggccactgtctctgtctccctgcccagattctggcacacagcctggtggtgttccgagtgctcccactggccccctgggaccccctggtcatggccaaaccctgggtaagagtgagggcatcagggcaggctgagctctgggtagagaaagggaagggctgagtgggtgggttgaaggggtccaggttcaaggttacatcagacccgccccccaggctccaccctcatccagctgccctccctgccccctgagttcatgcacgccgtcgcccaccagatcactcatcaggccatggtggcagctgttgcctccgcggccgcaggtaatgacctggaaggggaggcttgggaggtagggcacagtccatggtggcagctggctggcaagggcctggccctcagccctcttcggtctgtctcttctgccacccacaggacagcaggtgccaggcttcccaacagctccaacccgggtggtgattgcccggcccactcctccacaggctcggccttcccatcctggagggcccccagtctctgggacactggtgagcaagggtcggggagttctagtgcgtaacagtctagggagagactcctgtggtggtgcatggaagggcaggtctgaagttctcccttgctctctatccagcagggcgccggtctgggtaccaatgcctcgttggcccagatggtgagcggccttgtggggcagcttcttatgcagccagtccttgtgggtgagttttcattcttccccactcagagtttaaactcctttcctagtctgctcactggcactttccagttctttccatattttcttggttcctgctttcctggaatggggctgctgtagtgtcttgtgtcttcaggtttcagcttttttttttttttttttttttttttttgagatggagtctcactctgttgctaggctggagtgcagtgtacaatcttggctcactgcaacctctgcctcccgggttcaagtgattctcctgcctcagcctcctgagtagctgggactacaggtgcacgccaccacgcccagctaattttttatgtttttagtagagaagggggtttcaccatgttggccaggatggtctcgaactcttgaccttgtgatccacccaccttggcctcccaaagtgctgggattacaggcttgagccatcgtgcccggccagcttttttcttttttttttaagttacagagtcttgctctgtcacccagactggagtgcagtggtgcaatccagtgagttaaagctcactgtaaccttgaactcctgggctcaaacagttctcccacctcagcctcctgagtagctagcagtactagctcctggctagtaattgtctttttttttttctggtagagatggggtcttgctatgtggcctagactcctgggctcaagcagttctcatgccttggcctcccaaagttgctaggattacagccaagagccaccatgctcagcccagctttctttttttggtttcttacagctcaggggaccccaggtatggctccaccgccagcccctgccactgcttctgccagtgctggcaccaccaacacagctaccacagctggccccgctcctggggggcctgcccagcctccacccacccctcaaccctccatggctgatcttcagttctctcagcttctggggaacctgctagggcctgcagggccaggggctggagggcctggtgtggcttctcccaccatcactgtggcgatgcctggtgtccctgcctttctccaaggcatgactgacttcttgcaggtgagtggctggcttgccattcacctcatcttcctgtcccccggcccagccaggcagtggtaccttcttgccattatataaccactgggtaagagcccctagtgacatgttaggggaaggggccctgggaattcattgactctgaacctttcattttaaagatgaagaaaatgaggtttagaaaaagaaagtatagtaattagtgtcactgctttctgacagcctgttcagaggaagaggtaggtaagttgtgctgcctgactctgttaaatacctaccatacttctgctttaagcagtgaagatcagaatgtaactccccatcttcccagacccgttggtttgtgccctcttgatgccgtattatttccgtgtgtcttcattctcacctcactttctgttctttgttctttatttgccaggcaacacagacagcccctccaccacccccacctcctccacccccaccacctgccccagagcagcagaccatgcccccaccaggctccccttctggtggcgcagggagtcctggaggcctgggtcttgagagcctgtcaccggagttttttacctcagtggtgcagggtgtgctcagctccctgctgggctccctgggggctcgggctggcagcagtgaaagtattgctgccttcatacaacgcctcagtggatccagcaacatctttgagcctggagctgatggggcccttggtgagcaaaaaggatgctttggcttgctccaggaaggggcagccagaggaatgtagatggccttggtttaggggtgttgccaaggtgggatgaggttgatgatctggttgtgggtgggcaggccaggtggtaaaggccattgctaacatctgcccttgtcccccaggattctttggggccttgctttctcttctgtgccagaacttctctatggtggacgtagtgatgcttctccatgggcatttccagccactacaacggctccagccccagctgcgatccttcttccaccagcactacctgggtggtcaggagcccacacccagtaacatccgggtaaatgaaggccaggggccccagaactctcctcttttgcacattttattccttatttctgactgcttctctgccaggtaaagctccaattgcccccacacaagccctggacttgttggggtcgaggtggaagtcttgggaggactgaggctttgaactaaacctgttctgtttcctccacagatggcaacccacacattgatcacggggctagaagagtatgtgcgggagagttttgtgagtaacccttctctattcctttcctctcctgggtctggtcaaggcagctgcctcctccactcccagtcttatgattcttgattttgggatctttgtgttatcttgtctctcagtccttggtgcaggttcagccaggtgtggacatcatccggacaaacctggaatttctccaagagcagtttaatagcattgctgcgcatgtgctgcattgcacaggtcaggggctggccaggcgggggcaagtggggcctgttgcatgtgcagggctgccacgtgccagcattccctccttgtattttgcccacagatagtggatttggggcccggttgctggagttgtgtaaccaaggcctgtttgaatgcctggccctaaacctgcactgcttggggggacagcagatggagcttgctgctgttatcaatggccgaattgtaagcaccacctagccccagatccttagccttttgtttcctgaggtttccattctctgcagttttcatttttcttttctaaactgacattctgtaacctggatctaatctatttctaaaggtggttgagggttttgtgttctaaatctgctttctgtccctcagcgtcgtatgtctcgtggggtgaatccctccttggtgagctggctgaccactatgatgggactgaggcttcaggtggtactggagcacatgcctgtaggccctgatgccattctcagatacgttcgcagggttggtgatcccccccaggtaagggacctgttgggcgatggggtcagggtacttgagagaactggagagatctgagaggaagtatggtgttctttaatttcacagccacttcctgaggagccaatggaagttcagggagcagaaagagcttcccctgagcctcaggtactctagagagggggaggttgaggggccagataatgtggagtggagggctgggggagaaaggtttggaggctaaaaattctgaagcctggctcttcccgccatctgacacccagcgggagaatgcttccccagcccctggaacaacagcagaagaggccatgtcccgaggtccacctcctgctcctgaggggggctcccgggatgaacaggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctatccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgttttcccctttggcatctgggaaggcttgacagtgccaccccgggctatttgacagtgtgcttggggggggaaatgttagcttctgagggatggccttgtgtgcttgctgggatcatagggacttggccagcgtttctccaacctgcttactttttctctttagctccggtctgatatacaaaaacgactgcaggaagaccccaactacagtccccagcgcttccccaatgcccagcgggcctttgctgatgatccttagctctttgctctatggcccttcctcatcaggggaccgtttcccccctcttccttcacagtatttaagaaataaaagtcggatttttctggctgctttctctctacattgtctccattaggtagtgtgtcccttaatcttgtgtgaacttttttaaattaatacttccttggaacactgttgtgttctactcagcacgctaaattgtacaagccagttttgatgtttgtttttttttttttttgagacagagtattgctgtctcccaggctggagtgcagtggcccgatctcgagctcggctcactacaacctccacctcccgggttcaagtgattctcactcatgcctcagcctcctgagtagctgggactacaggcgtccgccaccacgcccggctaatttttgtatttttagtagagacagggtttcaccatattggccaggctggtctcgaactcctgaccttgtgatccacccgccttggcctcccaaagtgctggaattacaggcgtgggctaccgcgcccagcctggtgtttgtattttttgtgcgaaagcactttatatataaataaaaaacctgtattttgagttgggagcatattccaggtgcacactagcatagagctctcaaattacccatcaaaaaaagtttctgagcagctgcagacctaagtatagtctttagcataactagcatgcagcgttaccatgtgaaatcccacttagtttgacaatgctggaattggtctatccaattcaaagagccccttaagtgtgctccaacattgaggccttaacagagatttccccttagttcatcataaagaactgaagtcccatggctgcaaattctttgctagtccctttgagatgcagttgaagtcccttctaaacccccccatcccctaccttggctagtttagtgctctatcaactaagcatggcataagcttagaaaattccagctagacctcttggaacatgagctcacggacatttaacaggcctgctggagagtccatgtgaagacactggttgataacccagtaatgttacagatgtcccaccaaggccctagatatgcaaaggaagccatattgggaccagcccaggtgtcagctgcagactgataaccagttgacctcgctcactggcacaaaaaagcagatttatccagctgagctcagcccaaattccagactcacaaaaatttaaagatccaatacgatggtcatgtttttagtttcaacagctcactggaataagtaatgaatatttccctgactgaaactacagatcactcagcaccatgctttaagacaatgcaaacaactcatcccccaaatcattgtagaagtttttttttttaaatccttttattactcttttttaacaaacagccccagggacaggggaccaggggaagggggaggaggggaagtgaggccccagccccacaacccctccccgcccacccctttcccccttatatatttataatctatatacaagccccgggggtagggggcaagaggaactccctcagcggggtgggggcaacccaggctccttgtcccctcgggacccaggctcctctgcccgtcgggagggcccttctcgaggtggcggccctgtccgctcccaaggcttaggtatccagcgcagggcatctggtggggaggcctaggggacaggcatgtgttaaagagtgagtcacagtgagaggtcagcgatgagacggaaggacaggaaatcaggtggcaactcgaatttagagttggggccacaagggtttctccttcacctgctggtaaaggtcgacgcgctgggtgcggaagactccactgtaggtggaaggcgtggccttgagacgggaattgaggccagagaaggacctaagggaagaagggcgtctaaggcaagcctaggatccagaccctggttccaaagtaaggaagcacttggaaagtccacatccctattccgtttcaccttccagttgggggagtccgtgatgatccaggtcccccaaggttgctgctcagtttttgataatcctggaacggctttagttccactggatgcagct

SEQ ID NO: 659 - DNA, 267482 bp, Human
  misc_feature (1)...(267482): n = A,T,C or G
cacacgtgggcaggataaaatgtaactctagaatttgtactaaaggtgggtggaaattccactcttagatccaggcaccctcaggcgtcagccctgagccctgtgctttgcaaacttctcaagctattattatgtaaaaatagatatcttgggatattattcaaatgcactctgtgattccttagagctggggttggggcctgagaagttgcatttccataagttcccaaatgatgctgatgttgctgcaggtccatggaccacgctttaagaacaactgacttagtaattcccattctgtctcttttagacaggcccttcccccacaggctgcagttcatgtgacttagggaacctgccaactcagaacctgtgtccttttttcctaagccgcactttggttatccaagaccccagaattacctgtccagacagcctcccaaaactgtgcatacctgtccccagtctgtccttgcaatagaagactccaccagtgtgtacacacctgtatctaagtgtggccagaaaatcagctatttgaaaaaggttaaattgtgtgggtaggggttggggggtggggggacacacagatgggcctcatgcaaaacctcccctattacagggtggagattggggtagaaacagaaatgtactatgattagaggaccttcatcgtcttcttgctccagcaggctagtgttgtggtggtcttacccttatacctacttatatataaaggacagggagaaatcccatcctattatggctcatccctgattttaaggatctgggaccacagatgattcttggatggttctatttcatgaggaaggattgcatgtacagtgctcttcttagggtgaatgaaaaatgttttcccccttccatataaccctctacacattttcccagatgaccataaatgtaggggatagtgtatgcactttggatttcagctgaaatacgactaacttcctctgtgaatttgagcaagtcagttgacctctttgccctcagtttctttatctttaaaatgggagtaagaatgtctccctgttctcttccatctccttcttatttctacccaatttaattcaatacttttttcagttttttgttcagatgctaccatctttgattagatcaagtgcctgtatctcatctggaagtaacttctcactgcacttgcaaccctttgttctttttttttgtggttttgtgttgattaatgtctttctagctcattggactctgagagagcagggatcatgtctccttagttctctgttatattcattctgtcttgcacaaaacctggcacctgatagatgctaaatccccatttgctaatgcataaataaatgtgtgattattgtcataattagagaaaacatactaaatgactggcacatagtaggtgcttagtaaatgacaccaattgtttttcagtgcaatttgtgctataaataaacatttaattttcttttctcacatttgatatatggggagaatggggtgaatttgagacaactacaatttaaactgtccaagtcaccaacaaattgtggtgtgataagctactggcctaaacagctggaagcatgacacgctttttaaagactaaagaaatgaaatatccagtttaaatcaaaggataataaatgcaagaaaaagttgtgtttgtcagatttccttgccccggccccaacccaaactccaaagagtgcatctactttaaaagcgtgtggtgaaagtaattccctacccaagtgttcccactactgtcactggcctcacccttctccacaactcagggattattttaaaggtttctttaatatcggccagtccaaatattctcttgtcaaatatttctgtggcccgtacttgaaatctgtgaacaggacactttttttttttttaatgtcaaaataaaccatctgcttgtacaactgtttctaattacttccctgcctagactctccactgaggggtttggcaccagcaccccgcccagagcagtgccgctgcccaaatcctcgcaggcagctcatcaacgcaattgcaactccggctggagccccggacctgcaagcctgggtgtccgtgggtccgtctgcccagccatctgctggtggcacctctccctcctgccgcctccctcggtgaaccccaccttgcagaagtgcagctcgcccggagcagcccaggagctcagcatgcgtcccccaggcttcaggaacttcttgctgctggcgtcctcccttctctttgctgggttgtcagctgttcctcaaagcttctcgccatctctgaggtaagtttggtttgttattcttcagtacagacctgccctgcttatgtggcagggctcaagcttgcaggatggctgccctaagccaagagctgttattaaattggacaagggataaactgttttcaacctgttccttttcctctccttatatctacagcgtgtattgcctcatgtctgtccttttgcttttcctttggaaaaatgcaatcattgaataaaaatataattttcttttctgcaaatacatatcaggaggaattcctgctgtgagttaaaatgctatgtgtaccagtatcttctcacaacatgtaaagcagaatgatctgtttcccaagggcagcaacaggaggtctgtgttacattttgtatcatcctgaaagagactgagtgaggcacactgcaatagtgaaactaaactttttaaaagtagagttcctaaagactgcttaatgcaaattatgcccgatgctatcatagcatgtctaactctttctatagattcacgttttctcttctgtaatataagtgcccattggccatcagatagcagtgggacgttttttaaaggagaactgaaaagtcagctgagtgccgtaccttggattactttgtatttaatctaaatgtgcatataagatttagtgataaactaccaaagagcagggcagttcacctctgtccacctggaggaaggacctgtgtccgggggcaggtcacccattacacattttgggccctggtcatttctctggtgggtgatacctgtttgcttgggaaaatacagcccttccaggcagcgcttggaccccagagagatgtgggcctcaggcgtcctgttcttggggttgtacgtctgcacctggaggggacactggggaggaaacgtgggttcggagcagggggcggcgtccgcgtctgacccggcctgccggttgcttgtcgcccgcgcaggagctggccgggcgccgcctgcaggctgtcccgggccgagtcggagcgacgctgccgcgcacctgggcagcccccgggggccgcgctgtgccacggccggggccgctgcgactgcggcgtctgcatctgccacgtgactgagccgggcatgttcttcgggcccctgtgtgagtgccatgagtgggtgtgcgagacctacgacgggagcacctgtgcaggtaagagggcggcgctgtctcctccctcgggaggtcgaaactcctcttctgggatttctgccactccctagaagagtgaagggtggggacacgcctcccttcacataagcaccaattaagttactgcgattgtcacactttggctagttaattctggcatcatttatcacaacacttttatcccccaggctctgaacttgaatggaagtaaagttttaaaaattcattcacttaattatatattttattgtaattatgattttttaaagttgggatcttgctatgttgccctggctggtccccccccccccccccaactcctggaatcaagctatcctccctcctgagcttcccaaagtgttgggattacaggcgtgagccactgcacctggccgtcatttgcttaattctaaaatctcacttgcctctaaagttcctcattatagactaaattccccaatgtcctcacaaatggagttattttactgggttctcctatccctatcaagaatgttaatgataatatttgtagatcttaggcctgtattttattttacataggaaacagtgggagggggaatgtattattttcctccattctagggaggcaggttttgtctttgaagcctgatttgccctctcattattagaatatagttcacaggcaggagtgcatatcagaaaactgtaacaaggaaaaaagtaaacgggcacatatttacttagaatgactgttcttgcattgttctagctgcttgaatttttgagttgcaatgaaacttggtattttctgagggtggagtgaaaatacattcatttcccttgcacatttttaaggagtgattcaggttctgatattggaaagggtcaaaaaattccttcccagagaacacccttaacctctttacctgtgtcgttttacttaaggccaagagcctcaattagtgccttgtgagtgacacagaactccattagtgaaagcacaacacaatgcattccagccagggtttggcaaatttgtaggaaaaaccagccacttattttaccctcaatgtagctaagaataataagacagccaacactaacatagaaagatcaagaatgagtttatagcaaaatatttttttctcagagcctgggcccagtagtgtataagttacttaatatgcaggctgcttggcaatgcaaaaaatagtcatagaagaaatttggaggggcgcaggtgcatctacttgatttgttttccctgtgaaggctgtggatcaactctttaaaaatactgaatgctgggtggggtggctcacacctgtaatcccagcactttgggaggccgaggcaggtgaatcacttgaggtcaggagttcaagaccagcctcgccaacttgctgaaacccagtctctactaaaaatacaaaaattagctgggcgtcgtggcatgtgcctgtaatcccagctacttgggaggccgaggcagaattgcttgaacctgggaggcagaggttgcagagagccaagatcatgccactgcactccagcctgggcgacagagcgagacttcatctcaataaataaattaataaataaaattaaaatattggatgccacaacttgttatttaacttcgcagtcctacaaaccgcagtataattaagggtagccctttggaatgaaagctaagttaccgcctaatatttcattccaaatttgactgttacttggcttctctgacctatggcctctggcaagccctcttcaatatcatgaattttgaacaaattttccagggctttttctcttgttttattagagaagtaagaggtaagatgcagcctttaactggtgaaagttgtgagtgtcgtcagattcactttccctgttgaagaacctaggctggtgcttttctccgagaaactatgcagaaggaatgctgtggtagacagcattcttttttccctcccatagaaaatgatatgttgtttactcatagcatcttagtcactgcattccttccttcttgatacgaaatgcaggactgagtcaagcatggttttgtttggttatgcatgcatttctgtagaagatgaaatgcttctctttattttaatactgaatggaataatgaagttcattttttattctcatcttgctgactgatgcccatcaaaacttactctacagggccttgagcagaatctgtccccgcaaatgccctgaccacgtttgtggggcccatgcggagatccctacaagtagcacctagggctgccttgcgagcccgtcgatgtattccatgcttcaaatttagcttctcagttttatttttaagagatagttccagttgtatcactggaatatggaaatatagcaggtttcctatgtttatgtgcccctgtgctttcacctccatgaaagttcctgtaggtcctttccagaaatagagtaactttcggagacctctccaacttctaagaagaaaacaaaatccttctcttatagtactatatcatggagtgattaaaagtgtgggctctgggctgggtgtggtggttcatgcctataatcctagcactttggaagcctgaagcaggtggattacctgaggtcaggattcaagactagcctggagaacatggtgaaacaccatccctactaaaaaacacaaaaattagctgggcttggtggcatgtgcctgtaatcccagctacttggaaggctgaggcaggagaatcgcttgaacccggcaggcagaggttgcagtgagctgagatgatgccgttgcactctagcctaggaaacaagaatgagacgctgtctcaaaaaaaaagtgtggactctgggagacaatttccaggattcaaatcctagtcctattacttaatagctgtatgaacttgggcagttacttaaacattctgagccttgatttcttcatctgtaaaatgggaataacagtacctaacttatagagctgttgtaaggtttaacatatgtaaaatacttagactagtgtctgacatgaagtaagtgctcagtacatattaaaatgtatatatacataatattattacaatgatgcataacaagtgggctagtatggatggaaggatgggtggatggagatgacagatgggtagatagatagctggcccagtgtttgttgggcatttaatgcagtgagagcaatttacttctcttcatgtagtctgggtctgttactgattcaaggcccaaaaagtcaagtagggataactattttggcccagcctcagggcagctgtattagatacactatgcccttttaaagttaagtccattgggattattatactgtgaatcataagaaccatacttattatagtttgcgctggttgaaagtgattaggttccctccattagaagtctgtttcttccagtgtccacttgttcgtggcacgtgcatcttccacagacttttatagcataaagatccagccaagtgagtgttcctatggatgtgatggtctattaaggggtaaaataattttggtagaatggtgaaaccctgtctctactaaatatacaaaaattagctgggtgtgatggtgtgcgccttgtagtcccagctactcgggaggctgaggcaggagaattgcttgaacccaggaggcagaggttgcagtgagccaagattgcgccattgcactccagcctgagtgacagaacgacactccatcacaaaaaaggaaagaaaaaaagaaagaatggcaaaatgtttgattgcatggaaagaaactttcagttgatatttctaaagcattcctggttgaccccatgaccagctacaatgacacttaaataatgtattgttttcttagaaatcttttgaaattgctgttgaaatatgtcacttaaagagtttcagttttagtaatttaggaagagctaattgaattcaatttagcaacacttatgaagcactgcatattttctaggctctgtcctgttgaagggagtgtaaagatgagggatagaaggcagcttaccattgagtagggagacacagagaaataccagatatctataatgtaatgcaaaatatcatctgtacaaatttttatgagggctccattgagccaggggttatatattatggctaaaagttcttgagaaagaggtagcatttgacataagcacttgagtactgggagattttttaatccaaaaagtggactgttggaattctgagtaaggaaaatcttaagcaaaagtgtagaagcagaaaaacatgtggatgtttgggaaatagggctacaagggttggcttggctggatcttagagctgtaaggaaagtaataaaagatatgttgagaattacagttgatcatattgtagagagtttgttcttgattaaacagcatataagagctattaagagtccaaatataggagtgatcattagtgctctgatttatggaaagaaatacagtcattccttgatatctgctgggaattagttctagggagcctcccccaccagtggataccaaggatgttccagtctctcatataaaatggtgtagtatttgcatgtaacctatacacatcctctagtaaactttaaatcatctcttgattacatataatacctcatgcaatgtaaatgctatgtaaatagttgttatactgtatgttagttgtattattttgtactacacttttttattttctgaatagttttaatctgccaatgaggagcccacagatatggaggcccgaccgtatggtgcccaaaagcatggcaagttaaagtagagaaccaatggggaggaactccacgggagaggcaataagaacagaattattatttttttaaaggccatttaaaagtaaaatcaatatgaattagtgtccaaggatgagtaagatgaattaaaactcatgctgggtttttaagtctgcgagatcagaagtgtgatggaactgatggagtcaagaaatcacaggaaagaaccagataaccaaatccatgacttaaagttcttttaaaagaactctcatttttaagtggaattgatataaaatgaaaaattaatgctagcagaaagagattctgatttcattggccaccacgtttggggcaggatgggaatcttgtctgaattgttaacgtgggttaacttgtttatgttgttaaccttgagccaggtttttaatttacctgatatttagtgcctttttctgtaacagtatccttatggatatgaagaaccttctattctgtgtgacattgagcatgattttatgtatgtatgtataaatttatttaatattcatatcctttatatacttctacatttattcagactatacgccatccttagctgggtgtggtggctcacacctgtaatcccagcactttgggaggctgaggtagctgggatggcttgatctcaggagtctgagaccagcctggggaacatggtgaaactctgtctctacaaaagatacaaaaattagctgggcatggtgcacacctgtagtcccagctactagggaggctgagaggggaggatggcttgagcccaggaggcataggttgcagtgagccatgatcatgccaccgcactgcagcctgagcaacagagggaggccctgtttcaaataaataagaaataaatataaaaaataaatataagccattcttataaacattgatttatgtgttcaaatattaacaatataacaattaaaataattagaatacattgaaacatttttaatatgtaaaaattagtaattttttttcttgaagatatttgacttttatactacgaagtaagtagtatgggaattatatgtggttattcatgagaactggacttcctggctcttgaggctgcctgaggactgttcgacttgcctttcccttccaattgcatttttcttagattgttgaacgatctccctccaagcctacttgtggatttactcaggctttttctttactagtctttttctatttttcatcttctctcccttccttcaatcctcatcctgtcttccttgcccactccttcacctccgtctagcccatcttggatttaccgccccctctctttcgcaaaatagcccttccatgtctctgagtcggaggcaccaagcacgtaagaatattatctgccttgaatccccttcaccagtaaataaatgtctgtaacagacagactggctttcacattgcctctttcctgtattttcttcatagtcttcacatcgcttgtagtttttggaaacacattcaggagttccccactagctcacccactgcatgtaagccatttttcgggagctctactttcttacattcatctgtgttcgataaatgcatattgtcttagcccaagtgacgtataaaagttaaatgttttctttctgaaagcaagtgccaaacatgcacagcaattttcctcaattgtactgctttatttggacagggctctgcagctctaccatggtttcttagtctgttttgtgttgctgtaaaagaatacctgagactgggtaggttgtaaaggaaagaggtttatttggcttacagttttgcaggctgtacaagcaaggcaccagcatgtgctaggcttctggtgaggcctcaggaagcctttacttatggaaagtgaggagggactggcatgtcacatggcaagagaaggagcaagagatagagggaggggtaccacattcttttaagcaaccagctgtcctgtgaacaaatagagaactcactcatgaccttggggagggcaccaagccattcatgagggatccacccccataacccaaacacttcccacttgattccacctacaagattggggatcacatttcaacatgagatttggaggggacacacatccaaactatatcacacagagacagacataccttgccctggactaggtcatccctgcaccttgatgatctagaggaacatatttatagcattgtggtatttagataaaatagtataaatgtgagaaattcaggagttattttctatgtaaagtttccccagaatgagaaaggaaaggaacatatggaaacaaatttatttgtattacaaattttaaatttgcaaaacataaacctccctcataaggttctcagagtcttcaatatattttgaaacacaatgctaaaactgacatcgcatgttcttgatatcataaacccccacaaaagctgctcagctctctgagcctcatatacatattgttacatctgaccttgtgactcaccatgttcatgttcttgaggtaggtgatcaatgccctaggagggactgggtgtagtggctcacatcgcctgtaatcctagcactttgggaagttgaggtgggaggatccttgaagcccagtggtttgagaccggcctgggcagcatagcgagacctgctccctactaaaaattttttaaaaattgccagacccagtggtgggtgactgtagtgccagctatcaggaggctaatacaggaggctcatttgagcatgggagattgaggctgcagtgagctatgatcaggccactgcactccagcctaggtgagagaattagaccctgtctcaaaaaaataaaataaaaaattccctgggagcagagagccccgttatcattctttgggggaattccctgtctgcaaaattatgaagtaagacgagacattttgccaagcttcatatcctgcccttgtattatttttctattgctgctacaacaaattaccacaaaccttgaggcttaaacagctcagatgtcttttctagagttctgtaggtctcaaggtcccctgacatgggacttccagggccaaggtgttgatagcctctgttcttttctgaagactctaggagagaatccgtttcctggttattggtgttgagataatttagttctgtgtggttgtaagactgtggtccccagttccttgctggctgtcagttggggtccctcttgtcttctagaagctactttcgggtccttacaagtaccccactcccaaatctcaaaactggaaacaggttgtgagacctttctcacaccgctgtctcccagagcctcttccatcatcacatcccttcttaccaccgtcggaaaacatactccacttttaaggtgtattttaactagactgaacccagataatccaggataagcttcccatccaagactcataaacttcatcacatcagcaaagtcacttttgccacgtaaggtgacatatttacaggtttcaggagcaagggtatggctatctttgaaggcccatagtcttctcagcatagtcaccctcctataaagtgcagggcactctgtatgtgtgaatggcaagggagaggttccaactccattcatatctggctgttggtatgctccatcgaggatgcaagggctgagtcttttccttcttttccgaggttatctatatgatctaattgctctggcccatcttttccatatcattattttttttgagttggattctcgctgtgttgccgaggctggagtgcagtggagcaatctcagctcgctgcaacctccacctcccggggtcaagtgatactcctgcctcagcctcctgagtagctgggactgtaggcatgcgcccccacacctggctaatttttgtatgtttagtagagacagggcttcaccatgttggccaggctggtctctaacttctgacctcaggtgatccacctgccttggcctcccaaagtgctgcgattacaagcgtgagccatggcacctggccttttccatatcatttctgataaagaacactaagtgtctttctaaagcatgaagagagggacttaagcccaacagttgcctgcattcagttcctgacattgtcacttgcccactgtggagctacagggaggttacccaagaggttacaacctctgtttccttatggttgaaaagagggcaataataagaccaaatagggataatgacagtgccaaacacatatgagtgattaataaatcactggagttattatgcttaaatatgctagacacccctctcctaccctagcgtaattcctggtcctaagatatttattttcaaataagcaattttctttccatgttatatcttcctccattactaaattcatgtcttggaattactctgatagtctttgaactattatatcccaacaagcttgcctactctatagtgccagggctgggtgtgccctcagccctggccagcatgaggaatctgagagcttactgtatcatgccccaactcactgcactgccagccgtctgagtcttgtatatgtctttgtctcagaacctgccttttgtgttcctgtccctgaaatctgtaccctgatttatatgatcataattgatctaatggaatgctccagaaccctaccctcagaactgtataattagtccttgaatttggaattttcatgctttttctctgctggaaacctttagacgtctgcagactcccagggcttactctataagtgcaattctgcttctgactcttccctccactgagatgcctgtacttctagggtgttccttgatctcctctaaattgttgatcccaaataggttgatcccagaaactgcttcttcagttgcaaaactgcagaaagcaacacaataaaaaaacaaaatcaaaataactcacatatttttaaaaatatgtaataaacattactgaatgttgtggagacattgggttgtgtgttatttaatcataagaatgcaaactactgaagattgaataggagtcattctagttctttttttttttttttttttccgagacagattctcgctgtgtcacccagactggagtgcagtggtgtgatctcagctcactgcaacctccaccccccggattcaaacgaatctcctgcctcagcctcctgagtagcagggactacaggcgcccatcatcacacctggctaatttttgtatttttagtagagactgggttggccaggctggtctgaaactcctgacctcaggcgatccacccgcctcagcctcccaaagtgctgggattacaggcatgagccaccacgcctgacccattcttaaaactcccaatgctttgttatgtacttcagcctctcttctttatcctgtttgatcccctccttctcatcacatttctgtttttttatttcactttcaaataatgttcatttttcacaaggagtttagttattatttctgtcatctcattttttgcccatccatggcctctaaaatcttggcttgtaccccaagtgttgatgtactcagatattaaggacacagacatatatgcatgtgtctgtatgtatatatgtagttttttacattctggtttattatgtatatgtatacatagaagacccagagagggtctctctctctctctctatatatatatatgcatatgtttatatatcctcctatatattatttatgcttgtatagccaatcaaaatacatatattttacccatttatatttggtatatgtatatattttgattgcctgtacaaacataatatatatacacatatttatatatgtatacatacatatttgataccctaattttatacacatacgccatacatatgtgaatatgtaagtatgtgcacaaacatacatatatatgtgtgtttgtatatatgtgtgagtctaaatgttatacacagggacatacatgcgtaagcccttttctggtagaccactacctgcagatcgaagtcaagtccactttcaaatttctgtaatgctgacactcttgatataaaggttgcttgggattgatgccacatgtgtaaacctgctagaaatcaatatctcattggggaatactttttgtgtctttatctgtttaatgaatgccatgaaaacaatgacgtatcatttgggtgattcataatttggattcttttttcactttggagttaactaaatgcttttaggctatttcaagtcacattcgaattacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttatttaaattaccattatggctatggaataaatatttaggtaaaggcatctgaaaagattaataattgaggatagcggtaactgtagagcgtagaggataaagacactcataactttaagagcagaggtagtgatgttactgataaacagttgacaagccaaccaaaatgaagacgtggagtcagaaaggccaagaaaacttggaggggaggggatcctcttagtcatccaactaaactatggccaactttgactcatccttttcatttgctctcatatcctgccaatattgctaatgtttttacttaattttctgctgaatttagttctattgctagtgacttagcttagccttcatttcccttgacaaggaatattagtaatagtaaagttcttatcacacctcatgcttcattcaggctgtcttcccttctgtctatcctgtataccaccacttggtgaatcaccgtaagtgacattttgtcaagtatctgtgcttttcaaattcacttcaaagatcattctaaccatttatactggccacttattctgtacccctgctttgattcacttcatgaacacacattgagggtatatactataggtatcaaatctaaattttggcttctaatctacttggccattaagacattctagaatctgattcctctttaatggcatgctgacccgcttcctctttctcaccttgtatgctcccatctctctagttagatcttaacatcactgtcacttaatacagtctacaccaaacacatttttcatgatttcacgtgttttcttatgtttacaaatatgctgaatattctgaatactagcaccatctcacatatttttctggaaactaaaaacaaaaatatttagcacaaaaaataggtatttagcacagttctgagtaaacagtacagatcgatctttcctggagctctgctttgtatggttttgaattactgtctagtgtccttttatgtcaacccgaaggaaggactcctttagaatttgttgcagggtagatggtttagtccattcaggctgctgtaacaagataccctagactgagtaatttagaaacaggacaaatttaatgctcacagttctggaggctgggaagtctagaatcaaggtgccaacagattcagtgtatggtgagggctcattttcagcttcctggatggcaactgtatcctcacatgttggaaggggtaaacaggctcccccaagcctcttttataagggcactaatcccactaatgagcctggagtgctcatgacctaatcacctcctgcaggcccacccaccttcttaatactgtcacgttggggattaggttccaaaatatgggtcaatatttatatcatagcagccggtctactagctgaccttggcaaagggaaacctcacatcagtgggacggggatattgaagcctttgtcctttgggaaatttagcttccaaacctggtctgagatttaaaggcaagagtcacatctaagaaggtggaaaagtctggtacagctagactgagagtatcaggggaatttaccagggcgtttttgggactctacgtgggtaaattctcaagctattttctaataacttctaaattgataaagatagagagctgcatgggggttgcaaatctcattttctttggaaaaggagtgctttgtctttccaagaatcacatttcctggcaaataagaaactatattttgtaatagaagtcattctcctgtctactctaaatcatcttacttaaggctgggtagaagaatgagggctttataaagagaaaagaaaaataagacttttataagggtgcttactgatttgactttgtacaaccccactcttaggttatacgataaaatcagtccctgtaccaagagccctatcgttgtaattgtttgtacatagtcactagttcaaacaccgaattatttaaagtgaatacctacccactctagtttcctgttctgttattttatctggaaacttcctagggaaaggtaggctaaatttttttttttaaaagaggtcaatgagtttgggcattgcttaaaaacttctcttacggcaaggtattaactgtaaattcatgacttagtcaatggggtagagtaaggagccaaaatcagaaaatgaaaacgtggtaaatgcatttcctaattgttcattactgctttttcaaagctatcattttctgctgagcaaaatagttagacaaaactagttatttttataaacaaagtgacttggccatttaagcagtttcctctccaaaatacaaaagacaagttatagactattttcttttctttcctgggcaacaccattagttatatgagctctaagagctgtcttgacatggaaataattcacttgcttcaagaaagaaagtatttgatttgttaactatgtgctcgagagacttctctcagttgcctgtttggataattttaagccttgaaattaatgctacattagaaatacaaatgagtaagagtagtatctacctatatttgagtatagtatgctggaaaatattttcatacatatgaattcattcactttttataataacttttaagagatagtcaaaacaattatcctccaactattgtgctaagtaagcctgaggagaaattcctcccaccccaaatcaatagaagggttttcttcagcattatagtaaaattatcctaaaagcacatatgtagggataatttcttcatgaattttggagtactgaaagaaaaacataattttcagaaactttatttacatttaaaaatataacttctttttggaaaagtagattttgattcttatttttgtcttagagagtgcatgtaaaagctcaaatggtaagaaagtactgggcaaaagaacccgttatgcatctcatgttaaagaaagtgagatagccgaaatcactgggacaaaattacttgtcgtactgataatgagcattttctcagctgtagttgaagtttttagagagattgcatttaacatcaaccatatccaaataagaaggatcctcctgagtcagcctttgaaggaactcctccataacctaatttttcttgtctataaaagtgaaagaaaaggtaggtaggagagttgaatctacatatttgttatttccttgggcattaccttacattattttgtgtattacatattttggctattacgaataagtcacatcagagattctcttttgttcttataacattacatttcataaagtgagctccaaaaatttaaacacatgcaggttttaatatacgtatagcctttttgagatcaaagctatgcgagccaacaatactgcaaagagagagaagaaaggcatttacagaaagctgaacagttttgaatggatcatcatgtaggttcactttgcatcttggaaatgaatgggtggaccgtgggtcataatatgaaggcttatggggacatcctgcctacctgggattctggatattgtggtctttcaatatttcaaatatccctgttaatacaccagttgttgccaggcgctgtggctcatgcctgtagtcccagcacttagggaggccgaggcaggtggatcacctgaggtcacgagttcgagaccagcctggccaacatgggtgaaaccctgtctctactaaaaatacaaaaattagctgggcatggtggtgggtgcctgtaatcccagctacttgggaggctgagacaggataattgcttgaaaccgggaggtggaggttgcagtgagctgagatcacaccattgtactccagcctgggtgacaagagtgaaactccatctttccatctataaaaaaacaaaaacaaaaaacaccacaaaaacagatgttgtattttaagacctatgagtggcaatgcgctgatcttttattaaaagatagtacagtctttactgaatttaacaatcttttccttgggaaaactaagcaggcaggtttgggtaggatgaaaatgcagaggcagaatgctctggaaaatgcttgggaattggaattaaaaaacaaagctgtttgatctttctccgctattgttgctgcctgtgtgatcttgcacaaatcacgtaacttctctgagcctcagttcagttaaattcaaaaggcacttattaaacatctccagaaggatgtctagagaagaacagggaaatcttatgatcagacctagcctcattagctgtgagatttcagccatcagatggcaacaggagctggatctccagttactgtagatttgataagagggtggaaagaatttgttttcttacagttgactgcaaaacgaaatattctgttaccttagctaaccttggaagctctgctttccttgaggatttaagaactttcatatccataaataattatttaatgcatgtccagtgcttgaaagatagtataatataggcattactattttattccttttttaattaatttattttttttttttgagatggagtctcgctctgtcacccaggctggagtgcagtggcgcgatctcggctcactgcaaactccacctcctgggttccagtgattctcctgcctatgcattactattttataaagtagacgtggtgtttgtctttaattccccaactatatgcacacagtctgttaaagcacaatgaaataatgatatttgtgtgcatctcaacatttaccctctgggtgtatagttatcaaaaaccataatagtctctgctgccctttatatgaaagtcaactaggcaacctagcaagagagccatgactttgaagaacaactaatgaatgaggtgtgtgtgggaggggtggaggggtggcgtttagaagagaatggcaatagtctggaaaaaaattccttttctagtaggacaacattctatggggtgcccttaaaaatctatttaattataatcatcctatatgcttattcttaatttgaaataaggtaatgataatacagctaacatttatttagaattgctacatccttcttgtgtggtgttaaattctcccaataaacaaatagcaggataaatcatcttaccattctaaagataaaagcatgagcctcaaaaagattaaataaaatgtttaagatcacatgttgtctgaaataaaaactgtgcaatcagtcactttgttattaagttacaccatttagtacagtgacactggctaacaaatgccccaagaagtattaaatctcttttctgaattttgaattatcacatgcattattaatctaccataattaaatgtcattttcatatgtgaaagtgtgagagggagaatgctgaggagattgaaggagaaagactatatgggttccaaaactggctcgattttgggaagttagttgatttgcttgtgcctctgtttcctcttatcatagtgttattattgagaaaactcccttgcaggtaataaatcctcaacagcaacttctttttgttatcagtattatcaggccattcccatgtcactatgattaaattatatactcctcaagggcaggaatagtatctgattttctgtaagattttctcttaggtctttgttgttattgcttcaagaatgcttcattacagaccaccacaacatttagtggcttacagaaaggcaacacaaatatatatgtgtgtgtgtgtgtgtgtatgtatgtgtgtgtgtgtgtgtgtgtgtatatatatttctcactcttgggtgtgcaaatgagctacaactcagctaggcaagcctggacttcaggctgaaggctggctgcattctgctgcacgttatttttatgctacccaagctacgttttcggtattgtggatcacaggagcactagaaagtgagacgaaatacttgagatctcttaaatctttgactctgaaccaataacatgcactttatatccaaacatcactgggcaaaaggagccacaggcccaagccagatatctctgctctgcatggtgggagtgagtgaggagctcacagcagtaataccatcagtaggatttagaagggatattcaaatattcagtgaaattaatttattgacatgatcataaacatctgacatttaaatttaatttggaaataaatacattttatttttattttaagtataaccatattaatcaattacatagtaaattatattgacatcataagacattaggtctatgtttagggaattcatttttatgagattgatatgaactctcttatgtattaacttctggatgtatttttacttgtttaaaaattttcatgtcccttcacaaaaatccttaatttcctaaatatagacttaatgtcttatgagttaaagaacactgcactgaaatatatccaatatgccactttatggcaccttccaaatgctcttagtgtaaatgtatgttacaaatcccataaagcacagcaaagataacaaccaaactgttggtacaaatcatgagacagattcagtagttgtctgtttttatatgcacattcagtaagctgcttacctatgttttgttacattactttaattttcgtgcgttttctaccttaaaataatattttatgtaggataatatgcttagatctttgaataagctacttttagaatttcttgagaacttcaagagtattggaagcagtcaacatattattattcagatttctgttttgggggtttttaaaccatataactcaacttacttgagaagaaaggaaaacgtaaatggttttaaatggtgttagctctcacacaggcattgggtggccagtcaactgttttaaattaactgacaatgctattgtgaagtccattaacttaatgcagagggttgtttcattttttttaatgaggaactttaattcctttaggaactaatatttccataaagtttcatcaattttgaaatttaatatacattttgatttgatgtccatatttgtataaatatatttgacaaacatatttatccatatcaaatgaacacaatctttaagaattaaaactctaaaaatggactgctttctcatatatagagtcaaggatttatatattgatatataaattaagagttgtatatatttatgttgtgtgtataattatgttgttcaatcaacagttatttattaaggaactactatttataagatgctatatttgtagctgcagaggttataaagattaaaatgtgattcttgagagggaagtggaacaagatagccaactagaaccctccaatgatcatccaccccacagaaacaccaaactgaacaattatccatgcaggaaagcacctttatgagaaccaaaaaccagatgagtgatcacagtacccggtttcaataccatatcaaagaaaggaggcaatgaagaggtaggaaagacagtcttgaatcaccacaccatgcctaccccatccgccggcagcagccatgtagtgtggagagatcatctctgtgctgttgagggagagggaacagtgattgtggaactttggattggaactcagttttgccctgtacagtggaagacaacaaggggcaggattcagctgatgcctacagacagatcattttgatcagccctagccagagcggaatcatccattctagcagttggagcctgagttctggctagcaccaccactgtggactaaagtagtctggtgttttaaataaacttgaaagacaatctagaccataagaactaagatttctgggcaagtcctgctctgtgctgggcttggagccagtggatgtgggatgcatgtgacctggtgagacaccagccagggcagccaagggagtgtgtgcatcacccctcctttgaccctaggcagtgcagctcatagctccaggaggagagggtaaagaggaatttgtcttacaacttgcataccagctcagccacaataaaatagtgtaccagagcccccattcgaggcactagctccttgtgccagaaggaaacccactaccttgaagagaaggacccagtgctggcagaattcatcacctggctaaagagcacctgggttttgaataaatatcagtggtacccaggcagtacttgctgtgggccatgggtgagacccagggccatgctagattcaggtgtgatccaacatatttcaagctgtgttggccatggagagagatttcttttgcttgaagaaaggagaaagaaaagtaaaggggactttgtcttacagcttgggcaacagcttggcccagtgggttagaggatcaagtgaatccctggggtccccagttctacagttctaggccttgactcctggatggcatttctggacccacactgggccagagggaagcccactgccctgaagggagagaccaaggcctggtagcattcaccacaagctgagccttgagtgaacattggtaccaagcctggggtggtaatggccatggatagacactctttctgactgaggaaaggagagggaagggtgggaagaactttgttttgcagcttgggtgccaactcaagtcacagcagaacagtgcactaagtagattattaagtttcctgactccacgcactggctcatggacagcatttctgggccagccttgagccagggagtagcttgctgccctgaagggaggaacacaatcctggctcagtttgcaacctgctgactgaagagcccctgggccttgaacaaaattggcagtagccaggcagtgtggttgctatgagccttgggtgagacctagtaccatgctggctttgggactgacccagagtagtcccagtagtagttgcaacaggggtgcttgtgttacccctcccccagttccaggcagatcagtgtgaaaagagagactacatttgtttggaggaaagtaagggaagagaacatgagtctgcctggtaattcaaggaattctcctggatcttatccaggaccaccaaggagatacctttacaagtctgtaagaatcacggcattactgggcttggggtgccccctaatgcagacacagctgcaatgaccaaagatttagataacaacactcaattccctttgaatgcttggaaatcccttctaagaaggacagatacaaataagcctggacagtgaagacaacaataaatacctaactctttaatgcttagacatcagtgaatatccacaagcatcaaggccatccaggaaaacatgacctcaccaaacaaactgaataaggcaccagggaccaatcctggagtgacagagttatgtgacctgtcaaagataatttaaaatacctgttttggggaagatcagtgaaattcaggataacacagagaaggaattcagaattctatcagataaatttagcaaagagattgaaataattaaaaaaagcagaaattctggagctgaaaaattcagttgacatactgaagaatgcatcagtatctatcaaccacagaattgatcaaacagaagaaagaattagtgagtttgaagacaggctatttgaatagttagaagagacaaaagacaaaaagaatgaagtttgcttacaagacccagaaaatagcctcaaaagggtaaatctaagagctatttgtcttaaggagaagggggagagagagatcagcatagaaaatttattcaaagggatagccgagaaatttccaaacctagagaaatatgtcaatactcaagtacaagaaggttatagaacaccaaatagatttaacccaaataaaactacctcaaggaattcaatagtcaaattcccaaaggtccaggataaagaaaagattcttaaattagcaagagaaaagaaacaagtaacattcaaaggaactccaatacattggagcagacttctcagtggaaaccctacaggccaaaagcgactggtgcaacatatttaaaatgctgatggggggcaggtggtgggggctggggaggtggggaacaacttttatacctacagtaacatattcagtgaannnnnnnnnnnnnnnnnnnntggggaggtggggaacacatttaatcttacagtacaatattcagtgaaaatatcctcaacattaaagaagcaacaaactttcccagataaacaaaagcttaggatttcatcaatatcagatgtgtccctatggaaatgctagtttttcaatctaaaagaaaaggatgttaccaagcaataagaaattatctgaaggtacagaactctctggtaatagtaagtaaacagacaaatacagaatattatagcactgtaattgtgtgtaaaatatttatattttgagtagaaagactaaaagatgaacctatcaaaaataataactccaataacttcttaagacataataacataaatagaaacaataaaaagttaaaaagtgggtggatgaagttagtgtagagttttcattagttttctctttgcttgttagttcatttttgcaatcagtgttgtcatcagtttaaaataatgaattataagatattatttgcaagcttcatagtaacctcaattccaaaaactgacagataaaaagtttaaaaatgaaattaaaacataccatcagaaaaaataatcttcacaaaaaggaagacaagaaggaaggcaagaaagaaggaaagatgacaaaacaaccagaaaacaagtaacaaaatggcaagattaagtctttacttattaataataatattgaatataaatggactaaactctctaatcaaaagacatggagtgacttactggattcaaaaactaaacaaaacaaatgagacccaatgaacatttgcccacaactaacacacttcatctgtaagacacaaatagactgaaaataaagggatgaaaaaacatattccatacaaacagaaaccaaagaagagcaggaatagctatacttatgtcagacaatatagatttcaagacaaaaactatataagaggcaagtttattatgtaatgataaaggagtcaactcagcaagaagttatagcaagtgtaaatatatatacacccaaaactggagcacctagacatgtaaagcaaatattattagagctaaagtgagagatagaccccaatacaataagagctaaagactttaacaccccactttcagcattggacagatcatctagacagaaaatcaacaaagaaacatcagacataatctgcactacagaccaattgaacctgataggtatttccaagaacatcgatggctgcaaagtgcacatgcttctcctctgcacatggatcattctcaagggtagactatatgttaggccacaaaacaagtattaaagaattcaaaaatattgaaattatatcacatatcttctcagaccacaatggaataaaactagaaatcaataacaagaggaactttggaaactatgcagacacacagaaattaaacaatatgctcctgaatgaccaatgggtcaatgaagtaattaagaaataaatttaaaaatttcttaaaacaaatggaaagactacatacccaaacctatggaatacaatgaaaacaatactaagaggaaagtttatagtaataaggacctacatcaaaaaagtacaaaaacttcaaataaacaacctagtggtgcatgttaaagaattagaaaagcaagaacaaaccaaaccccaaattactggaagaaaatagtgaagatcatagccgaaataaatgagatcaaattaaaaaaataacaaaagatcaaccaaagggaaagttggtgttttgaaaagataaacaaaattgccaaacctttagccagactaaaaaagaagagccaaataaataaaatcagagatgaaaaaggagacattacagctgatactacagaaattcaaaggatcatttgtgactactatgaacaactatatatatgccaataaattagaaaacctggaagaaatggataaattcctagacacatacaacctatcaagattgaaccaagaagaaattcaaaacctaaatagtccaataacagtaataaaattgaaaccatagtttattgtacattgatgaaaagtttcctggcctagtaaagcccaggactcaatggtttcactgctcaattttacaaaacatttaaagaaataataccgatcctactttaactatttcaaaaaatggaggaggagggaatacttccaaactaattctgtgaggctaatattaccctgataccaaaaccagacaaaaacacatcaaagtaagaaaactataggccaatatccctgataagcattggtgcaaaaatcctcaacaaaatactagcaaaccagatttaacaacacattaaaaagatcattcatcatgactaagtgggatttatccctgggatgcaaggatggttcaacatatgcaaatcaatcaacgtgatacaacatatcagcagaatgaaggacaaagccatatgatcatttcagttgatactgaaaaagcattggataagtcactattacttcatgataaaaaccctcaaaaaactgggtatagaaggaacaaacttcaacacaataaaagccacatatgacagacctatggctagtatcatactgattggggaaaaactgaaaggctttccttgaagatcaagaacacgatacggatgcccacttttaccagtgttattcaacacagtactggaagtcctagtcagacaatcagataagaaaaagaaataatgttcatccacatgggaaaggaagaagtcaaattatccttgtttgcagatgatatgatcttatgcttagaaaaacccacagactccaccaaaaaactattagaactgataaattcagtaaagtttcaggatataaaatcaaaatataaaaatcaatagcacttctaaatgccaacagcaaacaatttgaaaaagaaataaagaaagtaacctcatttacaacagctacaaataaaatgagttaaccaaagaagagaaagatctctacaatgaaaactataaacattgatgcaaaaaattgaagaggactcaaaaaatggaaagagatttcatgttcatggattagaagactcaatattgttaaagcatccatactacccaaagcaatctacagataaaatgtaatctctatcaaaataccaatgacattcttcacaagaatagaaaaagtaatcttaaaatttattgaactacaaaatacccagaataaccaaagccatcttgagcaaaaagaacaaaactggaggcatcatattacctgacttcaaattataacacagagctatagtaacccaaatagtatagtactagcataaaaacagacatatagactgaaggaatagaatagagaacacataaataaatccatacatctacagtgacctcatttttttataaaggtgccaagaacatacattgaggaaaacacaatctcttcaataaatggctctgggaaaactgatatccatatgcagaagaataaaactagacccttatctctcaccacatacaaaaatcaaatcaaaatgtattaaagacttaaatctaagacctcaaactaggaaactactaaaagaaacagttgaggaaactctctaggacatcggtctgggcaaagatttcttgagtaataccccacaagcacaggcaaccaaagcaaaaatggacaaatgggatcacatcaagtgaaaaagcttctgcacagcaaaggcaacaatcaacaaagtgaagagacaacccacagaataggataaaatatttgcaaactattcatttgacaagagattaatatcaagaatatataagaagcccacacaactcaacaggaaaaaaaaaatctaaaaatccaatcaaaatgggccaaagatctgaatggatattttttgaagacatacaaatagcaaacaggcatatgaaaaggtgctcaacatgacagatcatcagagaaatgcaaatcaaagctacaatgagatatcgtttcaccccagttaaagtggctttaatccaaaaggcaggcagtaacattcccaccaacagtgtatgagagttggagaaaaaggaaccctcttacagtgttggtgggaatgaaaattagcatagccactgtgaagaacaatttggaagttcctcaaaaaactaaaaatagagctatcatatgatcaagcaatcccactgctggatacataccgaaaagaaaagaaatcagggtatggaagagatatctgccctgttatgtttattgcagcactattcactatcacaaaagacttggaagcaacctaagtggccataaacagatgaacagttaaagaaaatgtggtatctatacacagtggagtactattcagccataaaaaatgaatgagatcttgtcatttgaaacaacatggatggaactggaggacgttattttaagtgaataagccaggaacaaaaagacagactctgcatgtcctcactaagttgtgggagctaaaaatcaatgcaattgaattcatggatacagagagtagaatgatggttactagaggctgggaagggcagtgagtggcagaggggtggaagtgggaatgagtaaagtgtacaaaaatatagttagatacagtgtataagatctagtatttgatagctcaatgatgctattttttccatttgataacacaaatactagatgaatgtagggtgactacagtcaaaaataatttattgtacatttaaaaataactaaaagaatacaattggaatgtttgtaacacaaataaatgataagtgcttgaggagataaataccccatttaccctgatgtgattattacacattctatgcctgtatccaagtatctcacaccctgtaaatatatacatctaccatgtacccataaaaagtaagaataaaaaaataaattcagagtaaaaaatcatatgattttgtccttgagaaacttagtagtaggtttatagtatagcataatgcagtattagagaagtacaaagtgctttatatgtgaggagttggggttgttttgaaaatgagcatgatgttgactggtgggtatgaaaagaattgcattgtagtcaaacaagcgaaattttaaggtaggatatcatggacattttgcttgcctaggccagcaggttcttttaaagaagctgttggagagaaaccttcagagatcaataggagcagctcatagggagccttttaatgccaaaagatatgtgtgtgtgtgtgtgtgtgtgtatgtgtgtgtactcatatatgtgtaactatatacacacacatgcatatatatacacacacacgcatatatatatatacacacacgtgcatgtatatacacacatatatatacacatgtgcatatatatatgtatatatatatatatgagagagagcatatatatacatatgagagagagagagagagactgtgaacgcccttggcaggcaatgtgagcagagaattggcttttccagaaaggagtttctgggacatcactcttgggataaataggaaaaagataaaagccttcaaatggaggtaccaaggagaaagctatttagctattttaatagctaatagtgaaattaataatattctaaaattttgtgggtggctataggaagaaaagggaaagaatgatgctaggcacattgtgatattatagaactgacaggaattggagactgggttaagaggtggagatggggctgcaatttggtaaatgtaactagttatggacttctggctctcaaatattgcaagttctacaacccttcctccaccgtatcccagagatatctgagtgtctttttggtttgaatttcaagttaaaaccctgaatatctggaggaacacccacgcccatcatgctctgatgttaagtactaataccttttgctcatccttggttaaatctttttaaattcattcattgttctctctatatatactcctcactaacatgcaagatttttcttttnnnnnnnnnnnnnnnnnnnnttttcccccatttaatttttagttgagattaatgttgcacatattcacggtaggcaaagtgaatatttccaatatatgtatacaatgtataatgatcaaatcaaggtgattagcgtatccatcaccgcaaatatttatcgtacctgggagagtcaaggggaatgtggtggggccagaaaggggaaatttagaaggcaatatttgggaggcaaaggaatgaggggcagttgttcatgaaatgacagtctgaaggtagaaagtgggggccaaagaagacatcaactcccaaagattaccagtttattacgtaatgagcatgtattagccgagaaggcttgaaaaagttgacttttgaatgcgacacattttctttaaaatattgaatctggatgtttttctagttatttaaatttttatttgtaggtatctgtctagggcactttgaccctttaggtgtgggttagccatttctcattaggactgggaaagatgagtgagaaataaaattatagattgcatgttaaaaagaaaaacactggttgtgacactgagtataggtttttttttttactatatctgaagtaaaatgatacttatctgccttgttaattatatttatttgtaaaaatagtttccatttaaatttgtcaataataaaattcctcatgaaaaatatcagaaacctactctcttttataatgaaaagaaacctaagtattagttttttatgtacctatgacatttgattacaatatggaatgaaatttaattgtagcatagtatgaaatggaaaacaccctaaatataccatgaaatttatgttatgctgtgtaataatttcctcatatactttccatatataggcactaaataaagtgaagtaatttaggttaatttaggaggcagatgtttttcaaatactcataggtgtatcaggtaggatacacctgattgtgacattatttggggtccgtataatagaaaacccaagccaagggtgtgtaaggaaaaaaattgcaatttactggaccacttaactgaagtagttaggactgtgatttccaaagtgtgattcttgaatcagcagcacacgcatcaacgggggacttgttaaaactgtgaattctcagtttcatactcacggcatcagagactctggctgtggagctcaacagcctgtgtattaacaagtcctccagcttccgatgcttccatagtcaagtttaagaaacactggtatagagctggatctatccctgggtgcaaatcaacttacggttcaaaggataccaccaggatctaaaggtggactctgctaggcactgggatagccccacacccaggcttcacatggtggctaatgacaacagtagatacatatcatcacagcaccctgtccagtggacagagaaattatctcacctggaatcctcttgatgttcctgggtagcctgactcagggagtatctctgtccttcagccaatcacaatgctgagtgaatgggatgttccagttgtcttattctagtcatattgtccactgtcaaggttgcaattaatttagtatgggggcattgccacaagaaggacaagaagatgtagaatatcattgacaatgtgtcacaaacagcaaagattcagttgtttcagaagacaacctcaggccaaaatttatttaactgaagttattgatgaaagaaaaattcagagatgctctagaagtcaatcacttgactggagaaggagaaaaatgttcacttgcacagaaaatgcacagtcccattttccaatgtcctattacctagagggcaattttagtttcataaccttgattacactattaatactgggctatttgggctagtgtggaggataggcttgatgtttgtaaaataacatttatttgaatatgtttttctaaaattcaatttttttccttcttaatataaaaattgtccttattttactatcttaccacatatttttgaaatctaatctgattgttatcacatatttctttaagtggaatggcttaaataactcagataattaaaggctaattaaaggctttgtcatcattaagataattaaagtatcaattagctttttaaaaggaagcttagccttaatcagaaatcctctattcacacagcagggcctcagatatggcagatattcctgaaatggaaaaacagtacttcaaagttgaggctctgtggaacttcgtcatgatttttcttcatcaatctctattcttttttgtagacggcatatttggttttttttttcccctgctttttgtctaactagttatatattgcttattgtagatacttttgcaaataccaaaaaaaatgaaactcccagaagcaacattttagctaatttttcccagcatttttctaagttttatttttatttttgtggttaaaagggataggtaaaaacccatcagcataaaaaatttacttctctaataccctaggaaaacaagagaattacaaaatacctagaactgaatgataatgatttctggtttcaaatatttcctgccatgaatttagttttatttatcctatcagtgattatgtatagcttttctacatggtttatttaattcttaaaaattctcagtgatttttctattccaacattgtcaattgacccaagttgagtttctggatatgaaaaccacaatatttgatatgaaaaatactatatgggattaacagcagattcacatcacagaagaaaaaacggtgaatttgaagatggagcattcgaagctatccaaattaaaacagaaaaatgtttttatttgtataaattttaggattacaagtgcagttttgctacatgaatatgttgtatagcgggggaagtctgggtttttagtgtaatcatctcctaggactattcagaaaataggttttaaaaatgaatggaacatcagttagctgtgaaacaattttaaatgatctaatagaggtataatttaatttgtgaaggacaggaactggcaaaatatttgaagaaataataatgaaaatatttcaaatttgatgaacattgtatatccacaagcacaagacgctcaataaacttgaactataaacaaagaaatctgaagacactacactgaggcatgtcaaaattaaattgctcaaaaccgttaatagggagacaatcttaaaaagcatctagagaaaaaaccgtatactgtatacagaggaacaaaaataaggatgatagcagatttctcttatttcaaagacagtagaacaacatctttaaaggattgaagaaaaaatgtaaacctagaagtctaaactcagcaaaatacttttcaaaaacaaatgtgaaattaagacttttttcaggcttacaaaagagaatcatcactggtcgatgtcagctagaagaaatgctagaggaagttctgcaggcacaaggaaaatcatgccaagtggaaagatgaatctacactaagtcatgaaaagaactagaaatggtaattacatgggtaaatatatgtggtgcatttttcttttattcacatgtcttttaaagagaagtttgcatcaaaaagtgggtaaaggatatgaatagacagttctcaaaaaaagatatacaaacagctaacaaacatatgaaaaaatgctcaaaatcacgaatcatcagggaaatgcaaactaaaacctcagtgagatactaccttactcctataagaatggccgtaattaggccaggtgcggtggttcacgtcggtaatctcagcactttgggagaccgaggtgggctgatcacgaggtcaggagatcgagaccacagtgaaaccccgtctctactaaaaatacaaaaaattacctgggcgtggtggcgggcgcccgtagtcccagctgcttgggaggctgaggcaggagaatggcgtgaacccgggaggcagagcttgcagtgagccaagatcacgccactgtactccagcctggtcaacagagcgagactctgtctcaaaacaaaacaaaacaaaagaatggccataattaaaacatcaaaaaaacaatagatgttggtagggatgtggtgaaaagggcacacttttacactgctggtgagaatataaattagtgtaatacaaccagtatggaaaacagtgtggagatttcttaaaaaactaaaagtagaactaccatcaatccagcaatcccactcctgggtatctacccaatggaaaagaaatcattagacgaaaaagataaacgcacacatgtgtttacagcagcaccattgcaaagatgtggaaccaacctaagtgtccatcaaccaacgagtggataaaaaaaaaatgtggtatatatacaccagggaatactactcagccttgaaaaggagtgaaataatgtcttctgaagcaacttggatggagctgggggccattattctaagtgaagtaactgaggaatcaaaaaccaaatatatgttctcacttataagtaggagctaagctatgagaatgcaaaggcataagaatgatataatggactttggggacttgggagagggaagggtgtgagatgggtgagggataaaagactacccattgggtacagtgtacactgctcaggtgatgagtgcaccaaaatctcagaaatcaccactaaagaacttcacctgtttcccaaaactattgaaataaaaataaaaattagaaaagatcagagggaaagaatatgggggaaataagacccccatcaaaaaataagtgatgaaagatactggggaaaaacacaggagagcaggttactggggaaataaagactatttgagaaatgggcaaaaatgataaataatgcaaatccacaatgtaagtttcatattttaaaagtctagacctcttgcagctttgaaacttcatgatgctatttaaatgtcatgtttagtattgtaaataatggtaattttaatcattaatgctaattgctattctctgtggctatattactattcatttattcagtcaatgcatgtttgtttagcactagaaggaacataagcacacatccagtagtctgtattttatttggtttaatttcacacacccaaaaatgcctacgtaggtattaaatgtcagctcttatttttaatgctttctagattgcatcagccaaatgggaagaattataaaaaaatgtaaataactacttaaatacattcataaggtcaataataacaaaattttataatacttcttcataaaccttggatttgttttattgcttctaggttctcatagtgattttgatagcctatcttatcatttgttactatatctttgttaggtataaatgttcaggcttcacctattaccaggcatattaaatttcacaagagaaatgtgtagttatagctccaaggcaggtgttatgatcctgtcaaattgctcaggctaattttaaatcatatcaggtctgttgctgggagatgtttgaggaacacaggaaattatatggagcctgttgataacagcctgtccttatcctgtgacctaaaataataccaaacttgccacattaccaaccctcttgtttaaatgtaaaacccatattggaggtttacaccaatgtcattaaaaaaagaaagttaggattcaaaaatatgattgtaatttttgaaatcctggtagcgaaaatttagctgaaattggcaattatatttgacaaaatatttaatataaatcaatgtgatgtttagttcaattacctcaggaatatatagagttatcactgatggcctaaggccatgcattccaagcttgggtgatcataagcattacctgtggtgtgtttctgcaatacagtttcctaagccccttttccgaagtgcattccgtagatgtgcaggttaaccagtgtcctcggtgaatctcctgctcagatatactggcagcacactggcctaaagtaaggaattcttatgctttttaagaaactggatgcagagagctcttctgcatcaactgaagtatgttcagtcttagcttgtaggttttatttccttacagttcattaaggtcagaaagaagggttaatcttcctaactcaaatgatgctccgaagacaggaattgttaactaggtttgtgttcagtgtgaaactggcacagggggcctgactgcaaacagccatgcagggaggttgaggctgaggaggtggtgatggtaagaatgctgggcttcggaggaggagatcaaatgggcctccctcatgatgagaagggagagaagggatggaggatggcagggattgggacttacagtaaacagatactggtttttcttgaaggatgtttggatttcacagcccatgcttttctaaccaaggagccagccttagcattgacatttgagggagtatacaattccaaatgaggttgaagataaaggagcaattgctttttacattaaaggcacagccttttcagagcaatctgttcatcctctgttatcactttaaagggagtctagtttttagcttgatgtatacatttaactgactctctataatggcagagaagactgcatggcacttccaagttcatttctttacctttaagtggattaaggcatatgcctgcttagctttcccacgttcactgctttgaggggagtaaaactggagtgatttcaggaattgacactggaagagtttcctggtcacaggctttgaacccggaaagacctaagctgactgtcaactttaacttgagagagctgttaaccaccctcagtttccttgtctaagcggaagaacagaacatgttaatagaaagtgcagtttactgagcatgtactgtgtgctcaggcattgtactaagtaccctatgtcttattcgtgaaccccccactacaacctttggagatatgtgttatgttctgacaacagcaataattttgcgtcttcctcatggaattttttgtttatgtgtgagtgataatgagattagactcattaaagattaaagaagattaaagccatgccaatattaggttcccagttctcaaaaaaaagggagttatattccttttctttcatttgtgactgttccttttcatcttttggtgttttcaggaagccattttgcctgcagccgctgaagtggcccagctgcagatgttaatggctgtttaccagtaggagccaaaacaccacactaaagaagctaggaggtgtggttattttgccttttctgtaagataaatttcttaatgctaatgcctccaaatgaagacatttgatttatctctaaagtatatttttaagtatagaaactgtaatgagtggctagattactactctgttttaaaatgtgttacaagacagctttcatcatgtcaatctacggatccaacaattaaaagaaaggttaccgaaattgtacacagatagaagtttacttcatatagccctggcattccagtctcttctaagaatgtgaaataaaggattgatagatggataaacacatggtagatggaggtctgattcaggtggtgttaaaaatcaaacaaaaatctttccaaagtagggatcaaattctacttcttttgagatataaactgtttatagctttgaaatgacagttttcacctcagcacacccattaaatttttatggaacccttcctcgtctattaatacatggcatataggaggggctcaatataatttagttccccttaaatgctttggtatgtgatttggagagagcagctgacatagttgaatatatatcagatatatggttagaaaaatatcgcatagcatctgtagcagaaaaattagttttctgaaaagagtgaatgtaaataatgccagggaagtatgcttttgaataacatttggtaagatccattctgaaagaagagagttagggaacttttattttattttatttttcacagtacaggaaaaaagcaaaacaaagcaaccaaatgtcctgcttgggatgaggtcattgatatcagaggatgctgcgatactgatcaaactgataaaatagcattcagtttgtctgactcattggtgaaaaatagaaaccagtgagaggtggactaaaggttagtgtgacggttgctagcttttagaacaagcagaaaacaaaatatttttactttaaactttgtctcatgaacttagttgcagtgatgggagcatttaataaaggtaagtagtatttttcattaaattttattagcattttgttatggactgaatatttgtttacccccaaaattctgtgttgaaattctaacccccagtgtgatggtatttggaggtggggccttttggagataattaggtttagttgagtacatgagggtggggccccataatgggatcagtacctttataagagaaggaaggaacaccaagagctttctttctccaccatgtgagggtacagcaagaaggctgccatctgcaagccaggaagagagccctcaccaagaactgaatcttcccgcactttgttcttgggcttcccagtttccagatctgtgagaaataaatgtcaattgtttaagccacctttttatggtatttttgttgtagtagtgctagctgactaagacacacttgataagtagctactatgcacagagtcctcttaaggaataaagaacagtctaaccctgaagccagtgaagacaagactaattaaaataatactactaacagggctgtgagtaatgtgttgttcacacacagtaagtagccattaattctgcctgggattatcttgtgggtggtgctgtttgagctgagtcttgaagagtaagagggatttgtagccttgagatggtacagcttctgaagacaggaaattggaaatgggcacagagaagaggctaaactacaaataagtgttttgacaaaatatgccaaacctaacacatgtaggcaaagccacatgcagtagttctggctctgtttatcttcctgctcagattttagtctgacagatttatagagagaaggggcagagtttctggttcatttgagaaatcatggctgaataacaggtttttcccttgattagctgggaatccctagggttgcccaagggccacagatacttactgacatttagtaaagaacctctaaaacatcttcagactggtctcattgttaataagtggtgtgacacacattgtgtgtgtaatgtctgtcttggtttttggtggaccacttaaaagtttataaaaatagttttttaaggttctgatgacttttctgcaatataatttgtaagtgcttatatatctccaacctgtaactatgtaaattactgtgaataattttgtccttaatgaaactctgtctgcttctctgtctgtgattaaagattatgaataaaatgcatcggtcttttttgtcctacattctcctctgcaaggtcaggagatagggtttgtcagggcccagttctagcactgtcttaagactccatcctcagaccctccttctccccgttaccatcactgcaaaacttaccctataaagcagatagcttccaaattaacctactttgaacattttttatcattatgagcaacttcatctagcagatataagtagtgaagttttattcagattgttacatttgaagggattttataatttgtcacattacggtagagagccctgtggcctcccaaattgtaacaacttttcctccatcacacattgtcattttcttatgccacacattcttctgatgatttttaagtggatttgtaagatgaaaaattctgaatcacctggatgagcattgctttctttttctttatttttttttaaattatactttaagtgctgggatacatgagcagaatgtgcaggtttgttacataggtatacacatgccatggtggtttgctgcacccattaactcgtcatctgcgttaggtatttctcctaatgctatcctccccttagccctccaccccctgacagggccccggtgtgtgatgttcccctccccgggggttcaatatgttctcttttgttcaccccccaattgatgagtaaacacacacaggtgggggtgtcagcattcctgttcctgggttattttacaaaaaatggtggttccccccttcacccatgtccctgcaaagaacatgatctcatctttttttatggctgcatagtattccatagtgtatatgtgccatattttctatatccagtctatcattgatgggcatttgggttcgttccaagtctttgctattgtgaatagtgctgcaataaacatatgtgtgcatgtgtctttaaagtagaatgatttataatcctttgggtatattcccagtaatgagattgctgggtcaaatggtatttctggttcttagttcaaccattgtggaagacagcgtggtgattcctcaaggatatagtgcatcgctttcttacagaggtgtctgaaataaatgcagttccttcttttgaaagttcaaaggcgttaagtcaatatatgactgtatttgtggtcctgctcagcagttattcatttaggaggtgatttgctattttctgagaacagggatatgaaatgaatgtggttgcttttagagtccagaaatccatttggctcaatggagctgacacagtttattgcagtttttaggacctttttgtaatttacagtggatactaatttcctgctcaagttttctttggcagcttctgtacagctggaacagaagctggagctatgccctaagagggtggtctggattcacttctgtgggtctactcctctgcctcttcttctctgttccctctttcctttgcctttcttttcccaaattcctcaaagcttgaaagggtgagattttccttttctttcccttgctgccctccttggaattccattatgcaattcaccagcctcagctgttggtggaataaatggtagctaccagaggaatttagacaatcctttctcttggctctcaagtatattgtctcactgtacaatcctcttttgaattcccaaagccgaatattaactctttctttcttcgcattgcttctgtaataatcctaaacttcctcactccctttccttttccaagttcaaatgcagaagcttcaggctgcctaaggataaaatgcgtttatgaagaattcctttacacagaacttttctgggagtaaatctctgttaagcatgtagtagatgttgtacaaagtttattgtgtagataaatccatgggttaatgggtggaaggggaggtagaaattacagactttgtggaatgagtagatttcaaatcatccttggaattttcaagattttactcaaggagctgatatttagagcttagatacacctctactattttataaataaagggccagctgaaccgtatgagtttcttacttagcagaattggagctcttgcttttttgtctttcatcctctatcccaaagatttgttgaaggatgatgaactgaatgaaggctgggtatctttaagaagataccaacaatgtcacttattgaaaaaaaaaaagctatttcgattacatagttttaataatcctcatgtcatgtactcttattacgattctcaatattgcagtaaattgtgttttgtggggctttgattaaaattacattttgcactcacttttatggtctggagtgattctgatctatggggggagtgataacatcagcatcaagattttctttgtccgggacgtgcttcagctgcatgacaactctcctcctgagtgatatgtgacttgtgccttcatcacctgttcatcctgccaatatattttccacatctgtcctcccattcacctaaagatttattccacatgcctgatgacaaaatgtccttgcacctgggggacctaagcctgtagaacatctatctcattttctttcttttgacacaagtccattagcttcatctgtcttgaggacaatcccggctaagagcctatctgatgtttcttctttggggacctttcagaatttcaaggttataggaaacttggctttgtgcaaagtatgttgccatctgttgctagtttctaatttcagatccatttaagagatttgccaggttagatttatatagacattttaactaattctatttctttgtacttaacccaagatcacatacttaggtttgtcctttcaatatcatttatcagaatactccactattcagccactttgaggagacacattgtttacctgccacttgctgtgataagacattacatgcagcatgtgtttatttggtagttatcaaataataatgcctggtaacagacagccaaaaagcaaacaggggatttagaggttcctgtttatttttgtttgtttgttttgttttaaataagtaaattgaaactcagagcaattatgcggcttacttaaagtctcaaaattagctcatatttcagatgaaatttgccttcaagttctagatcacctgcagcactgaagttttggtgaccatttattcttcagattgtatttatgattccttgattaacaaatctttaaaaagttgtgaaaattattttctggcaaacattggaaaagggctaaaatatgataatactgtagtcagaaaaaaactattcaaagacacacttgtatacaaataaatatatttttattacatatgcttcatacgcactttctcacatacagagctctaacttcagtgacaataagctctttccagagatttatcttaagacaataatccagaagaaggaaaatgctatacatatgatggctataatagccaagtgttataggcaaattgtgtatccaataatataaaataaatgatagcatattaactaatgtggtaatttacagtcattaaaatgatgagtatgaagacaatatatggaaatatgatgaacaatcgagtttaaaaagccagaaccactgtattcgctttcctttcaactatatgaaaagtatacatgcataagacaaaaatgtaaaagtctatgaaatacttagtgttaggttgatgatattataagcgcttttctacttttatatttttctgtaagttaatgttggttctacaacacaccatgattacagtggtatgatatccactgccaaagaataggaatgcgttagaccaagagtgatggggattatttcacacaagtgctatatttctctacttcccatgattgacattcttaattgatgttggaagggttttgaatccttctaagttagttcttcaggttcatgaactgatcagcaagagcatggaagttgccaaccctttttaacttttatgtagtttactctatattccaaattaattgtccagaaagagtattgactttaaatgggctccaaaatatataagtagcaggaatggtggctgagacaaaactcctggtgttcattgcttagaaatgtctgatgtggaagtgatggaaatggtgggatctgagctggccgttgtcgtagctgtgaacgaattcacatttgtttcccaggccccacacaggtaatgctctgtctgtattccacagacagacacacggtcaaccccacaagggtgcttttctgttcccttcctagagtcctctcatgaaaatgtgcttgttctcatctcatcccctcaaggtttggctttctacttcactgactccccggatttaatccatgtatgggtgcagctcctcaacagtgggattgctatttgtgtaggaatcttctgggtccccacactttttttttttgtacaaagaggtaactagcaaaagggattttttttaagtaaatgatttttggtacacttccaatcagtctatatgaagggcctacctcctataaggatgggcatgagtaggggaattagaagaagattaagggggggtctttagttggagctaccagggaggtgtatgagatttcatggtgtctgtctgggacctggtaaggagtaacctttcccatttgtgtaggtgtatttacagttgacataactggtatagctttcctttatctcaagacaggacaaataatactgtaattctaggtaaaagcaattcattgagagagaaactgatatatcttacattgtatatttcataatatagtgaaacattttgaaagcttacttgtcttatattggttttcttaatattctttaattttcccaccagcttcaaattccacaatttatctacatgcagatacccaccatttctcacagatacatatattccagcctatatttctccagagttgctatttcttacagaatatttctacttgaatgatttactaatatgtaacctatttttgttgcaaaacaacagatagtgctcagtgtagaatttcacactccaatccaatgtaatctagaggtagacgctcccgggcaggctagtgttcagcagggacacagccctgggcatatagttgggagacttgggctggggttttctctgccagagcacagatctctgatcctgtaagtcatttaaattcttgtgtttcaaattccctcactgtaaaaggagtggcttgacctagatgatctcaaaagtctctccaagcttgaaaattctggttctatgattttaatatttaacaatacacataattgtgcttgtgcttgcatgataattaggcatgcatgataatggggcacagtgaatgactgtaattagctttactcctacagagaaaaaatctatttttaagtctttccacttctcatcttattggttttttaaaatattgataatcagtatcaatggcctttgactttcccttggaaccttttacccttaccatcctcaacttccttcttgccactgctctctgtcattatagcggtaatcacaaatccacacatatattagagaccattatgttgaatattaattcctgcagagctgaattcttcctgttctgactttcaggtaggacaatcctctcccatgtccttaattttcatccaataaaggtacttttgtggaagcttcctgccatatcctgaataaaggtgtccttaaaaatccagagatgaacatggaggaattaggtaaacaggatctgtttcacaggggcctgtggaaagcctgggatgttgtagtatcaggcatgtagatcatagtaaaggggatgtcaaggagccaggggagcctgggacaagcatggcagagggcaaagcccacagtgtgagaggcctgggggcctgctgacccacctgggagttctgaggccagagggaaaagagagggagagttgtccttacaggatgagagaagctagaattgtggccctttactttagaagtagccttctggctctgtaagtaaatttacctgacaatcatattaattattataactaacattaattctacaaatgtgcaaggaactgtgataagtactgtaaaagaatgatttaactcctcacattattccttttaagtaaatccttttgaatccctcaattgtaggttgatgatctaagtactagagagttctgaaaacttgatcccagtgatatgagtagcaggcgatggagccagctttagacacaaggcgatgacattttcttttcccttctactcaccccacagtccgtatgccatcctcaaaatatgtaattgcaatgtcaatttttcctgtttcgttggaccaggacatgtaaaccatggaggcagagtctgaaaagttctacgtaattgagcaaagtagtgaaaaagtgaagctggaaacgaaagacaagttttgattccacttggtgtgttttaatttaagttggccaccaggagttcctgagcaaaggtgctcactgtctctagtggtacttgtcttcctgagatggaagctctcggtccttactccccaagtgaccatgtcacgctccttaagggcagtctctccagatgatgaccaaatggtttgtagggaagattttaactctgatgtggaggggctcttcaagcaaatattttgtctcttctcagtacagtaattaagctgataattttttttttttttaccttttcgggccactacaacattctctgctcttggattcaaagatgaatgttccttccacacagtttaatacgtctacagttccagccgaggttgggggagattttgtctgatcaggatgtttttccaatagtagtgtctggttctgtgttgggatttcactcagtaaggttttccattcagttttatgatttggtactcctggtatgcacatcttaatatatctgacccttcactttaaatttttgttgcactttttcttttttttaaattttgtaccaaaaaaaaatgttctgtatccgagacctcatatagcttctattgggagttgtctccacttcaaacttacatttcctttgaaatcccagtgagtagccttactttccatatggcctgatgagaatgtatttcccttgcagatgtgaacaagctttttatttttaacttctcaaataagatgtacatccaagactgttaaaataatcttccataatgatttgtcttagagtagaaatatgtggcatatttttaatcataaatacatatacacattataattgttcttctgtatttaagttagtacctgtgatttgtttatccaagacagatggtaaggggtgatacttttgtcagcttacatctagagatctatagtagggttaatttagaattcaagtaatttttgttcaaggctttatgattttatgaagaaaaaataggaagaggttaaatgtcatcaagcattcagtttaaaaaatatacagatgacctaaataatttgttcagttgtatacttatatataggtgtatgatgtattactcagcttaaacctccagtcctttctcctagagcctaatagcatgaacggccgcagatggggattttacctaggtttctgtgttagcctgtttttaggctgctgataaagacgtacctgagtctgggtaatttatacagagaaacagatttcatggactcacagttccatgtggctggggaggcctcgcagtcatggtggaagagaaaaggcacgtcttacatggcagtgggcaaggaaagaaatgagaaccaagccccttataaaaccatcagatctcatgagacttattcactaccactagaacagtatgggggaacctgcccccatgattcaattatctccctctcacaactcatgggaattaggggagctacaactgaacgtgacatttgggtggggacacagccaaaccatatcagtttctgaatgtcctcttcaggcacaattttgccttgtgttatctgtgctctaagttcatgctgcttgtttcctggctatctgcaaaaataataaaataaaatgcagcttcagactcctgcatttgccacatatacttttcttatgctttacaaactttatcctagttatcaaagaccaggtgttgctggatatttctgctttggcttctacttttctttaattctgtcaacccctccctcatgtctttacactgcaattacatagaggtactcagtacaaaatatattgtatcagcagcatagatggctgcagagattgccttacagtagaaggcagtagaagtttttatggttttatatggagaaagaaaattgtttgctagcactcagatattcttctccttaagttcgtttctcccgactttgactttcactataaaatgccctgactcacttttggaactggagcaaagagaacaagagaagtgatctagagttgctacttcttgcttgggcaaataaatgcctcatgcttcccctgtccctttagtgtgagtcacatagaagactttggcaattgatttttctatttataatcagatatccccataggaatctttactggattactctgactttaaaaaaggagagagatttctgtatttaaaatgtttcataaaaataattggggaaaagagaaacaagaaataagagatggctcagggcttagatgcctgtgtcccctaatttgcccctgagatggaggacattcctgccttctgctgcgtcagcctccttccactggctcttcaacctcctggacctcagtgtggctttccaggtgtggccactggctggccttgggcctgtcaccactcctttcatctgatgccttcccccactgaaggccataggtttatcttccaccatcagtttgtcttattaaaactggccactcgacccttgcattttctgtggtctcacaaaataacacctaaggataaagacagtaaatccagaatacactttgtttaattcctcatgttgaggatcatttttgatcattgcctgctccaacaagccagaaaaaaaaagtccaataaaatatattatgcagtatctctttataaattgttttcttgaatagttatgagtggagtccattggattcccatttataacagagtttaatgtagtgaaattcctgctgactgatattggaaatgaaagtttcatttataaggatgcaattaaagcattgccaagttaaaaatgtcatgttgctctttgtcaatgaggttcattatgctatattattatatctgtgtgaatcctttcttctcaggagcgaaatgttctttctgaatattaaccaactgctacaaaattcttcagagattattattctttcaaattacatgaatttaaaaatcatttactaatgaatcctcctgaatttctcagaaaaagaaagaactcgagcagatttacccattggtaaaggaaactgccccttctctgatattgggttggttagtaaccattcagttgcatttttcctgcactttcatgtaagtcagtcatagatgcagaagggcatcctggtgggaagtagcattttacagcctttaagcagactgtttttctaaatataataacaatgaaaactatttggatacacatgtaagtcctttgtgaggcttgagtctagatgaaatatcagagtctactgcaacatccagtctgagggtgcctttgaaccatttcaggacaaaagcaaattaaacttggaatcctatcccaacttcattacctagctgaatgtactcacagttcatctaacctaattgctcttcctgcttcctcctgacagtaaatgaaataataatgacaattattttaaaacagtaaagggatatataacttagtggttgttattctgattactactgtgtgtctcctctgcttcacaatgggtagagtttagtttgatgggtggttcaccttttggctcctgctatttggcttaattgatgattggcaggcaatctggcttaaatctgatgacctttcttcaggaaaggaagggtgaaatgaagagatggtaagaattcctcccatatttcctgatctatctttggtggcccaggcttccagaattccctgaatcacactcctctgcagaatccttgcagtaatggttgaccatagtatggagagtgactgtcctgttatctactgttggtgtggctagacttattctgccagcttatctgctggctcccaggaacccagtggaatgggagtcctggcatgcagtgccctgtgaattcaatttccaggcaaaaccaaggaagagctttcctttcgagaatgcagctgacactgacatcctcaacaacactttaaatacaatgattacagtaaacaaaaatacaatgtcgtaaaaaagaaaaatgactcttagatattacccagcaaggaaaccacagtgttccagagaattgtaatgccccatgatagcccttaaactccctcaccactcctactttttgatagaaagatctgtaagggctacatgaccttaggctctactccccagcaaggtcagttttgttctatggaatatactataatgttgattgttgtgttcccataaggtcagcacatctccaaggtctgtcctaacagataaacttttggatcagtggtgagcagactaggacaggtataacatgtgctccctaaccagcttcctgaagtggctcatggttgaatttttgggaatcctttatcacaaagatggagaaattggggaccagaaggttgaatgtaagccagttccttttccccagaggcttccctctcacctgaaagggcatttttgggtgagcctcatcgttgaaagaaagtgggatacaaacaaaacaaaaaataagaatgtgtattggcccccaagcagacaccctaatttagggattaatggatatcatagatataagtacacacttaaaaaaaacaactaatgctctttgatagcttaaaccttaagtctttaattttatgcacattattattttttattttccaatttaaaacatttgcttcgttaaataaaacacacattaaggaaaccacataggaccatgtgtgatataataagttatcagaaggttgaattcttacatttactactcaggctaagaaattagtctgtggccatgctggagccctgtgtcccatcctaagtttgttctcactctctttcttcaaaagagatcattatcttggtgcctagtccttcatttatttattcacttattcaacaagcattatggtgtgcctggcatatgtcaaatcttttccatctgaaagattcagaatggcctcttaggtatatgagataacattctaaattaattttattctcctggcctgcaaatttattctcaaaaactgctagttatatggttgctctgtttacttggggacaggtaggctggttcatacatttactaattaaattacttttattgctaactctgaatatttaatgccttgtttggcaattatgagagatatgagtaaaccacagtctttgcttctacaatgattatacattatccaaacataatgcaaaggaaatgttaccagtaagaatgccagaggcccttttcccctaaattctcatgtgcctcgttccaggaagaaaaaaagaaagatttaggatgtttctttctacatcagtcattcccttggagacaagagagaatgaggcaagatgtattggattgttccttagtgtttttccattatgcctctccatctacagattgtgccctccaacaatttcctccctctaattcaaacgcagtgctcttgggaacttattttatgtgtacccaataaaatggcattaatctgatagtggtttgttcaaactcacacaaaatttgaagcaagtgctgtgttccaccagccagatgtcatatttggtaaaagaaatatggggtaatcaattttaaagtcctccaagttttcctatactgtgaaatttagggaggtaaaattaggattgaggcaaaaggatctggatctcctgaaaaaatatggttgtgcacttagtgttgtacacatctttcctaaccctctattccttggactgtttgtactcagggtcagggagtggtgaggctctcattggcatgaccatttaaggggttcaggaggtgtgtactccacagaaggcattgctgaacctgtggaagaaatgctaacaagaatttgaagaatcagactccaggaatgggaaacactattctgaaataatggaggaaaagagaccacattcctttcttgggggctgggatcaagaaagggcccccaggtgggccaggaactcacctgggctggatccatgcagagtttgttcatggttattagagattatgcctttagaagtgacactagtgggcacccctgaaatgacctccaacacaccccctaggggagtacaccctgagtttcccgaaaaatgaggaaccactgacaacagaaagaactggttttctttgtgtggaggggttagtccctgggagggaataatcttccttcagtctcaatagctaaaactgtggggaagtgatgaatggtagacttgagactttcctttgctgttaaggatgatggactagatgatggatgctgttaaagatgatgatgttttgggacatcagagcaaccaataactaaacagcagcctgtgataggctggagcaggttgtcactaggaagacagggagtattcaagtctggctttctctaaatcgtgaaatcattattctcactttgatggttttaggctaatttgacttggtaaagcaaagattacataaaaagttcagattgtggctgaaacacaggcatgtccttcaatctgtaaaagataaaggcaattaaaaaatgaactgtaaatgaagacatatttttgctaaatgttggaataattgttaaaaataattattttgctttataaacatatatttccaggagggctgtcaaaggcactgtggttaggatacatacacttattttttaaaaagttaaagatctgtttttcttataaaactgttcatcccttttgtgcttgacacatgctaccagagatacaaagtagatggaaaggaatcatgccctctcagagtcacgatccagcaaagaacctgaaaatgacaatctgacacccaagtccaagctcttaactactattttacactgattctcagaattgcttggaagattaaataagatgataataagagtgcatcataaccttatggccaaatagaataccattcactaataaagcaaatgttctgtacatttccttccatatctatatcaaattattcatcaagaacatcaaaatgctattatccatccacaactaatatttacaaccaacattttagtaagttaattttaggtaaattaattgaaacacggcctgtatatatattttatgtgaaagtattaatagtgaagtcagaaacgttgcatgagtgtctctccttagctttttatacctattctgtggaaagataatttaaagaaggtgaaatagcccttgcaaatgatagctggctggctgactcactgctatgacttgctttggtagctgctgcttctgtcttgcctgtgttttagggggaaaatatacctggcaaattcctctaatgtgcattgcaccatacttggagaaaatgaaatcttcacataatgtcaaagaaaaaaccagcatcacacagcctttttgtacaattagggataattctacctaagtggaagaagggaagggcaaaatagaacattcagcaggtcatctctccaggaagtgtttaatactgaggcgttttgggtgttcgtgttgtgctttaagctgttaccatctctcaagcctccctacttatttattataaacatttaaagctgagacctttacaaaaggccaaaattaacagtgagtgcattcacacaatgaaaatgtatttgaatgagatttctctgctgttagatggatcgtcagtggcattgtctcaaaggatatttgtgcttctctccttgtcgtttggctttgacaatcagaatgatgaagattcctgtagtagaagtgtgcatgtaaatggaatttttttaacctattttatgaacacttcctgagtccctactgtggactggatgtgcatgttcttgaagaactcataatctagcagaagatgtaaataaataaatctatagagtaggatgtgatgaaatgttggagagaagggtgtttatttgccctggggaccctaaacaggttgtggctaactccgcctggaggatttaggggagtaataatgaataaaacattcattatcttattcaatctgtattgaaatggataaaacatttattgtcttattcaatctttattgattgcttcagtgtatgccatgcactgtatttggtgctaggaacacatgggtgacaagacagcgttgtgaagaactgcaaaagatctgaggtttctaccctccttgccagccaatgagcttaaggctttctctccgtctgagaaaccatcaatagtcgatgttcccttcctcttcctgcttgctaatactccccagagcaattctaccactgtttgaactagccactgaataggaggacactgacaactttgggtggcagctttccagttcttcagaaactattaaactggcaacagagaagaagcggagcttgctgggactaggcctgcaggtttgaaagttgcttcagcagcagagcaccagcatctgagctcccttttttggctgcatgtcggccctgggatgacagtacagtagtgacatgagaaagagatctattagcaagagactcagctgcttctgaagaggtgggctttcctaccaagtgaatattcttttgatggcaagcctactacaatgcgctcactgtggaactaacctaaggacattcaagaatacttcagatgtcctaaaatgtgagaatgtactgctgagccaaataagacattcctgatgtgttggattttggaacttagtttgatttaggacaaaagaccaggaggcatatctctctacatttttctagcatctgtgacattgaagacagaagaaatgttaaatttgtttgattgttaaagacaaaactaacatgtgtcaaagacaatgtcataatttattttgtttattctgggataactttctagagtaatgtgtatcagattagtaatggggtcttgatgggaggcattgttgttcatagcgactctgaaagaccacatgcagcaaggtattgggatgcttagaagatttgccaagtattcagggtgaagtagcaggtgcacaaatgggcaatcagggcacagccaggtcggcagagccagaattgtccctgccctgcttccatacctctaccaaccgtcacctgcaggctgcacacatttccatatgaagagtgattcctgactcttgaggaaacataaaaggtgttgtaactgagataaaatttgcttcagcttaaagaattccttctattatttcctgtgacttgcattttattttttatttcctttgacttgtgtgacatgtaggatccttctctcctgagatctctcttgactgtaaactaattacccattgtgacatgaaaacaaaatatgcttcaaatttccaagaactgtggatcttaaagagagtcattgtttgttcagtggagatgaggggtttgaagatgtaattggaagaggtaagcttttgtgtatgaggaaaggaaatataaagacattggggaagatctgggagaaggagaactgctggggtggaggaagaagaaataagaaaaacctggttgctgaggtgaagaagacatttgggagaaaaaggaatacatgtagagaagattccttctccacgccccagtaaagtcttcccacataatatgtaaagtcaacccttttccttgcaacttcatgaaatcttcaggaagatagtggttcctcattcatctattgagaagtcagagctatttattccctgcttttcctaccagaagttccatgagggcaggaggacagcctgctttgttctctgctttaccccggcaccaaggacagtgcttggtagagtggatatccagaaaatacttcaacaaatagatgacttacttatttacaaataaatgcttttgtttacaaataaatgcttttatttttgtgattgtgttgaacaaaaagatttttcttcacatatcatcctgcttcaaataatacctatttctagaatgattttttacctttcctaatgataaaaaatatataaattatttgatattttaaaaatacacaataatgtgaggcaagaaagcacccacaatatcatcgatgttaggaaacttaattcttttatgtagtctttcttgtcttctttgcatacaccatttttatacagcgtcatttctggctggtgttttaaggcaaaatggatatattgaggtcacagagccattggaacaactgaaggaagagattttaagactggccttttggaaataactttaaggcaaaatagatataatgaggtcacagagccattggaacaactgaaggaagagatttcaagatagcttttggaaataacttcacatttatcctgttctctttccaagttgcattcataaaacttagattgtacatagggcattgctcgcaagggagtatgggaatgtagtttttaaggcaccaaaccttttcttgtgtatttttgtagttttcttttgtctggacctctctttctgcagctggctctacaactaacctattgacatatttcaaatctgagttcaaaagtcaactctgatgagacgagagactttatctgctcactgactcacagcttacctctcccacttactctaccttattacccagtttattttctttgtagcattagtggcaatctgtaattatttatttatgtctcttggctgtctccactactagaatgtaagctccataaaagcaagaactttgtctttcaatactgtatcctcagtacctaacattttgccagggctttatgtattttatacacatttgtaatacgatcaattcaccaaaagttgtacatttagtttctttccagtttactataaacactgcatgatgagcatctttacataaaaatatttgtctacgtttctgatcatttccataagatagactggtaggagttattgaattggtaggtatggaacatcttatctcttatatttgccaaactgctttataagaatatggttctatttactttcctgccagcaaagtgtgagcttccattttatcacatcatcactggaattgaatattttcatatttaaatatttgctaatttttctcactaaagcttagagggtgtgttttctgataaatattaagttttattatattatggatatttatgcttggtcatatttttgaaataaaatttacattgttttattctatgttagaagtcttacatttatatgtagtcaaatcaattgattttttatttgtgatttctgtcattattaagaaagtttttgtccagagctcagatgaatattccatatttggttctttgatgttttcaatatttcaactctttgagaaactttttaaatcaaatttattgtaataaactgtattttaaggttttttaaaaaattctctcctttcccaaacttgaaactggctcccgttagtaaagaacattggctcatattaatagaaaacattgactaaggaaccaaacataaatcacaaacaaaaaagaaaagaaaagtaaagctttcatatctgtcatattagtccattttcatgctgctgataaagacatacccaagaccgggcaatttacaaaagaaagaggtttaatggacttatagttccgcatggctggggaggcctcacaatcatggtggaaggcaaggaggagcaagtcacatcttacgtggatggtggcaggcaaagagagttgttcatggaaactcccattttttaaaccatcagatctcatgagactcattcacgatcatcagaatagcacaggaaagacctgcccccataattcaatcacctctcactaggttcctgccatgacacctgggaattgtgggaattacaattcaagatgagatttgggtggggacacagccaaaccatatagtcttttatatctgtttattcttataccagcattaagcaactctgaaaatcacattcaaacattcatccctcattttaattttatttacaaacataaattaatattctacccaggttctaaattgaataataccattggacccggtttacttagcacatgttgtgattgtttcaatattaaccgatattcaatatcattattattattggatgataaggtttgtacatggacctaatttcagatttgaaactgatcatagtgacttcccaaagcaaaaatgaatggggaaattttggttttagtgatgcacaaagccagtcatcctccgtgtctgattccagagtgaacagaaatgacttcccatagtccctttaaagttttaacctatcaaataaagtcctttagtctaatctccttgaaaaacaccatttttcaagtttcctgttattaacttcatgtcagaattcaaatccccaatgttttaaagaatgtcattggttactataacaattaacttaattcaacagagtgccttcctagacatgaattatgcagtgatcttgaaagaacaaaagatagtacaaaaaagaaatccaatttctcttttttttctttaggagtactagctttaattaatttatcttttactttcagcttttattttagatataggtggtacatgtgtaggattgttacatgggtatattggacccaggttgtgaacctagtacctaataggtagtttgtaaaccagtgctcccttcctccatcccctcctctagtagtcctcagcatctattgtatctatgtttatgttcatgtgtattccatgtttagcttccacttgtaagtgagaacatgtggtatttggcttactcttcctgtattaattcacttaggattatggcctccagtttcatccatgttgctgcaaagaacatgatttcattcttttttatggttgtgtagtattctatgctatatatgtaccatattttcttgatccaatccaccattgatgggtatgtaggttgattccgtgtttttgctattgtgaatagaacagcagtgaacatctgaatgcaatataatgatctatattcctttggatatatacctagtaatgggattgctaggtcaaatggtagctctgttttaagttctttgagaaatctccaaactgatttctaaagtagttgaactaatttacattcccacgaacagtgtacgagttctctttttcctgccagccttgccagcatctgttgttttttgactttttaataatagctattttgactggtgtgagatggtatctcattgtggttttgatttgcattttgatgatgattagtgatgagcattttttcatatgtttgttgatcacatatatatcttcttttgagaagtgtctgttcatgtcttttgcccactttttaatggggttatttgttttttgcttgttaatttgtttaagtttcctatagattctcgatatgagacctttgttggacacataatttgtgaatattttctcccattctgtatgttgtctgtttagtctgttgatgatttcttttgctgtgcagaagaagctctttagtttaattagatctcacttgtcaatttttgtttttgttgcaattgcttttagggagttggccataaatcctttaccaagcttgatgtcgatgaggatatttcctagattttcttctaggaactttatagtttgaggtcttacattcaattttcctaatttattgttttctttcttagaataatcattctcttctactccaatttgaaaaaaaagaaaacttcaggagtagaaagagagatgactttaatttgcagaaagtatgggttcacctatttaggccttatcaatgagaactcttaaagaaacagcctttgagtatacagtactgtggcacacacccctaaggaaccttctatgagtcatgaccttgtataattcctttttcttgagtggaacctgagacttgcctttagccactacaatatgacaaaagtgatagaatgtcactccagtgattttgttaacttatacacaaaggtgaaaggatttttgcagaatcattaagtccctagccttttgttttgagctaatcaaaagagaaattttactgggtggggttgacctaatcaggtaagccctttaaaggaaaagccaggccttccctggagttagagcttcaaagcagcagagactctcgccctcctttcctggctttgaagaagcaagtttccatacatcctatagccacaaggaaatgaattccacaaacaacctgtggttgctgggaggtaaagtctaccccgttcaagtctccagatgagaatgcagccagacatgcaccttcatgtcagcctcctgagtggaatacccacctaagttgtgcccagactcctgatctgcagagctgtgagatcatgagtagatgttactttaaacatcttgtttgtggtcatttgttatgctgcactggaaaatgaaaaccagaagtctccttgatggcatcagctaagggaggaagaattccttctctcagacataccaaaatgtgcaatttccttttcagtctgcagattaatttgaatgttgtcattctaatttgaaataatacccctctgacaaatagtagcagttactcctgtggattttgtgtttctttgtaattcgactactcgtcctattttttctatcctcatttaagtcattttacttccaagctcagatggatatccctcttccacttgcctttgtgtttgatgatctgatctcttcttctgcatgttatttctactttgcctttgctgggttatttctgtatttcttcctcacttctcgcttatttctatttttattcccattctgggtccactcgtgcttctcctcaggccactcaccatccaggaaatttctgtctccacgtctcttctaagatttacctgtacttaagaatttccattttctgaatgatgtttcaaatttagaaatgtggatttaggtctatttgctttgtaagatttatgtttcacaaatttatttattttccttgagaattagtgaacaaatggttaggtaaccttgagtggacatgaagcttttcatcggaattggatacagattgtatttaaacacctcatcaaagatttaggactgtgggattgtcattcataggttgtgagtgagcacaaggacccttcccatggggtggttgaccttttgttttgagagccagagtgctgcaaggaaatgtagttattctttgactggaagatgtcttttctgttctgaatgttctgaggtatgtggattcttatctataattaccttcccttaagtcaatctgcatgctaaagcctcccccaggtcctgcatctgtgcctcattctttgaagctgggattcagaatatattataacagaataaattataaagattgcttgggtgtttcctgtaccaggacatagcagtggtttggtgtcctgcccatttgtgtggcaggaaattcttttgtttgtgctggtgaatcgttttgtctggggcttctttctttgctaaaaatcttgcattctttcatttggcaagcattttgtcaacaactttaacttgcaagaactatgggtccacctatttaggcattatcgatgagaacttctaaaggaacagcctttgagtgtacagtactatggcacacacccctaaggaaccctctatgagtaatgggtttgtataattcctttttcttcagtggaacctaggacttgcctgatattccagagagtgtgaagagggatatttaaaaataaaaatgaaaaagtgttgcccccatagtatgtaacaaatgcctctcaggtgtgacagatgtgagttatactgtgaaggtgatattgatgagtctgggtaggtgtgcaactgcttatggcataaggcaggtacacagtaagaccagtaagactaaatgagaattactgggtatggagcttggggatccaataagcctcccaagtgattcctgtgtacactgaaatttaagaaaattattacatggtgccaaaattttgttgttgatcatgatgatcattggaagacaaaataccaaaaattttatccaacgtattatgtctttaagagaatgttataattttaaaagagaaattatatactccttaaaatcattttcattaatcaaaattacttatggctagaattcctctgcctttataatgctcttgcacttctaagtctaaagcctttaaaatggtcagtaattattatacttcaaattaatgaagaaccattgaccccatgaaatcaagttctgaaattgaccaacaagtaatgaattgttaacgaggatgtattattcacatctgcagtaattattttgcaccaatattctagatttaagtgatcttggaaaatatcatacatgtgatactcctgatctcaaagaacaacttagtaatgtataattatttttatttttctgcaataactgagaatgaagtgcatatttaaataaatatttatatagtatttgtttattcaatgtgaatttcatcatataaagttaatgccctaaatttaatatcttttgcattattgtggcaattgtgatagttaacacatctgtaaacacaaacacatgttctgtgtttccatttgatgacctataaatgaagacacattctaaagtgagacaaaataactatatcctaaatattctatcctaaacgtccccatattcttgcattgtatgaagaagtgtgttggctggtgtatgctaatttaatagttagatataatttggttgcttgatggaagataaagggaaacttgcagtttgaaagcagtcagaatgttaacatctgttaaaaatttgctaagtttcatcactgaaattgccatgacttagtactttagagggaataattatctcccttggaaaaaactaatcactttagaagtgcataaacacttctaagtcacaaaggtgctgtttcatgaatgacatcaaattattattattttttttggttaggaatcagttttaggagctaatttatttcctaaagtctctcatttcttctttaatgtcatttgtgtagtgagagatattaacaagctactctacaaatgatgagaaatataaaaacaaattaattgtatctattaataaccgtatctgttaatattatgaaatttccatatttctccccctagctgttgtcaacatcacatctatttattgtctgaatttcaatttctttgttatccctcatatatgaaagtttaaccttgaacctgaaatgaccactaaatatactgccttaaaaactggaatacacatgggtgtggtatgtgtgtaccctcacttattccaacttagatgccttccattccttctatccacctttgctcctgaggtcccaggctaggggaatttgggttgtactaataagcactttaatattggccaccagagggctcccatattccttccatctaagtatgaaaatacaaagtgcaactaacataaagttcaccatcaaatagaaaatattataggaatttatgatatagttctctctagagtgaaagtgttccaaacccattgtgttcttatataaaatacttacaatgaaccaatttgggatactcaacactttcattaaaataaagttatgaaattatgtttggttttgtctttgttttgggaggttatgataagacttataatacttaattggtgattccacattttaaatattaatgttagtaaatctggatgtaaatccattatttacatatgaatgatgtaaaatacaactgattctagtcataggagtacaattttttatcacaagctagctatataaataatcctctattaaaaccccgggtatttttttttttagcccagcattttgatggtacacaaaactttagacaacaagatggtagggtttctttaagtgtgtgttggtagtaagaaatagttccattggagaaaaacaaagaattgcttcgttggtgagtctttccactagttcttgttgggttgtgttagccgagaaccatttgcagttactgagacatgctgggatacctctcagggttttagaagcagcaaaggtatctgccatttttttttctttttctttcattgatggtaatttgtttggttttgtactgaccaggtgctgaccaaagtatttatgtatgcagacatatttctgctgtgcagtagagggtagggttagccaatagtgaaactgttgtaattgacagcggaacagactttgaagtttctttaggaactctttgaatctaggtgaaacatttcatatgagtcatcagattgatcttctctgcgatgtactttaaaaattacaattcatttatcatcagtaaccgaaaatggcatttaaccattctacctttttcaattgcttttcttctagaacacattacttatatttctgcacttaaatgtgcatcaaagaggatagcaacatggaaggcctgattaactaactcaattatacacccacacctagatgctgtctttttgactgtgagactgcaatgttgtgttgcagaagaaaataaaacaatctgttcccctttttttatccattatgttattctggtctgagaattattgattgtactttttctttagaaaaagagaataaaaatgagctaattttggtgcaccttgtatttattgaaatagttttaaagcagtgttttgaattatgttttgatatgtgtttttaaaacggtttttctgaaagcaggctttctttgtttaaatcctcctctgtcccatcctttgctttcttttcatgagacaattgtgattaaaaagcactctaatctctagggttagattatcatgtctaaatgaaatgcggttataaaactatctttgtatacaatctattttggaaatttgaatagttttattcagaatcacatagtaacaaatccagtccagtttgtcctgatgattcagtgggattttgatctgataatgttcaccaggcatttgcattcaatttctgctcaaggaaatccacaatatcgcaactagtaattgactgcattttaaaaatatgcacaagcaaaagaaaaggtagaaaaaatgcaacaaccaattttgatagtgactggatattatcatagcccaaaagctaactgtattatgttcctcttagaagtctttgaattaacaagcaaggcaaattttcagggttagatagattttattcaggaacatctttgttaattatcatattatttctaagtttatactgtctaggaataaaaaatacctggaaatgttttaattagtatgttcacacacttccatgtaaactgatttgggttcctaagtttcctgaataattgctctaattttgaaattcagcattcttagataccactccaattgtatgtatttaccacttagagagaaagtttattcctatctagcttgtgtgaaatcaaattggcagagaatgaactttggcttaaaagcttctcctgacatttatttgcaaaggtttctatggctaatattcttgcactcaaggtgacattaagcttccttggtcactagggagaaatgtggcttttctcttcactgattctgggtatgagaagaaaagaatgacttgaggatatgccaacctcaccttgcttctgtctgcccctagctatattttatatttacatttcaggcaagagaccaaaaaactgaattcccaacacagagagacagtggcgagcgagaggacctgcatcacccagctcttaaatcctacatcagtacctatgcctaaagccaccaatgatatccagagaccttcctatctgaagctattgatgtttatttttttcaagactttaagacctctcaaaaaataaaatataaaatttaacttagaatactggtgcttaattgtgactgcacgttacgctcatctaggggtgctctttaattcctaatactcaggttgcatcactgaccaattaatcagaatgactgggattcaaccagacctcagtagttttgtaagctctctctcatgactgtgactacactatgggttgagaagcactcaaagtttgagaaccactgtcttgtaaaccaggaccactaaatgatatcataatcctacatcctgacatatgtaaaggataaggatcttagactgcaaatccagatgttcaagaaatacaggttgattatgagttgtgtggtccaaattctgtaattcagccagtgtggtggagggttaatcttggccaattcagggttcttcctttccataagaatgcaagtgaattacaatgggttcagagagtgctacattatttgggggtagggctggagaggactctgtcctgggtggctacttacctgtgccagccttgctgaaatgtgcaccaaggcatctgtccacagtggatcagtggtggctcaagtccccacagcactgccccttcaccccaccaataggccattttctttcccccatgccatgttatggcatgacgtgagctggtgtgtacctgccgtgaagtgtccctcaaaattttttcctcttcggtcttctccacacttgagaaaatgactacatgtttgttgtttctcagagatttgacctcagatgaaaatgttaagaaaggaaccaatcattaaactgagactcctggtcagtacaaccgatgtttcctcttctttttaaagcaaaagcttgtaaattccttttttcaattataaggaaccataaaatcatgcatttttgtcctgaaggaacttttttagtatgcaataatttgattaaaaataatcactaaaaagtatattaccatcaatcgttatgttaagatacataatacatgaagtgttcatatacatacattgttatgttgctggataaatctaattcatctctgttttcccaaggtacttttgtcatctgtccaaacagttaagagtcacgtttaaaatggtatcaactgatacctactccagagtatttatcttaatctaatcagtgttattgctcctgtcattcagaatcttcttaattattgatttggattaattacctggtgaacatttaaagccaattcaaggggagaaaaagaacagtatattgattagcaccattactgaggatatcatttcagtttgtcttagacagggatcccccaggtatgtataatattggccttgagaaaatgtaattctgccatacaaagtctaattcaaatataatggcatttatgtttttatcaatgtaacaataatttacattaattacattcttactatgtgttggagaccatattagtacattgtaaaccctgtcttgcttaatccaataatctcatggggatatttactattttatctccatttacagttgaggaaactgctcaaatcacttttccaattactcagctagttaccacagttaggacttgcactatgtttttagctattatacttagacatacaagttgaaggcagttcttgatgttttaaagtaattgttgtaaagacagatacatgcacacccacatgcagaaaatactcctttttctaatagatactaaactttaaaaataaagtcagtggtacgcattaaaaatacgtatgttcaaatccgtaatggaatatcaaggggagcctggaaatattttgaaaataaacctttttgggggtgatgtgagagacagtacccgggcctctgcaaaaatgtttttgatatgagaatactgcactaagggcaccatagtctaccccagggctgcctgatacagctatatgcagtgatgaaaatgttcttcatttgcaatgcccagtatggttgtctattgagcacttgaaataagcgtagtgcaaattaaaaactgaatttttaatttttaaaatcttaattaggttaaatctaagtagtcatatgtggctattggctacggtactgccaagtgcaggctaatctgcacttactctgcttctttctctctctccctttactcccaccactccttccttcctgcctgtctgcctgcctgcctgcctgtcttcccttcttcctgctttccaataaagagaataaatataaagtttggatcagacaaataaaattcgctttttaataatctgagtaaatgcatgcgtttttccttcttaaatgcaaacagtaaataacaacacctacttatatcattatttttaggactaatgagacaataacagatcctgattatggtaattttttagagctaattagataatatatgtaaagcatcaagtagacttcctgctataaatgatgatccattggtgatgataatgattatgatgatggtgatactgacactaatgctgtattcatttagcaaatgggatagaaggaggtccccatttctacatcagtgtctcatgtggtaaaaagattcagatatttactcattgatgtagtaatatatttcctgtcaataaagccatgtgtgtatatagtgatttattagtatggggtaactgctcatgtttgagcatgtcgacatgctttttgagtttagggttgaaatattagccttgtgttactagtaataaaacgaaaatccagtgagagggatttgctgcagatcacatagaatttgtactcaagttcctgtcttcttttccatctacttctctttctgtgttatcatagttcccataaaaaaataatatgaaagactctaagattcaatgaaaaacataaattttgtgggatttcttcataactttttgacacaaaataaataagatgttagaatcagtggttgagtacgatcaaaactccagatgaaattattttttgcatctctttttttaaccaattattagcagtgctttttagagagcagcatttattttgtttaaccttgcaatgagagagtttcaggcccagttttttaaatgagtgtgatagtagccaatgatagagaaaaatccagtattcctagggaataaaaattgaagaagtaatcatctggccttggaagtatgtatcagcatggccaagtcatgtatcagcttccatctttcactgttgccatagttccatggaggtgatggaatccaatcatgttcttttaaaggataaccactgctctgttcagggcaccctgctcactccgtggggaatgctggaaggatgtgggaccctgcaaggctgcctcgctggaaccaagggatttagcaaatgctaggaaagaaaagcaagtttaagctgggaatgcaagtcatttgctgagacggcaaaacaagaagagagaagccagaggattgctggccatcacaaagccaaggggcctaaaggaggtggaaatgcagcatactagaggccagatgtgcttccactcaaacccattggtggcaagggcctgagaaggaagtggtaatgagtcacaagcaggatgatacagtattaacccacatcctttagaaggcttgaacatcgtccttttgtagctgattcctgtcttagatcagaatgccgactgagagacaggattttgacagaaataaaataataaagggttaccaagtgaaagagtgataaaaagtgctggaatggaaaactatgtagtacatttacaaactctgggtcgattcgaaagaacagaactttgctaatgtaagagctgtgtttggggcatagattctgagataatattggaaagttattcctcatccttttattcactcattatttcacttcttcattcatttccaagcatttttctagaagcaagggacatagcaacagatacaactgacgaaaatctctgcttacatgcatctttcattgtaatatgggaaacagacaataagtgagaaaataagtaaaaaataaagtaggttagatggtgataaatactacagaaaaattacatgggagggaggatcagggatttttgggccgatgagaagcaattttaaattgggttgccagggaaggcctgcaaatccaaaggacctcacttttgtatccagggaacaagacagagaccagtgtgcctggatctggaccgaagggaatgagaagggagggtgggaggagatgacgtcagaggagtgatgggtggggacagaagatgccatggagtctcattgaaccagctcgaagacctggacagaagaggattgcttctccatcctggcagcatggagaaggccttgttccctgtgtgattcccacaggagtgccgaagagcatcctgcccctttcctgatgtatccatttacaatccgcacaagtaaaattgcaacagctgtccctctggactagttcttttcctttctttctttttccttacctttccttttcttgcttttttttttctttttgtcttcagcaacagaaattcattttctcatagtcctggaggctcaggttcaagatcaagatgctgttaggattggctctaggtgaggcatctctccttggctaacagacaccaccttctgctgtgacggcaacatggtctttatgctcacggtgggagagaaagagagagggaggaagagggagagagagaagagagcaaagagaagagaaagagattgagtgctctggtgtcttcctattcttataaaaacaccagctctatgagatcagggccccatccttatgatgtcatttaactttaattatctcctaaaaggccttgtctctacttacagtcacatgggaagtgaagacttcaacatacgaatgttggggggacacaatttggctcataatagtatatgaactaaagatgtagcattaaaaaatgtctatattatactaataaagaccttacagactagttactttgcatccacaaagctacactacaagaaggagaagaagaaagatactcttactattccctccctccattgggccagccctggaggttatgatttctgttattcttaacacatgtcatagagaaatttgagttcagctgtgaagagccatttaagccttttgagaagaaatataccttgatcagaaccgtgatttaggaagataaacatgaactgctttgtgggaggtaggaagattaggagaagggagacttatcaagtagattttagagtactctaagaaaaattcgatgtggctattatgtgggacattgacagaagtttcctcagtcagtacatatttactgagtgtctacaatgtgcctgtatctactgtaacacatttatacagttctaggtgccaggaacaagtcagggctctttgttatttgcctttgataaaaatgatgacaagtcagatttgaggagctttaaacccagacacaagaagacattgttttgatccaggcagacaagtgacaaagagcaagcgcagagagtaggaatggaataaagtcttggagttaggacaatgaagcaatatctacaaaggacaagccgttggttacatcgctgcaggcaaaataatgccaaatggacagacatctcaaaatgcattcctctctcgtccaaagatttcacctcagatcgctcagagatgttttttcttttatgcaagttaaaaatgcagacaaatggaaataatgctgctttatgaaaattcaatctttagctacctttattagcacatatctgttctatgaaacaaatgttatttgtccatcctagctccatttgtccttgaaataaatatttggccctagctcctggatttcttaggaaattcaatttattgctggacatgtttcagtaatctgtgaatgaccccaaattacctgttcataagagaaggccaggcctggatgacaaacacagaaggcttttcatttttcccatgacttccttttttggcaaaccatcctctttgtgagagtccgcctccaagttggattagaagatgtcctggagcgtgcagttcaccacccactatattgtaagctgaaagtgtttttgctaactgaatgtcaaattaatgaggttttgctatctacatggcatgttttgacaaaaatactgtgtacctttattgacagtgaaccttctgctctggagtaatgctaatccaagactgctggtttttcatgttaaaacccataaacttgttattagagcagatgacttccaaaacgtcaaaactaaagatgttgcttattcactagaggagtttatgttgttcacatttaagatgatttatttttattcacttgacaacacttcgaacttcaaatggatgcacacaagccaattcttggagggttgtgactgcagaaaaaaaattaaatcttgtgctcatgtgttgctccatcatagtaatcctcagttttgtcccagaagtagcatgtgtcacttccagtgattcaggaccagctggtagaaaggacggacatttcatgctgccatgagcaactgctgtgtggtccaggatgacttttccaaaagcttcactcactgctcctcagaccacgtctgtttttgtagaggcaaaatgagatggctgagagaattgtggactctggccaaatgagtagtcattccctggctgtaagtgggtgaaagagaggtgacagaaccatttttactgcagtgcagtgtgattaatctgtgtcttcttaatgagattaaggggaaaaacaaactttttttttaatttttttttttttttaactagctctcctctatactgcaagttaaacaacttattctggcagaaggttgaaagaagggaacaattgctcctttgctagaaattctcttcattaggagcatagcctttcaaaaaacaatgccactcatgatatgcttcagattctatataatcatctcatgttgcacttctcctaatttattttataaaagaagttcttttttggtgagagatagattgtaaaactcaatgtattcttattcttttttttttttgcaattattcctgaatacaaaacttaaaaaatgacaccagggctttatgtctagagtagactgtgaaaaaaatgaatacacatttatttgggaaagatattggtggtcattatgccaattgacatatagttgtcatcactgatgtaattttgcatttgtttgtgtaattatttaattaacatctgtttctcctactgtagtatcaggttcttttttagtgagagatagattgtaaaactcaatgtattcttattctttttttttttttgcaaatattcctgaataccaaaattaaaaaatgacactagggctttatatctagggtagactatgaaaaaaatgaatacacatttatttgggaaagatattggtggtcattacgccaactgacgtatagctgtcatcactgatgtaattttgcatttgtttgtgtaattatttaattaacatctgtttctcctactgtagtatcaggtatatgtagaggtaatcacagatgcatcggctcaacactgcttttggagggctgcacacaaccttggcacatggttggcactccatttgtatgtttgttggtgaaaggatgaatgaatacctataattgaaattttatgcaatttattttttatttttgtagtgcttgtccaagcttttttgagcacctctagctatagagaaaaagttttcttcataagggtgctcaatgtgttttcagaagttttggatattacaaagttttttcttttattgaactgatatatgttcatatatagactttaccatttaaaaataaaataattgtatggaaaaatgactgatattaagggacaaccttctttatgtaatttatgtcctgattaatggacttttcttgtttgggattcattccttttcattcaagcattgttcacaaaactggattagttgttaattacaaatggcctaaactattttaagaaagaattttattatggaaaaataagagtactataaaaaaagtcagttggggtcaccttgtctattgcaactaaaatagaattgactcagagctacattttcgtcacctccttttcctacctctttcttggcccccttattctggccttagattactctgcagaaacacaggcaccttgttttttttttttaatgtggaaaaaattaggtttctttttcttattcttccactattccagatgaattccgtgtctattttctaataaatgttaactattttgaagagaaatgcattactcccatagaaagaacaaatacttgcaatcagtgatgttttacacttactatttctattttaatttgtatttattataaaaataggggatatgtgcacacttgaaaacattctcgttgtgtaacattagagtattacagttaaaactgaagccctctttaagcagtaatacctctattattaagcatttaaatatatatgcatatatacatatatcattgtttttatgggttttgatatgtggtacctcaagactctcttctctctatttttccaaatcaatatcagtgaatcataaattttgcattttcatatatgttcatatatatttctgatatatgttgtttgtttttacttttgaaaaataacaaccctattttgattacttcacatcaagaagtctgtttcactcttacctttagattgttctgccttcaaatacaaacattttacttgaaactgtggcagtaagaactctggagccaaaggctagtttcttcttcttcttcttcttcttcttttttttttttttttaaatactttaagttctgggatacatatgcagaacgtgcaagtttgttacataggtatacacatgtcgtggtggtttgctgcacccatcaatccgtcatctacattaggtatttcttctaatgctatcccttccctagccccccaccccctgacaggccccggtgtgtgatgttctcctccccatgtccatgtattctcattgttcaactcccacttatgtttattgcagcactattcacaatagcaaagacttggagtcaacccaaatgcccatcaatgatagactggataaagaaaatgtggcacagatacaccatagaatagtatgcagccataaaaaaggatgagttcatgtccttttcagggacatggatgaagctggaaaccattattctcagcaaactaacacaggaatagaaagccaaaggctagtttctaggcgctcttttggtttgattttgaaatctgaaaaatcagcattgaagttatatgtgtgtgtgtgtgtgtgtgtgtgtgtatgtaagaaaagttcagtaaacacctttagcacccaaattaaacactagttagcatttttctataatatatttttatgtttattcatctataatgccatcatagatttatgtattatctgcttataattttttctgaattatttgataagttgcaggtatcatggcattctacccccaaatactccagcttgcatttactaaaaataagaacattttcttgtatcaacataatgccataatcacacccaagaaaaataataatttcttatataatatctaatttaaagtaacattttcctattatttccagaatatttttaaagctagataccttctttgattctatgccaacaaaaattcagacaccctagttatgtctctttagtctcttttttaaaaaatcacatctattaagataaaatttgacttcaatgaatcgcacccatttaaagtatacactttagtgcatattgcccatacatgcatgtttgattctaacttcatgatcaagatacaaaacaatatcatcatctccaaaatatttcctcatgtcccttgactattcatctctccttccatcagcccataggcaaccactgagctactttctgttgttaaaagttagtttgcatttcctataatgtaatataaaaggaatgttgtacattgtactcttctgtgtccaacatcttttgctctgcatgcttttgagattcatccatgctgttgcatatagtagtacatgtatggatatatcactatttccttcaccattcaactatggatggtcatttgagttgtttccatttgaggctatcatgaataaaactatgatgtatattcattcctaagttttcatgtaggcatgtgttttgtttctcttgagtaaatgcaataatacatttaattttagaagaaactgcgaaacagttttacataatcctcaacaatgtctgggagttctggttactctgtatctgtcaagacttgtttttttcagagttttaatttagccattctaataatgtgctcaactttcactgatatcaaatttcagttaaattttactagtatcaaatttcactgataagtatgttttgaatattttcatatggttattggccatttatacacattcatttggaaagtgaatgttcaaattttatcgtatttatttaggaatttgtcttctcattactcagaagaacatttatatattcttgataggaatcctttggcaggtatacgtattgcaagtaatttttcccattccatagcttgccttttacttttcttattgtatgctttgaaggtaaaatgtttatggttttgctaaaatccaatttgtagattattttttctttaatggctcatatgttttgtttgctatataagcaacctggtgttttcttcttggaaaatgttttattacaaagttattgtttttatataaaaatatatataggtttattaatatttaatggtttattaatatttttcttttttgtcagtttttatatttctgtctttcagtgaatttatccatttaatctaagttttcaatttattggcatagagctatttataatattgtcttattgcctttataatattcaaggaatctctagttgtgctcactctaatttagaatattgtaatttgtttattacttgtgtttttaacataaatgtttgtgtacattgttgtttataaatttcagtgatctttccaagaagtcagcttttggcctcattgatttttctctatagtttgtttttttatttcctttattttagcccttatatttattaatttatttgtgccatgttgtgttcttcttttcctagattcataaggagaactcttagatcattgatttttagcattttattttgttattattttgcttaaaatattttttaaatttatttgtgattccttattttacctatggtttagaaacaagttgtttgttctccacatactgaatgtatataatgaatgttctgtcaaagtcgttaagtagttcttaaaatgaaattaacagaagagggagctttgtaaaggtaaacaaggatttctgaacttcaaaattatggatcaagtaattttctataaaaataagcatagcaaaatatttaggcccaatcccatagtaagatattgtaagacaaaagagaatgagacaaataacatccctagaggtaataaaaactagtcaaataaaataaataaaaatatcaacttgtatttcaaaactagctaaatgacattaagaatataatgcaaaacatggaataacattataaaacagaattagaaaaactcaaaaattaggcactataccatagggaaaaatagaaatgaaagaaaataataatttcagaaatgaagactaaactagaaatatcaaaagaacaaataaacacatggataatgctttaagaaaaaccgaagttgaaagtagaaaaaaattgagaaagagaaatgcagaaagaaatacaaataatttgagagagaaattgaaacgtggaatatgaataaagaacttcttaaatatggttaataggcatctctaaagaaaaaaaaagcaagggaaagaactgatactaaaatctataattcagaaaaagtttctgcagtgagaaaaagatgaaaaagatttcaaactacgtgttgaaacagcataccaaatgccacattgaccagaattaaccaagaccaaaatatgttctaataaaactaccagattctaaagaaaaagaaagaaaaaataacaactgggcatccagaaagaacagtaagtgacactggaaaaagaaaactatgttagcatccctatttttggcaagtatagtttactccagaagaaaatgaggctacatagttcatgtggtttggctctgtgtcaccaccttgaattgtaatccccacgtgttgagggagaaacccagtgggaggtgattggatcacgggggtggtttccctcatgctgttctcatgatagtgagtgagctctcatgatatctgatggtttaaaagtggcacttctgcctttgctcgttttctcctgccgccataaaagacttgctttgcttccccttctgccatgatttaagtttcctgaagtccctgcagccgagtagaactgtgagtcaattaaacctccttcctttgtgaattacctagtctcaggtagttctttttggcagtgtgaaaacgaactaattcagcagttaagataatcaagaaaaaaataacttgtgagcccacaattttctatctaaaaaaatcaccttccagtataaaaggcgtagacaaactgttatctataaggaagaactcagggaatattgagtaatctaataaagaaacagcctaaaacaaccaaaatgcctagagagaagagacaggtggtacacattaaacactggtgggaagcattaaaaacatagttacttttgttgacaagtcttactttagtacgaagactagaacaagtcttagtgtagaactatgactaaatgcaggttaatgggggaaaagtatgaaatgtaattatatatagagagagagagagcgcgaggggagagagagagtagtgatggacaatcaaattacattttcactttaaagaaaataatatactatagtgatgtctactagtatcttataagtaagagtaattataataatattagcaattgccttgctgcttctgtgccaggcataattgggtgccatgtatcagggtgatccttttccccacccagggttttgcttagatggttctcccttaaaaatgcttttgccactgtcttctagtttcccagcccttcccttttggtggaaggcttccaaaaccaagactgaaagtcaagtttgtttatgctgatgtgtactctctggacatttttcttgtaatagaaatcagtgttattttattttacatcctgatattttatatattttatctaaatttgtttgaatatgtttggtaatttacatatgtagcctttagcttacaaaaaaattaacacacacattaaatcttcaattttatctaatctaatacactgatgagattttgattctttaggttggctattgacctaaaaacacatttttgggatatgtcgcatgtaagcagcaacagtttctaatgaaatcttcttggactgactatcaacttcaaattcttgaagggcaaaccacatttacttagtgtctggttgggtctagattcatcttaaaaaatcactaagaaaagtaaaatcatgttcgaaagtccatggaggtttcttgtctttctttctttgaactactagaggagctgtaatataggaagaaatattagaggatttttttttattttaaaaactttggaggcatacaggataaactttcaataatggctaagtttatgaaatttaactgaaatgtgtgtactatatatttagttgtaactgttgattttaaaaaaacgtatactagttggttctaatcagaaattgtcaatatttatgtaatgtaagtgactaaaagttatggaatacaaaaaagtaaacaattgtttacatgatatgttttcggggctctgatatttctgctgctgctccactgaattgcagtttaacttagctgtaacttaaagcttcagtttcagtttttgctaatcattaatattcattcacttattcagttcttaaatatttatccaggtcctgctacttttgtgggtgtgatattgtgctgttttaaagcaatactctggaaaggattaaaaagccattaacaatatagagtgaagtcaaggtcagtgagtaggattttgcagaattggaagtaagacatttgcactcgaaaacaggggtagttggtttctggaacacgctacacccgattacttcatagcgtatttttttggggggggggatttactttatttcttaagtagtttaggtattttattagtgattttgatttttcttgaaggttttattttttttattttgttatttattttgttatttatttatttatttatttatgttttttagacggagtctcgctctgtggctcaggctggggtgcagtggtgcgatcttgactcactgcaagctccgcctcccaaggttcatgccattctcctgcctcagcctcccaagtagctgggacaacaggcgcctgccacaggcctggctaattttttttatttttttggtagagacggggtttcaccatgttagccaggatggtctcgatttcctgacctcgtgatctgcccacctcggcctcccaaagtgctgggattacaggtgtgagccaccgcgcccggccagttttatactttttaatttactctccaatattcaagacatacaacatgcacatcttaaaataagttgtgtatctgtatttaaagaacgaatttttttcaagttatttcttagaagttatttatttgaagagattatttttaatcatatggttgctgttgaataaatttttaaaacaaaatatgtaaagaagtacacaaaatcattttcagtaattctctccttatccaagaaggcaagttctatcttaagaacctgcacagagtaaatattcagtacattatctatcaagtagtgtgttattcactgcaaattgaaaatcatcaaattcctaattgttctgcttaatagatgcttaactatattttagcagattccaaatatatgttaatatatatttttggaattcagcatgagtatctttagatgctaattgcaagttaatctttcttcctagaatgtaagttccatggattataaacgttattcctattgcagattttctaaatagtgtttctgctggtgaagtcttcttcactctctggtgcttaagattagaaagaaaaaaggaaagtaactgaacaaaagaaattctttgaacatgaaattatcaaatgaaactgtacatatgcaaaggaattttaaaccattgccttgcaaagtctttttttgcataacaacgttttgataaaatgaagagactgaccaaagtaacaactctaaataatagcatttcactgccataaggatgattgtaattatcagtggaagcctagagcattaggtcccaactcctaatattagtttcaatttttatagcctggttgttcaaagacatgcaattaaactaacctagtattattggaatagaaaataaagaactactgttggaaacacaattaacaatacataatagaggggccatatttccaatggctgcatattaaaatcaacattgagctaaactaagcataggccaaagctgaatatcatcatcataggacatacttctaggattacaagagtgtatctgaaagtgactaccactttaatgatattaattttatcattaaaaggttttatggtcaaatttcaaaatcatggcattgtaatgtagggtgaaagttcctcagcactgccatgtgattatttctgcaatgaacctgctgcacatttgccattctaaaaggacactgactttcaacttgtgtctctggaagagccagacccacctctgctagtatagcttactgctaatagtcatgctgcagtaacaacattatcaagcttttctccttctctcaaagaaaatgattcaggtaatgctttgcttcctttgcaacccagggattggacctactgtcttcaaacaaagctctgtgcagtgttggtagaaatggtttctgaatatttttagaagcagacttaaaactgtagcatgatttcttgtattttccacaaatgcacttgatgctttactcattcattgagatacgtaatccttcaagtctggatccttccctatatttgatgttaaataaatgttaaatgtattggttaaaactttttgattagaagttaagtgtaaatccaaacactaagttttgttcatattattcacattctgaaactcatttggtatgatattaaactttataacagagaagactttgcagcaggtaattgagtattatgatttccaatgctgaagtacaataaaagagtttggctaagcatcttggctaaggcctaacattagtgttttcctaatatgattcataaaacattcttttctaataaaaacaatctatttggctgctactttggacaccttgaaatcaaagaagattaaatattccattaataatgttaaattagtaaagtaggaaatggtccaattgttcaaatctttgcctattttccaagttaaaaaataagccactaaggcaacaaagaagaaataatcagagatagaaaggcattcagaaaatagtgtgtcagggaagacaaagatagtttttcaaagaaaaaataactggccaacagcatcataatcagcgcagtctaattaaacaaatatagactaccgttcttgtatccacagcacaaatgtcattgtcaacgttgaaaagaataggttcagggagtaatgacagcaaaagtttggaaggggagaaccattaatgggtggggaggaaggagaaacagcaggcataggctactctttccagaagcttgggttgggaaggaaaggataaaacaagaaataggtacgtaagtcttagaattgagaaaggttgctttcatgtttgcttttgttttttagaagaagaaataggtaggaatggttttaggttgagggcaacacactaaaagataagacaatttaaaagtgtaagagaaagatggatccaaatccaggaggaaatagaagaaggactccaagattcacatacaccagtaaggaatcaacaggcagtttcctgtttcctctaaaaatggaaagaccctggaaagggtcagtgcagaggttggacagtcacaactgacaggaccagtgagaagaaatcttagttcatgatggcctccatcttcctgatgaagcagaaaaaaaggcagcctgttagcactgaaaaggctgaagcttaggaagagggtgttaaatgttcataaaggtcaaaaagttgaaagaaggtgttggagggttttttaaggccgtaaagggcttattaagctgtgttgagtgctcagagaaatctggagaccatgattttcattccataaatctgcacataagtacaatttttttccagcagtaattattaatccaggtggagaggagagattgtgaaattaacccagggtaaaataaaacagtgtaacataagatgttctggtggtgctacagcaaggagagatggagcatttgtcaaagatgattgtgaccaccatgcttatggccttcattctgtagctttgtttgtcatattcctcttgtcttcacagtatcttcgtcagaagcatcattgcttttactccacttgggattggctttccataattgaccccagaaagaggcttttctttctctgctgtcattggcccttagctgcattatgctcaatatatctacgtggtgataatgccctattaaaggtgaatcttcacagatgatattttaggaatcttaagtatgtttttattaactcaaaaaaaagagcaaactttcacctactccagcagaagactaggaaaagtgtactctgatgttacccagacattaccttttgatgaggcttcacccactctttcagagctccaggaggctgtgttcttctgggagtgcttggagttaatgctagaccttatagttagagaatatgatgttagctggcagagacatcctggtcaaattattttagtttaaactttcaacctctctcaaaacatctttgaatccctattaaattcatgaccagacagttttctaaaattcctctgacttgagaatctaggctgactcaaagcttgcccttgtgaaaactttatctaaacttaatctaggttcagactccttccttaaggataagttgagagttcatatatcagaactgaaaacatgttgaagctaattgacataatcttcacaaacaacaacaatgacaataacaataacaacttgttcggagatattcttaagctcttcaaagatgatttgattccaaaaacttttgcgaagagtctgaaaaaaatttttccttgcaaaattttgcaattcgaatctcttcttcataatcattcttaaaagtccaagtgaaaagttctcatatggctgttaggaactataagttgaatattgataattggcttaatttgtgttgaaatagagtttttaaagtatatttctcatggttagttctgtactttagcttttgaaatagattttgtgtttgatcctcaatttattctctttaccttaaatatgaatatctggggaaggttggtggcccttttctatctttttttttaaattatactttaagttttagggtacatgtgcacattgtgcaggttagttacatatgtatacatgagataccatctcacaccagttagaatggcccttttcttttaaaaggactctgcgtggcaaataatcaaaagactaggctatacttgtttcttctaaaaacagtatttgtaccctatccctccctgaagtcaggcttactaatagaacaaattgtatttttatttttaacttctagacgctttcagtttccagaagaggaaatataaaaaacaacaactattttcaccagagtgactaatacaggaaagattatttagcataatttctaaacatatataattgtaaaataaataaccatgagggcacgcattttcttgaaagcattattgagaagaggcaaaattgagagcaattgttgaagctgagtagtattgtagaaaagagaagaccatggatattaagattgagtataactttatgatttgaggcaagtcagttggtctccctgttctaaatgttggctttctcattctcaactcataagttgtggtcaataattcattgtgctaataaatttgaggacctaggtacaatatgtattcctttcttaccctcaggatttttaatctgcctcataaagacttctgagtaaattgatgcaagacttctattatttccctatggttgtctcactagtaaataatacctttcaatacagaagatgatttctggtcaaattaatttactataatctcatattaataattatttccagaaaatatctggagcagatgtcactgggagcatatttaagaaatgaatggcatttaaaggtttaatttaaactgatcacatttaataaacttttaatacatagatattctttgcttatctctactttgagaaggatgcttttgtctgtgatgaaaacttatctacattttaaaataaaccatttcctaaacctgttctagcacccagtgtttctattccccattggataaaacgtatgtaagcatatagaggtgacaaggttaaagtcgtaccttctctaacattcaataatcagtctcctgagacatgtgaaattcatcatattctaatcaacttgtatattatcagccctgaaacacaaatattatatcagctctgactgcctcaaaccacatcttagcagtcagagactggctctccaggctattccatctcatttgagaagaaaaccaagaaccaaaacaaattttggtcaagtaacttaggaaatatttaaaatggaatacatatttccagtaacaaatggatgatattaaaataattttatatgaaacttaatctttagaaaaatataacatttcaaaggaaggctttgaactcagtcatgaagtctgatgatatgtggcaattttgggatgctgttgctcactgtggccttggaaaaggtcaaattaaaatgaaagtgtacattttaaatgacagtttgtttcacttagcatagagcagtatggtaccttcactaaacttcctagattcaaggttgattcaatcatcttaacaaaactaaattattaatttaaaaacacacatttttcatgtaaagcagagggttccctcttatttcccagagaattaaaattgtcatgtggatcacaatgtattaaattgctttgatcaactcccagtcatttttaccttagaatgaactttacaggtagtctatatctttagctttgtttaatggattctaagattgtttgcatgaagatccactgagttttagtcattatgattgacaggtggtcagttgcagcttaatcaacttaaagaattatacaataatttcatgaagaactgttaatcctatgtcaaactttggttacatagattaaaaactatgtttggatcatgctttaaagtctcacactaattaaagcttattaataatgtctatgcacacatacatcataattttatcagtattaggataaataagttatttgtaagagtcatttgaaggataattataatttcatgtatgtaaaacaggtttttgaccgagactcaagttttaaaatttatattggtgtaactaaggaaatgtatagtaggaaaataggatttgtagagacaagaactagatccatattctacttttgctatttatcagtggtgtgcccataagcaaatagttctaaagaagatgaattcttagttctaaagaaggaaacagtttactggggttggggggccgtgtaaagagatgataacagactagaagtaatgaatatgaggaggcatactggggggtctagaaaagtttcctctcccatttgagggttaagaaggctttcaaatagtaaacaaaaaggaagaaacactggcttacagttgttggtagaaatgaaaattgcttataaccattttaaagaactataaggccatatctatgaaacttatgaagattggattttttaaatttacctttagaaattcatttttgaaaaacataacacgaacataataaacaaaactccagaaaaaaaatcagcacctgaaagatctcaccatagaactataaattatgaacaatttttattttacaaaattaaaaagaaagtgtttcattctaataagctaatggatatgttaacttcctggaaataagagctcaaaggagaaatgtcaggcatgtaagggaaaattacatgagagcagagataagttcttttttaaaaggatttaagaaatacttacatagtgtttattatgtgacaaacactcttaagcagtttatagttattattttacatagaaattctgtaatgcaaatactaccattttctcattttacagatgaatattctgtgatatataaagaggttaaataacttgctcaagttcacacagcaaatccatgtagtggagctttaccatcagtggtacggttgcggagtgtgtgactttgagatttatgctgtgctgcttcttttttttttttttttttttttttttaagttttagggtacatgtgcacaacgtgcaggttagttacatatgtatacatctgctgtgttggtgtgctgcacccattaactcgtcatttagcattaggtatatctcctgatgctatccctcccccctccccccactccacaacaggccccagtgtgtgatgttccccttcctgtgtccgtgtgttctcattgttcaattcccacctgtgagtgagaacatgtggtgtttggttttttatccttgtgatagcttgctgagaatgatggtttccagcttcatccatgtccctacaaaggacatgaactcatcatttttatggctgcatagtattcccatggtgtatatgtgccacatttttttaattcagtctataattgttggacatttgggttggttccaagtctttgctattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaacagcaaatgttgctgcctgatcgttcctctggaagttttgtctcagaggagtacctggccgtgtgaggtgtcagtctgcccctactaggggggtgcctcccagctaggctcctcgggggtcagggacccacttgaggaggcagtctgtctgttctcagttgtccagctgcatgctgggagaaccactactctcttcaaagctatcagacagggacatttaagtctgcagaggattctgctgccttttgtttggctatgccccgcccccagaggtggagtctacagagacaggcaggcctccttgagctgcggtgggctccacccagttcaagcttcctggccgctttgtttaccttctcaagcctcggcaatggcgggcacccctccccgagccttgctgctgccttgcagtttgatctcagactgctgtgctagcaatgagcaaggctccatggtcataggaccctccaagtcaggcgcgagatataatctcctggtgtgccgtttgctaagaccattggaaaagcgcagtgttaggaaaagtgacccgattttccaggtgctgtcttttatccctttctttgactaggaaagggaattccctgaccccttgtgcttcccgggtgaggcgattcctcaccctgcttcagctcacactcggtgcgctgcacccactgtcctgcacccactttccaacacccctcagtgagatgaacccggtacctcagttggaaatgcaaaaatcgcccatcttctgcgtcgctcacactgggagctgtagactggagctgttcctatttggccatcttggccccacccctatgctgtgctgcttctaaaacagtaagatgagctggcggtgttttggagaaaaatatagaaaaaagtaaaaatactctaagaattaacagtgttagaatgaatgttgtcacaagaagaatagatgcacacaggcccattgggaacaagaaacacaggcttaaaggtattagaattgaatgaaaagtaatcaagtgttacaccaatgagtagagagaaaataatatagaaggaaaaaagggaaatccaacataaacaaaattggtgcacttgctgaagagaacagaaaacatagaataattttcaaagatgtaattcaagattacttgttgaaaatatgtacacttttatctgtagacagggaaaaatatgtcctgggggaaaacacatattttaaaaaaacgacatataattcagcagtaaaatcttccatggtaaagttagtgcattcaaaagataaggaaaaaatctaatgggagaaccaagctaaatataaacaataaaaaaagtcatcttcttcagggaatttatagtaacagccatcactggggccctctgctgggactcatggaccagcctatgattcaacaactaaagggagaaggcagagcaaagcagcaagcctctgactgttgtatgttcagattggttactcctagttaaacattttgaatattatacctgtttataattacattcctagtatgacaactactgaaggcaatccccaaagtcccacagcagaataaagaataattttttaaaataatcatacaatgaactatatcaaggtgaaaaagaatgaaatacagctacaagtagccaaatagatgaatcttacaatattatagatattacaaacataatattgggtaaaatgttatgataaaaaataatagctttgagtgacagagttcatgtagtatgattcctttatgaacgttagaacatgtgaaattaaactggtcacatgcatatttaattcaataaaactgtaaagaaaagcaaataaatcataaacataaaattcagggtggttggtgcaattgcagtgggctacaagggatactcatgattttggttttcattgtcgaggtggtggttacatggctttaatttcattattgggtgttaaacgataggtagggtttatatatacactttagtgtgcatgatattgtggaacaaaacaattcacatggcagaaatgaaacaaatgaaaatgaacattttaagggtccaaaatcgaagtaagaaaataacagaataaacctaaaaaagtaaagaaagataatgaaaacaaacaaaaatgatagaaataatttaaaaagtcaaatgttaagtctttgtatagtcttcctgcaaacttaattttaaaaactaacaaactcataacagaacaaacaaaggtgaaaagcaacagacaaacctaacagaaaagcaacaaagaaaaaattggtaaatatattaagaatgaaactgtatacattaactatagaattagcatagaattaagaatatagcaagcaacttttatctagcaagcttataaatttagatgaatctcaatttcccagaaatattttttaatctgactcaaaaagagatagaacatgttaaactatcaggaattaaataaggtggctaataatcacaactgttttcatatcttactgaagatgctaccaagtgaagtcaaagtagcatagcaatgtgaaggaaaaacaattctcaaatattttagtatcagtagatctctataattttagaaagaaaagaataataaaaccagagaaaataaaacacaaaataaaatcctattgattactaaaaatatctcttggaaatcttacaacaaaagtcaaacccagactgcagaccaccaagattacaaaaataatgaaaatcctgaatatcagaaatgtgtttgtgtctatataacctatttatattgtttattgacttagcactttattttccttttagaatttattgctaattttttcttgtttgttttgtgtatgcctatattcctcctttttgaatttattatgaaagctaatgactttgccattttactagctattgaacatattaagctcacttactcatgtgattattttctaatttattaacttctgctatcatctttaattagtccttctccttttctaagaattgatatttaatgactttatttttaattaaaagattaattttattctttcttgtttagtaagaaaaatattttaaaatacagcttttttccttaacacctctttggaagtatacaaaaagagtgttgcaaataaaaaaatctttatgcatgtaaatattaaagcctagatgaaatggatgtctgggaagggtagtggggagggaactgagatggttaatgggtacaaaaatataattacatagaacaaataagatctagtatttgacagctcaacaggatggctacagtcaaaaataatttattgtacatttttaaataactaaaatattggattgttttttaatacggagaaaggataaatgtttgacgtgatagatctgcatttaccctgatatgactattatgcgttgtatgcctgtatcaaaatatctcaggcaccctataaatacatacacctattatgcacccacaacaatgaaaaagaaaaattgctttcttacattaaatatatgtatatatctctgtgtgtgtgtatatatatatgtgtatatatatacacacatgtatatacacatacacacacacacaaaaagagataaagcaaactctaaaaaggtttattaaccatagttaccattttagatgtttaaaagtcttgttaccaccaagtgcttaaaacaagacaaagtgtttcacagataaacattataaaacttttaagaataagtttagttccttcttaaattctgttagaatgtagaaaagaaggtcaatttccaaagtttattcttcaaggctgcaaaacattgactatatccccagataaatatgacaatacaaaacactataccaaactcactggattgctaagcctttgagtaatgtattagcagatagaaataacagcatgtttaaggatactatgctattactaatggtgtcagtacaaaagagggaaggctggcttaatcttagtatcttttaatatcattttccatattgagagatcgatctactttaaaaatcctgtgatcatttctacagagattgaaaagctatttaacaaaatttatcttaatctatgccttaaatgtatgaccacaatttaaaatgggtgaatattttctatatatgaaaagaatgcatatcatagtcttccccaaaaagcagcattaagtttagtgcatttaagtgaagaataagaaacatatatccatgtctgttatcattttaaacattgttttatacatagaagggaaaataacaaaataagtaaaaaattgtcttcactatttaactatcattaacttgataaagatcttattatatagctaaagcaaaagaaaacaaaatatctgaaacaaaaggattattagaattaataagagaatatagtagacaatttattgaaattgacaaactgtttctatattataaattattgtatatctgtgaatttaccttacattaatctttatgtttaatgtgattaactactctctccaagaaattccaagatttatttttggaattaaataagctgagttgaaaaataaaggcttaaaatgaagaatacaaaagggacatcagacctaccaattattttttaaaaatacattattacacttgaacatttaaaagtctggcagtcacacatgaattcacgcataaattgagatcagcagatatcaacataagattatacagagttgagaaaaagataaatattcaggaatgtagtatttaacaaaggtgactttaaataaatgagaaagaaataagttgttaattaatggtccttcaaaaacctgtctagccatatggaaaaaataaatatggacagtaaccatattttatggacatacgataaccatattttatgtccatatttatggacagtaaccatattatcttacagtataaaatttccagatttatgcataaaatcaaactttcaagaagaaagcataagagaatttgatcatatgatttaggagtgtgagaaactttatatatgtcacaaaacttagaattcataaattaaataattttcaagcaataaatattaaaattttatggaaaaatgccatttattaaaagtcaaaagatcaaaaataaactgaaaaatggctgcaacatgatggaagtaaaaggctgaaaacaacatacagaattgaatgcccagaaaaataatgaaaatgttcaagactcagtagaaaataagccaaatatatgaggagaacttctaagaaaattttttaaaagattttttatataacaaaaacgatttataaaccaatgagaagattttgaatcttattcacagttgacacatgtcagtgaaaatatccagtataattttcagtgccaagattgacacaagttatttggtaattttttttttgttatgtgttggtaagtgtattcttacacattgtcggtgaaaataaatttaatataactttgaaaacaaatctggctatatctattaacaatgtattgatatacatagctttcatccgtaaattcaacatataataattgatctcagaggtctagtcacacttctgcacaaagatgctcctgtaaggaagaatatttatgatgatataatttgtagtggtaaatggtcaaaaactagttagttaataaaggactgctagatgattatggctatatactatagtcacaaattatgcatctattcaaaagaataagtctttttctatgagctgggatatagatatgtttagatattgggagaaaattctccatgggcctcttgtgtttgcatatttttgtcaacataggccctgactaattttgttccagactatcttttcatggctgtttgttcagagaacagcctgggaagacagacatggtgcctgcctctggagaaaaagagtatatttatagcataatataataaactactgtctccttctggggcaaaggtcaggaatacttactgcccactgtgaaagagcagggaccccctatcctgagggttcctctcctggaacacaaccaactgcatgttcaaacaccacttggttctcattgtgttgccttttgggaagtaaaacttgataactatctcaaattgatattccagttactgatcttgccattataaagccccttgacgctgattcaagagtctcatgtcttctgccagaatccgtgaaactgtggcaggctaatttgttagtttgaaagtaaggtgaaatctaatcccagtcccctttcacagttctcaacaaaagttctccaagatatattgtaggtggaaaaataaaccaaggctcagagcagtatgtatggtagagtaataaatttaagaaaactgataagtgtgtgcttgtggaagattaaacttcacattctttatcttgaaggtgcaaaggaaatatttcttttaattcctttctattttctctgatgtttctcatgagctttcttcctatttttcaactgctcactgaatgccaggaaaaaaaatagaacaaagcttaataaaacataacttagttcaagcctacttaaaacttagtgtgattcagtcatgtgaagaatatctttaggtttaattaacattcttcagaatacatgttccagtcttgttcttttatttgcttcatcgcttcttggatgcactggggtgtatggattttgctgaccctctgtcatcatgtaggcatgatggagaggggtgaggatacagaggaggatggggagggtaggagaaagaagagaagttgtcaaaagacaaagaagcaacaaatgaggtaaggatttaacaggcaattgaactaagcagtgaaaagcatattagtttatcttagagaaatgtcagtaggatggtgggaataaaatctgattgtaaataaaaggtgagacttggaatgaaacctaccttcgcctaatgtagtactgattatattttgtaaagaacaggagacacttgctcagttgtatggtttaaggggaggtatcgaaaatgaagccaaggttgaaatagagaagagagaggaattcgggacccaaagaaccagaaggcaaagaagtcaaggctccttgaaaggaatggacctagacatggccttgggggctggagaaaagggagcaagatggatcaggaaggaagttcaggaagggaggggatttctgtcttgctcctcagctccagggtacctgagctgggtaagtgacttgagaaattggctaaaaatttggaggaatcatgaaaagacattcaccaagaatttccttttctagaagtgaggatgattatgttttctgtttttcatgccattttgcaagtcaaagtgatttttaactcagaagattaacatatgcttatgttattttatgcattataaacttggtaaagctattttccaaagtaaatattggtatgccaatgcaaaaggaagacaagatgtattatctagaatgattaaaaatgagatagtttgtaaatgtaaaactaagtgaagattatctatcatgacagattttcagaatgtggggtgatatagcccatgggtcaagagcagggagggcagccttgatgggggtggtgagttttgaactgatcatattttcatgggaagatattcctttttgtcgaagtgattgccaccactgttttcatgctctttcctcaatctccaagctccttggttttaaatggcttcaaaacagctgtgcatactggccactctagcaacctttccttaactgcatacctgagtacagtttgcagtccctttaccaaaatacatgatttctatgagagttctacttgctgaatgaactgtgtccagtgtttagtcctcaagaaaggagatggggcatcagaacagagagagagtatcatatcctgcaaaatattgcttggcttatggatttattctcaatttaatttttctgtctactgatctaggtgtttttttttaaatagaatcaaaagtgacaattcatttgaaatatttctcccttgtccatgaattgctttgtaaatcttgtgagctacttcacgagttatgaagtttttaagaataaatagcaatgaactcactttagtctccatgccaaatgcagatgtttttgtgatagctgatcttgttttgtaggaaaactcttgccttcaagtccttctattggctttcaagagaataatttccttgttttaagtcagatcaagcaaactgtcaataatgtttattaactacccactttacaacagcttacagtggaggttccctagggagttagagttaatagaaaagtcattgcaattagaggatttacaataaagttaactcaaaatataaatgtttgttaattttgaactgagtgagaaggaaagaaaaataaattattgcaatcttctccttttcagttgggtgaggagaagataacattccaaagaattgagtgatcataacatttgtagatcataaggtgattattggtaatctttgtgttagccatttcacaaatttatttgaaggagcagtaaaaatgttctctctgtctatgaaacatcttctcctcaggcatgatttgtcagctttgtgtgggggattctttacacagcccactggaattcagtgatgcaatgttgttagtaggagaggactgacatttttttcagacaaagaaagtggtcttgttttttagacaacaaactttggggaatggaggaatcccaagtagaattagaaagagaagtcatggagagacatttggcctgttacttagtgattgcctcagctgtgtgtttcattatatgggagatttctattgcttttctttcctactgcctttagacacatgttagcaaggagaaatatatacttttgttaagaactttttgccttctgatgtaattttcaggatggccctgggtatgtcaggtacaatattcagatttaattatttctcccaagattcatgtaaatttcaaccctcatttatgaggtcacctcttaagcatatatattaaaatgcattaatatgtcaatgtgtggcagttactttttgaaactgcaaactcagaaacgcaaaatgatataccttcattttcctacaatttttgaagactgtaccttgagtttctgccttggtttgcaagggttactataacagagtgccacaaacgggatggttttgaattacagaaattttttgtcacaatgttttggagaccagaaggctgagatcaaggtgttggcagacttggttcctcctgagggttatgcgagtggctctgttctatactcccttgggagcttctggcggctgatgacccttggcttgtagacacattgccccgatccctgccttcatcttcacaaggcattctcggtgtgcctgccgctgtgtccatatttcccccctttttttgagacagagtttctctcattgcccaggcagaagtccaatggcacgatctcggctcaccgcaacatctgccttccaggttcaagcaattcaactgcctcaacctcccaagtagctgggattacaggcatgcaccaccacactcagctaattttgtatttttagtagagacgggttttctccatgttggtcaggctggtctcgaactcccaacctcaggtgatcctcctgtctcggcctcccaaagttctgggattacaggcatgagcccccgctgtgcccggccgaggtttcccctttttataaggataacagtcatatcagattaagggcccacctaatccagtgtgatctcaactaattctatctacaaccaccctatttccaaataaggttacattctgtggtactggggtctaagttttcaatatatgaattgtaggaggacacaacttagcccataacagctctcagtccactgatgacagaatgttattaaattccatttaggttgctctcaatcaatgtggattttccccggagtcaagacaataatccttgggagtaaactgttcacagttcacagggctttgccactgtcacctggtccctgcttatgtctcatttctctagctgctgtcttacacgatgacatctgtatttgccatgtggtcaatggtgggcagtccttgtgggcccatctacttgttctcaccataggtcctcttcagatagcaaccttcctttgaagcaattatggttgttctcatgagccatgctgcgtctgtggaacatttggtggcctgtgtcaggcatgtgtggccttaacagccacaagtgccttattctgttgaaattgttctgagatgattcagagaaaatttgcaactctccagggatatgcagtttggacctgaggctctgtctttccctgtctgtactccacccctcctggggtggggcaggggacagggcccttttgtggagtgccacacaattcatagcttttctatgcatttctcatactggcatcacatttttctgaataatagtgtccttttcatttaaatagtcattaattacattctcttggctcttcacagcccctcaggttgcaaagattagtattactctgtcttcccccaggcagtgacttatgaatgtgtcaggatactatgagttgtaacatctcttgatttcactgaaatcccaaaacaacatcatagttaaacaacatctttaatattactgcttacagaaagactgtttctgacatatgtttttccttttttaaatttttgagtgaaatattatcataaagtataaaaagtgacaatattaatattgtgtgttcatcacccagcttaaaaaatagaatttttcttatagctttgcaaatctaagcttacatcaattcaaaacttttttgattacacatcaaaagtgaaacttacacatacatgcatattcatttataatttatataggcatattttacgtcaatatgttgtgcacataaaatgtacaaaataaccatttttaaagataaaacaaaaataaggatatgtattaattctagtgttttcttcttgtatcccaaatatttttttttgtactccctcaacgagggccctatattttggaaaccaccagtgtgtatcaggacctttgctctgaagatgaaaaacacagaaaaattaatttttgctgttggttatgtttctgttgcttttccaaaggcagctgatgtcaaggtataatatggatatgggaaggggtggcgtttaggaatcttaaaataatacacagacaacgcacacaagaaaatatatatgcatgtatttaagtatctacatatatgtatgtgtatatatatgcatgtatttaagtgttttgtgtgtgtgtgtgtatgttttatatagataaaacattggttagcactttaaagtctttaaattcttatctggctccaattggttttgaattcatctgttagtaggtttgtctgttagttttgtggacattctccaggaaaatttcttatctctgtaacccagatgcactattagtatttgatcagggatttttgtgtgccatatgagagaaggactcagactcagaattttcacttaatgtcctttatttcattctgcaaaagtacttcttcatttaagcttagggttgtgatggtcaagacagttgtgttagggcaacctgctctccaaacactttcagtgtggatagtaatagctatgatttgactgataagcagtgttctaagtgctttgtgcgtactgacttattccatacatttaacagctctatgggagaggggctatcattagctcctttttcacaaaggaagacacagagataatgagaggtgttatgagttgaactgggtctccccaaaagatgtgttgaagttctaacacccagtacctcaggatgtgatcttatttggaaattgggccttgcagagataatttattaagttgagatcatactggagtagagtgggtccttaatctgatatggctggtatccttataagaagaagaaaagaagctgggcgcggtggctcatgcctgtaatcccagcactttgggaggccgaggcaggcggatcccctgaggtcgggagttcgagaccagcctgaccaacatggagaaaccctgtcactactaaaaatacaaaatagccaggggtggtggcacatgcctgtaatcccagctactcgggaggctgaggcagaattgcttgaactccagaggcggaggttgtggtgagccgagattgtgccattgcactccagcctgggcaacaagagggaaattccgtctcaaaaaaaaaagtagaagaagaaaagagacacagagacatgactggagaaggccatgtaattggagtgattggagaggcaaagatctgagtgatgcaactgtgagctgagaaactccaagaaatgtaggtcactgccggaagccaaaataaggcaatgaaggattctactcagagtctcaagagaccctggtcctgttcgcaccttggttttggacttcgagtctccagaaatatgagacaaaacatttttgttgtctggagttactcaatttgtgggactttgttatggcagttcttaggaaactaatatgatggattaaatagttgcctaaagttacatagtgagcaagtcatacaagcagaatttgagtcaagcagtctgtcattggagcctgcactccacagccctgccttatccctcctcaggggacagacagagcggtgccatgctgatgcacagctcctgctggggcatgaggaataaggctgtgggcagagatttttccttaggcaaccagtggaacttaggatgaagaacgcagcactgtcagatgaagaatattattaatgtttatcaaagatgcacattcaagatttctgaaaaacattttcaacactggaaggcatgttaaatatcatctcattacacagtgcttttactttgagtcgccatttaaaagataaagtttatagccttgctgatctccttggcatatgcttacatacatatgtgaatacatagacacacatatatgcacatataaatgtgcatgtcgttcttcatttaaccagattccttgtgcccctgtattaaaaatggtcaagtttctatttcaaaccatgcaataattataatatcagataaagaattctttcacaatcttttcttagaattctagatgtgacttagtttccttcctctacagtgagggaggaaataagagtgatttgtgaagatgcatattttttttcagtaaaactggggaggtttcacttatctcgggtctcctattctggatacaacatttcaagagtcttggattcctgtttgattatcaagttcacttccactgaccaataaatattggtagatgttaagttctcaggcttgagaggcttctgtcatttggtgtgtccgatgctaacagacactcttaaataaaatgcctcatgaggggccgggcacggtggctcatgcctgtaatcccagcactttgggaggccgaggtgggcggatcatgaggtcaggagattgagaccatcctggctaaaatggtgaaacgatgtttctactaaaaatacaaaaattagccaggcatggtggtgcactcctgtaatcccagctacttgtgagactaaggcaggagaattgcttgaattcgggaggcggaggttgcagtgagccgagatcgcgccactccagcctgggagacagagcaaaactccgtctcaaaaaaaaaaaaaaaaaaaaaaaaaaagcctaacgagaaggtaaaagagcaaggaggaaactaaagcaaggattgcttttattgcaaaagaggtggaggaatctttaaagatttctgatacagcagaaaatcagatattgcatgttctcacttacaagagaatgagctaaacaatgagtacacagggacataaagatagacataagatactgaggactccagaaacggggagggagggagaaggtggaggttggaaggttaccttttggatataatgttcattatttggatgatgggtacactagaagctcagtccccaccattaggcaatatacccatgtaacaaacatgcactgctaccccctgaatctaaattttttaaaaaagatttctgacaaatagagtcttagaactgaaagctagaaggtgacaaagagaacggagaatgtctgtcatcaaatctagtggtcttccctttctctcgttcccttctcaggacacctgagatatgccatactctcttttattatcatggattctctggtagggaaagggtcaccaagtttttgggatttacgtggatgaaacggcagaggaagataattccgataccctcttaaagggacatgccttgcctccctcaagaaattctgatctcatatacatttttaatttaccagacaaaaatattgggaccagaaaaattaaaagattaaccatctggctgaaggccacagagctagcagtgacataatctatactaacacctagaggtttcctgaatcccaaactagtgcttgtgtatttgtatttgtgtgtgtatgtgtgtgtgtgtgtgtgtttatataactttcatgaatttgatacatgaatatatgtttgactttataaaattttctaagttcagccaaaatactgtgttttgctttactataatttcaatttcatcctttagtcacaggttattagaaaaccccctaattttagtagcattaatgcaaacacaccttaacaataaacatatcatgattatctgcaatactttaatggatactctgaatgacacatagaattttaactggtcatggttgcttttagtagcaaacaagatctgatcacaattaattgatgtctgtcacccccttgttttaatagattgagtgcccaatttgaaaatactactttgttgtgagaaaaagaaaataattgaggatatagtatgggattttgcagatgaagggaatcttggggctattcaatccaatctcttaattttgcatgtgaatacagtgaagtaggtcaagaaaaatttcatgactagatttctgaattatttcatgtagttttagcattattcaattttaaatcgtgaagttcaataatttactgttatagttctttcaccaaggattgtgaataatccaattctaagcatgtgtgtttcaaaggaagcagtaaaaataaaaccagtgctatccaacaaccaatccatagcttttactaacaccactcttcctacagcaaaagagtcctttcaagtccattgctaaattccagaactaaacagataatgttggctgtcatgggaaaaacatagcttttgagcttaccagctatatgaccttgagccaaaccaaactacttaaactctgctcagtcttttcacttgtagaatggaaaaacaaagcccatctcactggctcattatgaaaatcagactaacttgcataaagtacttatcatagtactggaagccaataattattagattccctttcttctcttcttttttattttccttcaagattacatggctagttagtgtccaggcaggacaagagtggagaccttttaatttcgaggcagtggaaccctctatattcttccgttgtccacatgaaaatgctctcaggaatgaaaagcagaaatacctaaggaacattttttttctcagcttgagaagcaagccagggactggtgccctgtcttaaaaatggtgaagtttctatctcaaatcatgaaataattgtactgtcagataaagaattctttcacaatcttttcttagaattctagatgttacattgtttttttgtttcttattactagagaaggcttaggaatctatggtggctcaaaaatgactagagaaaaattgagtttatctgttataaactgagcatatttgaatacactggaaaataggacacaaaacaggtttttggaatttacatatttggaacaaagcaaatgaattttagctggcagagtcaactaagtgttcaaattaaaatacccctatttcaaggttatcatgaggctgtagcagtggtacacctagcttatcagatgcacagagagaataaatttttaatacctatccttctctatgtgataaaattgttgccagtaataatcatgaagagataattaacaatcagatttttaaatttgttttttagtcttaaannnnnnnnnnnnnnnnnnnntaacagtgtatgtagaataatacatttacttttaaaagtatattgcaaaattaagttaaataatttatatatgaacaaaaatttgcacttacctcaaaagttatgcattacatccctctgtatgctgttttaaaatgtaaaacaagtaaacattccaagtggttaagaagacaaatacaagtaactcaaattatcctttttttgtatttacaatctctgagctataattgtttatttccaatatacatgtaaatgcagggctgtgtagcatcacaggttttggggatgggagctatagttattctttacccttgatgaacttatttgcaaagtgtctgtaagattttggtttccacttagggatgtagaaagttacaaagtgtgattcccattcttacactgaagaaaagtgggacgaattaaaaatccccatgtgtttctgaattcatccaagatctgaagtcacaggaaaagcaactggccccaaatctggagatagataggcagatgaagggagagaaatgagctcgggcttagctgggtagacataattaggtgctgagaagggtggtgggaaagttggtagcggccaagtatgccctcgtgaatgagcatgaagccccgggtgctgcagaatttgagagagcccaaaccctcttcagatttgtatctataaatcctactgagctctcacagaaaggactggaagatgcttttgaaaacagatccaggaagtggggaactcaaggaagagaggagcaactcctccaggatggtcatgaaactatccagacatttagtacctgtttcccctataaaacaaaatctttcactgtcggggaaagggtaatacatctccttgctcttagggcacttgtaagtatccatggcagctatgggaaggaaacaggaacataaataaatgaaagctcgacatagataaataacgaagaaaacatatcacacaaaaacaaagaggtggacttatcattttcaaattaccaaacacaaaaacaaacagaaactcttacaggcagttacagaaaaagaaacatatgcagaggaacaaagatactaatgacaggggacttcttgtcagaaaccatgcaagcgtggggaaaatggagagacgtctttgaaagcctgaaagaaataaatgttagcattgaattctatatccagcaaaaagtatattccagaaatgaaaacaattaaggatttttatgaggctattcattacagcagacctaccctaaataaatgtaaaggaagttctttagacaaaaggaatgtgatacttgacaaacttgaatctacacaaagaaatgaagagcaatgaaaatggaataaattaaagtgtaatagcattatagttttatttttagttgctctaaaaataactgactgtctaaaacaaaattaatggcagtagattgtgtgtctataggaaatgtgtgtgtgtttatgcaaaaataaaatggcacaaagaatgggaggaaagagctgggaatttaatgttttaactcttacagttttaactctttcctagaattacatataaagtggtacaatattatttgaatgtaaactctggttggttaaagatatataatgtatacactaggacaaccactaaaaatcaaagtatacaaatagcagaggaaatagaataaaaaataatgctcaataaacaaaacagaaagcagaaaaaagaggcaaaaacaagaactgataaagctaataaaaattgcttagaaagttggtagatttatatccagcagtgtaaaaaatcatgttaaatgtgatctctttaaactcaccagttaaaagatagagattgtcagattgtataaaaactgagacacgactaatctataagaaatgactttaagacattgacaggttaaatataaatgaatgggaaaggtattctatgcaaacacccgtcaaatgaatactggatcaactatactgatgatagacaaagtaggctttaggacaagaaataatatcaaggataaagagagatattacacaatgaaaaagtaattatatcctaagttttaaaatgctaagtatatatacacataaagcatttcaaaatacataaatttaaaaaatgacagactgaaaggggaaaaaatccacaattgtagtcaatgtcaatactcctttctcatagtcgacagaacaagtagatagaaaattagtgaggatatagcaaacctgaacaaaactatattaccagcttgaccaaattgacatttatagaacagcagaagatacattattttaaaatgcacaaggaaaattgaacaagatagatcatcttctgggtcataatagaagccttcagaaatttaaaagaaactgtattatcatataataatgtgattaaactagaaattacagaaatagatctgaaaaaaatttgaacaacacacttctacataacccataggttaataggaaatctcaaaggatattaaaaatattttaatgaatgaaaataaaataatttataaataaaaatatttaactgaatgaaaataaaatataacatatcaaaaatttgtggattgcagctaacatagtacttagagaaaaatttacagaattaaatgtttatattagaacagaagaagtgtttaaaattaatttatacttctaccctagaaaatagaaaaaaaagacctaattaaatccaaaaacaggagaaggaagaaaataataaagattagagaaaaaaatagtgaaattgaaaagagaaaaacaataaagaaaatcaataaaaccaaaagctgattatttgaaaataacaataaaattgatttatttttaagcagactgatcaagaaacatacaggacatacaaatattaccagcatcagcatgaaataacatacataatatccaacactatgcatgttaaaaagatagtaagcttatgatataagcaagtctatgcctgttaagttcaggaatttaaatgaaatgggccaagtccttgaaagacacaatctgccaaaaatcaattaaaaagaaatagatgacttgaatagccaatattggtcaagcaaagtgaatcatagttaaacatttgtaaaaatgaatattctaggctccaatgattttactagcaaattctaccaaacccttaaggataaaataatgctgattctatactacctcttccaaaaactaggagattagagaatacatttcaaatcatttcactagggcaaaattttccttatcctaaaagtagacaaagaccttacaacaaacaaaactgcatgccagtatgatttataaacatagaacaccaaatctttaatagaatattagcaaatggaatccaatatataaagaaatatataaaaatataatacttattaccaaccaaatgaggtatatctcaagatgcaaggctggtacaacattaaaaaatcaaccaatgtatttcactgtagtcacagactaaatattgttaagatggcaattctctctacttttatctatagattcaatgcaatccctatcaaaatctgtgcaagcttttttgctgatgtcaacatactgattctagactttatatagaaaatcaaaggaactacaagagctgaaataattttttaaaaagaacaaagttggagttctcagaatacttgatttccatacttactataaattagggtaatcaagactgtggttgtagcagaagaataagcctagagttaggcaaaggtttttcaagtagataccacaaaaaccactattaaagaaaaaacttgataaattggatttaattaagatcaaaaccttttactcttcaaaagatactgttaatagaacaaaaggcaagtcacaaattgggagagaatatttgcaaattacatttgtgacaatgaacttctatccaggagatacgtacatatatatgtatatacaacaatttatatacatatatatccgtacatatatgtatatataacaatatataacaatttatgtacatatatatgtatcctggatatgcatgtatatatgtgtatatgttgatatatatatatatgtttttatatatacatatatatgacaatgaacttgtatccaggataaacatacatatacatgtatgtataaatttttaaacatatatatagaaacacaggtatatatgtatgtgtatatgtacatatatgtatatgtaattatatatgttatatagtcatatataaaaaatgactctgcaatttcaatacaaaaaatgggcaaaagaagatagatgtccctaaaacttaaagtataataataataaaatttaaaaaaagaagatagatgtattgcaaataagcatatgaaaggatatgcagtatcatcagagcagagttacactgccacaagccaagaaatgcccaagattacctgcaaccaccagcaactgagagagaggcatggaacagtttctccctcaggtcctccagaactaaccaacccgatttcaggttccagtcttcatcactgtgagagaataaatttctgtttttttaagccaccaagtttgtggtgctttgttatggaagattcaggaaactaacacataacaaataaattattttgaaaaatgaggtgttttttgaagccatgttattgacactgtaatggagattaccttgccacaataatatagcaacctaatcccccgaggtctgctaaagctcttactaaccttagaaaaaattgtaaacaatagtctgaatactattttttaaatatatatttatctttaaacaaggttacacaggctatttgataattcttgacagtcagaaatcaattcctattcaatgagttttcctaaatggaagaaaatgaatcatggaacccttactgggcataaagcttagaaagaatgtaaaggcagatggccctgtctgacattagctgtcatctttgcctccaaacagatgctaaggaagaagctgaaaacacattacagtgtctgacacagtgttagtctaagcatgtgcctaagatgctaatacaggttatgagaaaaggggcctcgtagccaaagttttgcaaattctaagctaaaaaaattaaaaatatttttcatgataggatatatgaggctcattagtgtgctgatatatatcgtgacacattagaacagaagatagcagactcttttccatgtttattttaccctagaatcttctgtgaagaagtttcatgaaactgagcctccatgaactcacttcaggggataagcaacttagaatattgcttctattgatgcgtcattgggtcaatttggaagggatggatctctccctatcctgtatacattttgtttattttccccctttctttctatttttaaccatctcacctttaaaaagatgttcctttgacccacaaattatttcccatctctactgtgtatactttaggatctaagatgtcctatttaatataaaatttaaaaaatcacattgagtagtcttttattcctgattcaccaaattactgctaccataatgctttatcttctaaatcatttctattttctttactgtttattggtgtggaaccataagaaacagctgatattcaacttatgaaagtggcaattccatatggttcaaccaaatacattaatgttattaaagagtcaacacagtttccaagatagttgatttatcaaagagccttaaccactgcaagaatttggcttaatgcttttataaataggctaggtggttgacaggtgagatcacttatgcttaaaaatgataccaagttgggcaagattgacaatattttgtagggccaggcaggaatgcaaaatgatgcagtcaatttgagggagtaatgtgtgctgaatagaatgaattcctaataaaatacttgcaaggttttggttataaaatagaataattaattttataaatgcaacagaaataggaacatttacatggactggtccacataaagagcagttttaaagtcacagccaatcacagattcaggctctgccaaacatgcccaaatgggcagcctccaagccattcatactgaccaaccatctggaccttatcccttggatttcagctaccatgttgaatcagatcaatgacttcatgtggcctatgaattttaggcatttagacatagtagtattgtcttgagtaatatatgtacactcttcctgtaacccattcaaaatctgctcaactttcaagggccagttaacagtcaaggaagtccagaaagtctctgctgttacgtctataggtcatagactttatcgctcagcttaactcaaggtgacaatcacttctggctgacaatcacatcagcttctttgtatattagccttgactttgaagtttgtacattctttgaggacaaggaccaagtactgcacatgttttgcacttctgtcagactaatgtgcaatcaataaaaacattagtaggcttcatcaagcaggacttaataacattactgatcacaacaatgaaaacaacatgcattaaagcaaaatgactattgagaacattaaagattgagaaatttatgtggaggcagatgaatatgaaacaaaatatatacgtattttatgtccatattactgaagttggtatttaatatatccataaatttcattacatgcttaattcgagttaacagtaaggccagtgtttagtttagtagagtttcatgtaagagtctttattcatggtttgtggtttaatgtgttatgtaaaatacagtaaactagaagtattttttcgttggacttttgtctcttaaatactgagatgctggatagaatggtttttcagtgctgaattttctgaccctgtgatttattaggctttttaatgtattatcctaatgtctttataaattaatgtttttataatttatcggttgactattgaaataaaattttcatattccattgcattttatataatagcattacccctcagccactgcgatatacatgagtttcaatttattatagctcagtcccaaatcaatgtcactgttaagagtatgtgttacagtagtggttatctttggaaaacaatttgagtctgactagatgttgttcaatccccaggccatggtaagtgtgactgtggcaagtgcaagtgtgaccagggatggtatggggatgcttgccagtacccaactaactgtgacttgacaaagaagaaaagtaaccaaatgtgcaagaattcacaagacatcatctgctctaatgcaggtaagaagtataccctgtgaaaattgttaagtggaataatcaaattttgtttttaatggaaatatgtgggcgtggagaaatgttgaatctcagagtgagtctgcttttgagtatgttttttagaagtgaaattcagataaatcaatagaaaaaaaatgccatcttgctgagactggcaagtttgatgctttccagctgttccaaatgcctccttctagcaggatattcactggaaacaacaccccaaccacattttatgtaaattgtgagccatgatattgaataccggattacatctgttaaaaaggatttatataaactgacttaattattttctgttacagatcacgggtgctttgaatttttaccttcgcaaaatagaaccaaatactttaaatttgatagaagtttcagatatactggttataaagctctttgaaggatacagtcacagaaagattttttgtttgatcaaaatattttttatttcatagaagttatttgaaaatattttttacaaaattgtagcaatgctgttaaaatttattagcaaaatcatataaaagagttgcagtttaggtttcaatggtatttagcgagtgttaccgtaattaaatattctttttacatttgggcaggtgaagcctcaaaatcagattttctcaaccgtggttgaacatcagcatcccaaggagaaaggaataaactgtcagttctcatgtagtacaccagaggttctgtttcaagtgctttggtgtgtggccttgacgttggtggtttttttaaagctctctgggtgattttaatatagatgagtgtgtgacccattgctctaaatgctaaaggtgaggatttgacttcacgaatgagtacctttcttcctgaagctcacattgttggtagggcccatctctaaccagagctgagaattccccacagtctgattgcaacagattgtgtgttttagactgagctcagttaaaggtgttttgctgataggaatcagaccatatccaaagcgaggtgtgagtggatccgtcaggggtcatgacaaatggtcttagcagttaggtccctttctgtgttcatgatgttctcatcatatttctctagcacttcagtctttctttcttcttagtaggatttctctacgtccaattcataacacccacccctccaaacacacacacacacacacacacacacacacacacacacacacacacttctctacttccaattcataacacccacccctccatacacacacacacacgcgcacgcgcgcgcatgccccatagcgtctttcatcttgaaaaaattattcttttcaaacttgtttcagtaacaagacttgaattctgttttgggtttgaaatctattttgggatttatttatttattgtttgcaaatcaaatttagggtttttttttagagaacattataatcaaatgtggtagtctaggattctaaagatgtttaatattaaggaatctaaacatgtaattcaccacattaacatatcttaaaggagaaaacatacagaagtgtttcagtagatgataaaacatatttgatacaatgtaaacgcatttctaggacatctgtactctctcattttttaagcatggatgcaatacctttgttcataacctgctttagtcaagggacccagtaatgtcctgtatagcgttttcctctccttacaggattcagactattgaaaatgttatgtttatatctctctttagtcttctttaatctgggtcatttccacagactttggctttagagcattgaaacttgtgaagaaagttgtccccattttattaaaagaaaagtgtacttatcttggatttgtctgatgtctcccccgccatgattagattcataatacatattcttaggtaaaacactagagaaatggttttgtgttctcaaaatgtttcatctggaagcacatgatgtccatctgctcatattggtgatgtcagttttgatgagctggtcaaggtgttggctggtgtcttaactgtgttatttctgacttaccctcttcacaaatgtgcattctatgaggaaatactttaaagccatacatgtatcacattcctcactaaaattaccccagatttaacatccgctgatgacaatcacctgacacagtattgacaatgatgactggaaaatgatgatttatgaactgtaacattctctctgaattgactagttggcactcagtattccaccacaaacaggaatcctcctctctcatttatcagttatttgttatttcatttacttagtgacttattatcagtctagaagcacaattcttattatttcattgatttgttattcattttgtacataattattctggtgcacagagttttccagattaggtattaaagcccatcaggctagcttttgtgtttttgtgacatgcctgccttttgtttttgttttttgttttgtttttgcaattctttacttgttggcataataacatattccagggtcatattggacctgcttcactgcacctttggaatcatccacttatccaaacagccctgattccttttagtgaaaatggtatttgaataaaaattgtgggcacagggatacttatttccactggagggtatttgcttcttggccctttctgcaaataggcttgtgtcaaaaaagtagattgaagcataatacaatttttattttatctgagcaaacaatgattcatgaatcaggcagctccaaatcagaagtgattcaggtgcttcattgagggaatgcaagtgggaggcttttatagggtgaacagaaaaagaaagcaaagaaaaatagttggttggctaatgttatatggttgccttatttagtctatcctgttggaaagtccctagttatataattataagtttgttggttgcttctgattggttaaacttaagttctgttcttctttaatgtagacatttataagaaataacttaagctaagtttcacttatttttgcctgtcaggcaaggttaggatcatttatgaggcctaactggcttagtctgctcaggggttctttaggccttgtctccattttaatttatcttgacactagtaaatatatgcctgtgcatatacacacaaatacatatacacatacttgcacacagatatgcatgtacacatacacatacatgcatattttagaaatcatgaatttacaccagtgcatctaattccagtccaacctcacaggattacttcttgttttctccattccatatttgcatgtcccattttcacagggagaaccctggctcccaataccaccaacatatttacttatttgctcaatcctatactacatctctagttacttctagaagtgctgcagacacaccactaaaccaagcaaatgtaccaaaagagattaggatttgcagtccacccctctccacttccccccactcactgtacctcaatcatgcccaagattggggtatgtagtcgaatgacgtgttcataagtcactcagacttattttattttcttctcttttagtgtggttatggtactcatttgaaatacaatttagcttatttatttcagatcactttcaattttaggttttataattccttcccatctgtattaatatattttataatgtatagtacactaacatgcttctaaaagtcataactatgcagaaaagtatactcagagaatcatccctctcttcctcaaaccttgcaccctgcttaccctcaccttatagataaccaactttattgctctcttccttctctgtgcatgtatttctttttgtgtaaagataaatagacatatttgtgtgttattatttctcatttttttcctgtgcaaatggttgtgctttcattccatgtgttcttttgcactctgcttttacgactcaacataatctcctggaattcactccaaatcagttcatagaaatccttctctttattttttcaaaagcacaggactggattctatgtatgcaatgtaatttattcaatcaagctcttatgcttgagcatttagacagtagtcagtattttggattgtaaataatagtgcacagaatgatctagtgcacatatatttttatatttttggaggtgtgtattcaaggcaaattaccagaaatgcaattggccaaaagatacatttatattcagtgttacatttaatcttttctgtctcatttactcttgtagaaatatctaagcctttcatgtttactttggcagtctcattctcacctgtctttcttttaatacccacttccaccctccgagttcaggaccattttccccaaattgcattagcctatgaagtctctctattaatccttccctttcatatcacagtgtggttttctgaagtagtttggagcagaaggggaagaggagttaaatggattggggaatgagactgaagggcagaatgaggcagagctggggatcaaagtgttccagaggctaactttgtgggaaaagtagaagggaggtccagtgtgcagagcagggtgaggccccggcaccactgtacaggagtgtgggctggtgtacatgtctggtcagtcatcctagagagagtcagttctattgggcactatgaaaaatgagagctaaaaatcatcaagtgtaaggcagaagaccagtcctagaggctgagttaactggcaaccacgagagagaagctgtgtgtgtcatagcatgagcacaggagtctggagcttttgcctgggcgtccatatgccatgtcttggaggctccgttgtgaattctgctttatgggtgagacaggaagtctctgagctgttgtaaacttcccacatcagccgggaatgtttccgatgtgtggatgagagggagctgcctatgggggacttcagtgaggagtcatagaatttggaggcagaggctgttccttcccatctttcctgaaaaaacttcctcatacacagtcctaaccaagtgacttcctgctctcatattatatatgagaggcccatattatatatggttacatgtataatatttgtataggtttatatttgtagttataaaacaagaaaacatatgacacaaaggcttttgcaatagacttgtggcaaatgctatacaaaatgtattaatagggtatctcttcctggtctatgatttacttaattttaagcatctcattattttctatagcacttagttccttgcaaacaacataacagataacaagaaagcttaatggctggatatgtgggtggttgagagacaggatgaataaatgtgaaaatgaaaaagaagggtgataattagagaacaaaaactagatgaagcaatagcataaattatagcattagatttcaaattacttttatgaattgagttagcttttagggaaaaatgcaataaaatgaagtttaatgacaggaaaattcacatgagtatttgcaagatagaaaaataaattctgcaaaatcaccatttatatgtaactgtgagtgaaaaatttatagataatagtgacttgcaagtgatctgggtaacagaatcatgcagaggatatgaaaacaaggatattgtcagcatccataaatatattttctggagaaaatgtttgtaaatatgatgaatatactctatatcttaatgggagaagaggaagaacccaaattttctcaaatcctactatgtactaggtgcagcagtgcttctagaaacatgactgggtacatattcatcacttggtattggcagcagttctatgaagcagagattatttgcagatatggaatctgggaattagaaatgaaagcaatgcctttaaaaatgcatagctcatgaggattaaaactcggaattcagctacagctctaccttactcacaagttcattctctttctaatagatcacatatagatttgctaatatctagtaattcaaaccaaattagcaacagcttccttggttccttcccatccttcaccctttacactcagtcaccaaatgccctctactctttctcctaaaaatatccccagatgtatttgttccattctaaactcatcgcatcatgtgtctagccactgtcttctttcctgcagacaaatataacagccttttaactcatttctttgcatccacttttgcctcatttcagttcattcactcttatgctattgcttcatctagtttttgttacatgacaaccagagtaatctggtaaaaattcatacatgatcacaggactcccttgcttctatgtcttccaattatttttggattaaagctggaaatctttaacatgacctataagacttccatgaactgcacctcaggttgctttattcatttcatgccacttttcatgctgttctgtatacatcgtggtgtttttccttcacttccccttttattgcagagcctgtgctattgtctcatgctggaagtaagcctcttcaccatctcacttctcttagctatgctttttctcttggcttttagttctcagctacttcctcagggactctgactttgacctactggtctcagttaaatccccttgctatgtgcttctgcaacactttgcacttctgtatttattttatcacattggtttttgctcatataaaactctgagaggagggttatggctgacttgattcccgttggattttcagagtccagggtggtttcttgtgagagatcaagtctcagttgatacatggtgatggctgtgatgagcattaaaactcaaaatagataaattaacaaggaaatttctcaagtgggcattctacctctcaaaattgtttgagtgcaatattaatgttggtgaaattacatttgggggatgtggtagaatcttcagacttggatgagtatatggctcgtggtagaccagatgactaccatgcctctctaacgtggaggtcccctgagaatctggtgagttaccagcaatccatgcctaaggaaatccactcttgtcccattattgtaaggacatgtgtatcagtataagttaatgctgaggaggagaaattatcaggggcacatatgatttttatttatgcatttgataataaattatttccacaaatatttattatataaatagtatgttcaaacatagtgcaaaacattgaataaatactggtgaggaagataagcaaggttgcttccctcacaaagcttagaatttgctgctttatttcacttcagacccaggtgtaatcagaagacattcatgcattggttggatggctatatgtggagtagctctgcacttggagaggtcaaatttacattcattaaaccattagaggtcaataataatagttgtgtgatctaaaatataattgccatgctaaaataacctcaagaaagagtagcatgtgctttacctcaccatgcccacagaaatatctaattgaaatattaaattgatttggattatctactctcttgagagagatggtataaaaattcattaattataattttatgtgcatgtaacaaacagtcttttttgttttcatggtttaggtacatgtcactgtggcaggtgtaagtgtgataattcagatggaagtggacttgtgtatggtaaattttgtgagtgtgacgatagagaatgcatagacgatgaaacagaagaaatatgtggaggtatgtatattggctctgtagaaattaataaaagtacctgtttttttcacctatttcattgttcttttatctctacataagtttctgctctaggtgtgctaatgtagtttaaacctatgtttatctggaaaacatttcacataaggagagtgagactatggcattaagagtagactagtactttttagatgcaaagccaaattgtccccagaggagagctgtgtcattatggcaacaggccaactgcatagctctgaagtagtcctagtagaataccatctcctctgctcaccttagtcacttttattttcctttctcctactctcttaagtgtacattttcatttctttgtttttccctttctaaaacatgagtctcatgtcctatcagggacaatgaaggtcaatagggttattagcctagagtttacctccccctctctgtccctaaacacttaaataacattttcaatgaccttttctgtgtaccaccattactcaattcatttttctgttgtagcagttcttgcatgtttgctagtgacaaattctgcaataagtgctttacattcattatgttttgtctcacaacatcactctaggctaagaattatgtttatctacatagatagatgtggaacctgggacgtggataaattaggtaacgaacccagggtcagtccaccaataatagtagaatttgggctcgtgtctgtgtgatgccaaagtctatgttcctgatgcctcaccactcacgactgcatcagtgccttagagctcagagctccacaagaggagtctctcctcaccacttgcagttttcatctcttctgctcaacctgcaagcctgtgcccagagttcccatttgcaaccttgactggtgtaggaaaagaaaagtagaaagcagagagaatcatttggtttaggtaaatttttctctgctctgaacttatatttcactcctatctcatgggattccagttgaaggaagactgccctgcgtgcagaaatggtagttttagaagtattgtttttctggaaggactagggcccaatggggccacgtggaaccagagaaccctgagaaactgtggctagcataggacaagcttgttcttttgtttacatttcggtagcttcaattcctgtgagtcatccaaatacacttattttaggcctgattggccctccctccttgatctcctggctgtacaaactacctggataaaacaaacaaacacaaaaaccttattttcatttttccgagccaatgacctaagcaagatgctgctcagacaattctttcttaaagggctcagtccaaaataattagatcaattagacaaatccatccacaaatatatgtgtttgtcctcttgatgtttagtttccaattattatagatgatgaaaaaaaaaaaaagaagaagacgggaacatgctttggggccagtgtgtgttgataaacaccacaaaagcagagtctatttgcatgtatcaatagaaaaatgtaacttgaaacaacacaacagaaaatgtttaactttcaaactttctagttgttatttccatttgtttgaggcttaagcaatttcatggtgcaaagtctctgaacaaggacaccagcactgcagtaaacaccctctgggggtgacattgcctgggattgtaaatctttccatgtgtcattcacatgaaaccaatctgctgagagatgattccacagttcatcagtgaagtagtacaaatagacattttcttgctctatcagtttgcacaaagcaaagaattatgtttattgtctggaatatgtattgtcctaaagcacacattttaatctcaattattcagatgtgtcttgttcaatatttttatttgagttatgtggatatttgtttaattttccatacctgcatagacgtgtattgttacataatttttgcttccttatttacctctaactcaaaggtttcttagtaaaaccctaattcagtactgaattgtataaatattcaaagaatttggatgtgagaaatatagattttctatcatttattaatatagtaatccttacttatgttgcaccttctgtataaattttctgaaattacagagaaaataaattccgtagtctaaaaaggtgattgggtcgtacaaacctgactcctaagaaaagcaattaatatacactattgcttttttttcagtgtaatccttgagttcttgaggcctgtgatatatcactaggatgtgatttgtgtgtgcaagtagacaccattttaagttcataaataagatatatagatgatatattctgtactgattaaatcacttgacagcctttgcatttgcttaagtaaacaaatttaaaattcaaattcattgtggaaatggtcattgatttttaggttaacaagtgattttctttgaatatcccaattataacttatttagacagagaacatggcattgggtccctgtctctttctctgtgtctcactatagcactctttctgttcatctctctggctctgtctctcagatgtgtatcttcttgatggaagtctcatctgctggacatgaatagcgtaggataccagaatattctgttgtacttcttgcttcttatgtgagttttacaggtcctattaatgttcttgccattggccagaaataccatagtgttagaatgataaatatgcttataagacaatgaaaagtagtctcataatcagttttgcattgtcttttggggagtttggctgtaagagaagagagatggaaagaacaaagactttagccatagactgataaaacacaaactcctataatacagaaagaatagactaaaaacaaaacaagaacaaggacatacatttatacttaggtgatataactacaaagatgagagtataagaagtaaaatttgggataaatgccatctttggggaatttgcagaaggattgctaggtgtggatgaggaaagcaatggtgcgataattcactacagatggcttggaggcaagtgcagatgagcaggtaacaggttacagagaggtgggagctgaaagagggcatctggacacaaaatggtgagtgcccttacctgtcatttgtatccccttgacaagtagaaagggaatttgattgcgtggccaagggcccatggtattttgtttgtctaaatgaggattaaacatggactaggctgaaaacctctctttcacatggtggaacacaacagcttgtggggcacagttgagtgaaaagatgaaatatttattctgctttaaagagttgtttggtcattcataatgtctatctaggtaaatatgcaccattggtttctcaatagttgatttcaaatgaaatattttaataactaattcaagaaacgtccttagagtgaatgctcatatatatttgggtttgatgtgtgcatttgagatggaaaagtaatagactgtcatggtcattcatgtcatttctttaaaaatacttttaatcagttccctgtctaggccaagttaaaggacactttgctctttttgtatgattaagcaggtataggcacaaccatgatgtgtttggagaaagctgtataatttgattattttaggcaaggaatgtggagctgtgacagtatttcagaaggcaaaaatgatcacaaagagatagaaagttaattctgcttatgaaagttgcttttttcctcactgtataaaattcattttgggtaaaggccatgggaagtgttactgtggaaactgctactgcaaggctggttggcatggagataaatgtgaattccagtgcgatatcaccccctgggaaagcaagcgaagatgcacgtctccagatggcaaaatctgcagtaacagaggtgtgtcattcatacatgttactacataatggggaggcaaacaaagcttttaattgttaacacttcttttctttgtatttcctctagtgtgggaggaagttatcttctaaccatttactttgatgtaaatcaacatttactatcccaacaatcttttctgtcttgttttttattgagtagaaaagagaaagataagaaagttgctgtcattctttaagcttcactgaataaacagttaacttagggactgtaatttctttggcagccctccagacatagcacagtgcagctaaaaggcaattcctttagatacttctgttaaatgtctcttgactaacagaaccatctacagcatgagcatctaattatccgtagagaattcagaaaaccctcttgtcttaattatgagtatatggaaggcttggttgaaatgcagatttgatatggactaatttaacttccgtgtgcaataataaaaatttgatattgaatacaatagatatacaaagtatgtatccaatagccataggaaatgtacactgactttacaaaggaagttaacaaatatattaatattgctaaactataatttaaaggtagttaactaacttttgatgtaaaatcaaacagtttaaacatagttttaaaattccttgaaaatacttaattttccctttgctgtagtgataaagagagccatactaaagttttcattgcctatccaatggcattaaaaagtgattatacttctttaaaactaaaaaaatctagatagctggaaaactttttttcatttctatacatgaataatgcattgcaatagataatgctaatacagaaatcgtagcataccacctgtcagaaattgacatagaggagtaaaatgtgccacatttctttacatagagaaaataaataaaaaggcaggaacttggaacaaaatcatgaagtcttcctttgtggggactaaatcttactatatatcatactaatttaccttatggtttctttttattatttattattattattatactttaagttctagggtgcattgcacaacgtgcatgtttgttacatatgtatacatgtgccatgttggtgtgctgcacccattaacttatcatttacattaggtatatctcctaatgcttcccctccccactacccccacatcacaacaggccccagtgtgtgatgttctccttcctgtgtccaatgtgttttctgcataagtccttttatgcagtaggggtcacagtcaccatttttaagtatatgaagcttgaactctggtactgtggaaaatgactatttggctgtcaaaaagagagaggtggaaaatggaattggttgggctgtggattaaggtcaggttctgcagcagagttacattggctgtgagagacgatgtccttcagaaacataagctaagccacctgcatcccacttcgctgtgcttggagcattctgacctggagctatggcagaggcagaatgggaagcagcttgcctgagcgaggctcacagcttctgagattcaggggtacttgaagacagggcagaagtgggcgctgagatgagtcatttttttttctcaaaagataatactcctgactaccctgaaagcatttctgcatcattgcatccataggtaatagaaacacactggtccctgcacatacctatcttgtcttcctttttccccatcttcaggggccaaaaaaccaatgttgcagacataagcattaatagaacaaatgtcctctattgcccatctgttttattgagtttcatagtggacccctttacacgtggctgagaagctgcttcttcgtcacatctgcatagctcctagtccctgttcctcctgaccaaactcatttatcctattatgagagcaatgcatattcattttttaaaatctagataataaagtagagtacacagaaaaataagaaagtgacccataaacctaacttccaggtgtaacctccttttacattttggtacatgagctttcagtccgtatttatttattaaaattcatttttatggctgccctatccctgtatttccttcttattaaagaaaaaaaatcaaatcatactgcacgtgctgatttgtaattttacagttttatttcatgatatatgttgtttatctttccatatttatggggcaaaaacctaatttattacttagtgattgctaggtagtccatatgtgtgtaccattactgcgctaattccccattgaacaatatttcggtcactagtaatttttcaaaaacataaatacaactatattttatatttctgaacatacacttgtgtgtactttttctttctgttgggtacattaattaaagtgagctataagtctgaataataacacagatataaaaagtacatattgcaaaatcgctacccagaaagttgtaccatttcgtactccccttcagggcaagaaagtacccattgtcccacacctttaccgagtctggatccaacaatattttccacctctgacgatctgacttctaaaataattgccaatcacgattattttgaagatctgccactgctacccacttagtagtggttgattgagtgataaacatttttcatctttatctgtcattatttctgtatgaaatttccttttgttctttccttttgtctatttcactttgggcatattaatcctttatatattcaattctatgatttatttatatgtttttgaaattgttctttgtcttttacagacatattaactacttgtttcagctttgtcagtcttttttttacagtgttttgtttccaaccaaaattttcaatttttatggaaattttcaatttccttttttagtaattgtgctttggggtcttgaataaaaagagtttagttcatattatacagttttattttgtacgtttaaatctttaatccaactggtacttattttgatgtaagaggtaagaaaaggatttaactttatgtctctatcaaatgattagctggttgccctaaagacagttactgataatccacacagagtaaacatgatgtacagctgggcatttccctctgcaaatctgcaaatgaccaagtttatgtctctcaatctgatctccaacattctctataatctgggctcatctgatctagcaaaccttacttcttagtcttttttattttttaacatgcacctcagggtccctatgcccatccctacccttctttgctcagtctttttttcttgactttctcttagttctacctccaatgtctcctagaacatttcctctaatccctatatatccaatccatccactgctaattactccaacactcattgatcctctttctccaaattcttagagcattcatgtcttagtttacaaaatatttgcacattgtttttagtgtttgttaatttttctttctaattagctttctatttgccaaatagattgcaagcttcttgggggaaaggattatatcttatataaattgttttagtgttatctttgaaggaaactaacataatactaatgacacattccaccaactcacataattatagaatagataataacttttgtttattaaggaatctctattatcaatattagatggtgtttttcctttttagaatatttttgtctgaatatatgtgtttttttcaaacacaaagtaaacagaaaataataagcgatatgtgaaatgctttctttcatggtttttcttgactggattcttataaaattcttcttcccacctagggacttgtgtatgtggtgaatgtacctgtcacgatgttgatccgactggggactggggagatattcatggggacacctgtgaatgtgatgagagggactgtagagctgtctatgaccgatattctgatgacttctgttcaggtaagggctcttccaattcctgtttttctggagggggaggtggggcttgttaatgggtaaaaaaaaaaaaaaagcaattagaaagaataaataagacatactgttggatagcacaatagggtgactatagtcaataacttaattgtacatttttaaataatgtaaagagtataattggattgtttgtaacacaaaggataaatgcttggaggggatggataccccattctccatgatgtacttatttcacattgcatgcccgtatcaaaacatcccatgtaccccataaacatatgcatctactatgtacccacaaaaatttaaaaagtaatgaataaaaaataaaaatgcatatttccctgttttcaagatttctgattctcacataccctgtaaaagaaactgaatgtgtattctaaagcatcttatatttgcagtgctcctactggtaacttggaaaacctccagagaattcccaaagttggcaaagactagagatgagagggcacccactcttttaaagttagtctaattcctcacccaggagaaccattagctctagatagctactcagttcaactctgagactacaaaactagcagagctgttgacaatgaacaggatagttatcattagggcacctatattaatgtattacaaaacaggataatacagtgctcagggttattttgtgcattaactctttgataggctttaatgttattctgcaatgtagtctgtaattaaatatcaattagtagattcaaaaatctttgactgtaaatactgtggggcagatactgtctgttagggactgagtgacatctgggctactggtgtagtaggagccagtaggggacaggagacagccatgaactttgacttcatggagtttgcaatctaaatgcaaataaataaaatatgtaagtccaggatgtctaatagtgcaaagaaaaagaaagcagtcagaagtctatctgaaaaggtatcatttagcaaaaatggagttatagattttcagtccagttctatttgataacccataaggtagacacatacacatatacatcttgctaagcttgactgcctcattggtgcatgcagatggatagaaactcctctggtctcctgaaagtttgccagcaaagggagataaaagaactgtcccatttaattatgagtgtgcaacttcaaaggcttctccagactgactggggaaagcctgctgctaaatcttcccattgcagaagggtttccctcttctgataatctcttgtgctccagaggatttcctaaacattttgtgaacactattctcttgagggtatttttttctattattaattatacatgctcatgttcttcattatcattgctgtcaacacagtggtaataaaagagctcatgactagtgagtggcttctgtgttccaaagagatgatgagaatagtggggaagaggcctgttggagattttaattaggatgatgtggctcttcacagtggtggtgatgtagggctcatgaattgcaggaggctattggatcacagtgcatgtgggttttatcctaaaaaaaataggcttgcaggtaaagaaagatgagaggggcattccaagcagaaggaacagagggatagaatctgtgtataggaccagactcagtttgaaattaccagaatgcagaattaaggaagcatgtggtaaaaggtaaagttggttgagaaacaagaactggggggctttttaccttcctgcagacccaggttttattctaaaggcaatgaggagctaatgatggttttaggcaatagagtgctgtcatcaccagatttctagtctgagtgtctgggaaaatgttggtgccatttactgaaatagggaatatggaaggaagctgtcaagtttgtttctagacatctccagcatagagggcaaagggtaagccaaagtttatattttttcccagcctgttgaatatgtgagtcagggtcagggttaaaccaagagaatttcaagttgtaagcatagagttggtggttaaaactatgctggcattcaggaaatgccatttgacaatatcattttcttttttgagatggagtctccctctgttgcccaggctggagtgcagtggcatgatctcagctcactgcgagctccacctcccaggttcacaccattctcctgcctcagcctcccgagcagctggggctacaggtgcccaccaccacgcccggcttatttttttgtatttttagtagagaagggtttcactgtgttagccaggatggtctcaatctcctgaccttgtgatccgccagcctcggcctcccaaagtgctgggattacaggtgtgagccacctcccccggcggcaatgtcattttaagattgcttttgagataaacatgatttgacacaatttaaaataagaaaataagggaggcatataaaaggcagtattttaaaattgtaagtgtgtgacttgctgatatggagcccctttttcctatgggtattcactctcttgtgaaatccataattctgatgttgatcctgattttggactggggttgaaaaattcaaactaactacattatagcgataattcagggtcctgtgagccagtccatctcactgtgagggagtggggtcatggggtaaagatgggtgatcactcctgaactgacacttcaatcctcgtgtaagcttgtgtgcaattcccgcagcgtgtcatttagtcttggagtgcttactctaggctgagcaggtgaagtgtcattaaggaggctgcactggaatctaattttccacctcacctattcccctccaacccctcttccctgttttcctttttctcacattttcctttctttcataccctatgagattccacacagtgggtatggacaggtaggggtaggaagaggtgatggcacaattggctgtagtttgaacaagaaaacatcaatctattattgtgattttatgattcgctggttgaagtgaattgaacatggccagctttccacagcttggctcccacacttagaatgaggaattgaggaaagaggaagaaactcatatttacagagactctactctattggacccttgctgagttcttttataaacctcattccattttatgtacacactaactcagagagggaggcattattgtctatagtttagcagaagagaaaatacattcagagaaattaagtaacttgataaagttcacactgccataaaagtgtcatctgaaaacacatatagcctgactactcatgtaacttaatctccaggtgatgcaaatacaattctccagttttactttatttttctgaggaagaactgtcctctgggtactcagatttttttaaaataaaactaagcttctctgaacatcattacaatctggagcagacatcaacctctgcagtatttcatcattcttacagaatctgtagaattctatatactgtatggtattatgcttattagtctttaaatttttcctaattaacagtctaagttgcagtgtaagaagagtgccatatagttgattattgagtatattaatacctttgtgttatgagacagaagtaacccaatgacatcaatattctctagtctttcatgcaagactagaacataataaggctctgatgaaatgaagttttatttttagctcctattcttgccatcctgagagttttggtcttatttaagtccaagggaagtctctggacggattagtttaagttagctcttttaattgacattctcattttattcattcatttccattctctccatttatctgttcaataatgcatttaaatgtaaatattttatgcctaacacatcatgaatatagggaacacaaatatgttgaaacatggtccctgcacccaccaaataaatcaattttatttacttcttttaatcctgtctgttgttcatcatccacaaaatatgtgtgtttgtgtatgttcatttgcccatacaccaacatgactgttatactacacacatacacgcacccctcaaagacaatacggttgacacaatttgagtgtgactgaaatgatcagggcatgaatgggcatcctgacgtgtcccgactgtcctgtttgttacacccaatttactttctgattctaatataactgctttattcctaatggccgcttaccactcaggtctatttacccaaatcccataattggaaaaatacgctgcaatgtgaccttaaactttatcgttcagctttccctgcctaagaaaattatgaaaatatagggaaagttttggcttagagttacattagtttggaaaatggaatattttgatagaaccatattatgtggtgaaatttgtccctgtggattgtcaaagcattaagaaagaaactaaaggaaatgattaagtatatccagaccacattttcttgaaaggaaaaattaatatattgaatttaaaaaaaatagcaagtactacctagatctaagttattccccaaagcttttctctattgatggtcttcatgttactttgtaaacatgttaacagacgattcaaattcacaggcattttttgatcctttaaaaagaaagaagtatcctctaaagcagagaagtgtttgtctggaatagatgcaactgcacttgtgctgaaacacctgcacctgtttctggagtttggatagcataactccaaagaacacaatagttacaaataaacaagaaaaagtttagttaacaccctttcctataatggcctgagaaccttaataattcctgccttcccagcatggcctttggaccactcaatggctgctcttgctgcaaatcttccttttcgtatgggtattttgggctgcagtcatttttatggtaggtagattataccaacaccaagcactgtattcttccattgtgtgtgtgtgtgtgtgcatgtgtgtgtacatacagagagatctttagagagcatttctcttatttgaattcttctgatgttcgatatcaagacaaacagcaccatgccgaatctttcatctctatttcattgatcttctgcctacacagtttaaaggaatactggttagaagtaatgaaactaaaacctgcaggcttaacatacacataaatttgacaaaccagcatggaagcattgcatttcagatccatgtggcaaattgatctttttttagttctgtcatttgaaagataaagcaatttgagataaggcccagaaaagatagtggcacatcagatgaaggacacaagtctcctgatttcttcttttatgaccttttcactatttgtctattaaaaaaaaaaaaaacctgatgtaatgttatggcagtctaaagggttttcatgctaaatagataccattatctctaaactcttctatatagcaaaacccaacattttcatcttcttgactttatctctaccaaatgattccttctttggcataacttttaaaattggaattgagaaactggtaaattcacaagaaaagttgcaattttgttttataattttctgtcttatctgaaaagcccaatacctgcctgagaatctggtaccaacacctgatatttctaagtgatttttaaactctaccagttaaatatcacaaaggattttgtaggacatgtacagtttcacttaaagtggtatctctaatattctaaaatatattttgacagcacatgactaacttcttgaaatatgtagtatataatttttattactgaaaaagcaaaagttatgtttctgtttcaactctgtcaattaatctgtaataaacatttaaattaggcaataccattgtcgatactatttttattatggtaggctagaattatagaaagtttatccatgcacttttatgcttgcttcttctatgatatacagtaagatatcttgtttagaaaattctactttccccaaacaataaaaccagttctactctccccagacaataaaaccatcaaacactttctgtgccactattttgtcacttaaactggtgaccatacattcgctgactttcaggaacttcattctttatggatggcttatgtatgtcactcatatttaaatacctcttctttccttagcttgaacttgttcaattaatatcaaatcctggtggtaaagcatagaagacatatcagtggatgatttgaggaggaacattggccatcttgaactaaacaatgttctcccactttgatactttcctgtttagggctaaggtcttttatccttcagccaatcacagcaatgatacaatctcttaaattcatcccaatgtgcaagcaattggctgcaggtgtgttattgagaagattattgaggagtcatcacacacatgccaaagtaaggacacatatatattcttcccagctttgcttatagttggcaatgcctggaggtgaagcacgcatttagaagcatgatcctggagaatgttcatgatgttgcattaagtacacaggaaaagaggtgtgggagcttataggctgtattttccccctcatgtttgtagaagagcatcagaaatagcaatgggatataaaaataaagctgcaataatagaattatgttaggggaaaaaggttgagagaattaaaaactgagaaaaataaaatgataagaaaacagaacgtgcctatgggagaataaaggtgaaagaccgccaaagatttcttcctgcaggtctagagcatctgaacttaaaaaacgaaaaattattaaggcttccacagctaatctggcttttgttactaattggataggattccaactttaaaaatctcttttgaataacttctgcctttaggatttgttttattctgccacatgtttttaaagatgtcaacatgtgaatggatttcagataggaaaaaatggttgcttttaaacatggattccgactatgcaacttaagaacgttctcccttcagtcgtgtgtctccctttgtacctgcctttatccccaaggtttctattttattttccctccccagggagggaatcctcctgtggggcacgtcactgcttgtgaattcaggtgggccttagtggcagatgacattctcttgggcagttagggacttcctgggtcccgcatcggctagatgtattgttctaaccttcacagccattaaactttcaagagtggagaaactttttctccctcttcaatctggttttcaatgttattgttaaagtgtcaacaagcaatgttattgttccagtgtcaacaagtctctcgcaaatgtcagcatgttctgtactttgcccagtttcctcacaacagatctgtcgctgaaataaaaccacttgtctccaagaatttcaaagccattggctcctgtgaaacaacagaattgactgtactttaaatgtgaaatatttatgtgttaaaatcattatttatataggcatttccaatgtagatctgtttgcaatgtttgtccttaaccttacatgagggctggaaataaagaaagataggaacttctttgttttgttttttttgagttggaatttccctgtgtcacacaggctggcgtgcagtggcacagtctcggctcactgcaacctccgcctcctgggttcaagcaattctcctgcctagcctcccaagtagctgaaactacaggcatttgccaccatgcccagctaatttttgtatttttagtagagatggggtttcaccatgttggccaggctggtcttgaactcctgaactcaggttatctacctgccttggccttccaaagtgctgggattatgggcgtgagtcaccacgtccgatgggaacttcttaaactgagatgaatgaatggcaaaagccatagaacccaacaacctatgaaatataattgttaataagcataaaccgttacaaaaattcccatactgtaaagtctaatcatattcatatgtcatgtatgtttattaataataacaattttcttttcctttcaactgaggtctagaacagataattatggcaacaatttgtcaaatagactctgttacatagcagatgatcaacaaatgagcatctgaattgaattgaatttgggattaaatgagagatttaaattcagtgatccctaatgtctcattccactttgatttatgattttgtgattttttttttactaaaaattagttaaatggtgaaaagcttctacatatgtgtattgtccagtttcttcaaattcagaagatggaaccgcaaacctcaaggaatattagtaaaatggtctagtctttactggaggccaattttcatattggatgatatacattaatatcagatgctaaagacagcatgcattttcatccattagcatttctatgtacttttaaaaagtgtaattccacttttaaaattcttcatgcatttttgcagcaattatagaaatctactttgttctgtatctgcggtgatgagtagcttcatgtttattaggaattatggaaagctcagttgaaactatgctttcctctacttgcttataatgtgggaactgatgaatacaaaaaccagtagctcctttttatgtagcttttaaactatttaatgtacttccgaagaaatgtggattgataatatattttcttcctttttaaaatgaagaaactgaaactcagatgtggtcatttgaccagccccactctgtaggaagcagaatcaggatttgaacccattattttattgataatgtaggtcgatttttgctaaaccacaccgtttctcacaattctttgcaaactgtatattcatgtgttgaaaaatttaatatcttttctgacttctttggaatacactaggctaatcttcaaggattgtaaactccatgtaggttactggttttactctaagggtctccaggctaaacatgtagtatttgcttaaaaagtgcatgaaaataaagtgtggagactccataagataacattctgcttcggtgaagtaaccaaaacagaaattaagaaaacaattttatctgcggtcgtgtcaaaaataatatacttaggaataaaattaaccaaggatgtgaaagattattgcaccaaaaactgtaaaacattgatgagagaaattgaagacacaaataaatggaaagatatctcatgatcatggatcagaaaaatgaatattgtcaaaatattcacactacctaaggtgatctacagattcgttgcaattcctatcaaaagtcccatgactgacacccaactgattttcaacaaaagtgctaagaacacacattggaaaaaagataatattttcaataaatggtgctggagaaattggatatccatatgcagaagaatgagattaaatcactacttctcatgatatacaaaaatcaactgaaaatgcattaaagtcttaaatgtaaaacccaaagctacaaaattactagaagaaaacataggatagtactttactgtgggcaagaatttttaaaataagacctcaaaagcaaagcaacaaaaacaaatagataaatggaaggacatcaaactgacaagcttttgatcaacaaaggaagcaactaaaagaatgacaaatagacctacataatgggagaaaatagttgcaaactatatatctgacaaaggattaatattaagaatacatagggaacttaacagcaagaaaacaacccaagtaaaaataggcaaaatacattaataaatattgctcaaaagaagacattcagatgtccaacaggtatatgaagatatgatcaagatcactaattgtcagggaaatgcaaatcaactccacagtgagatacctcttcactccagttagaatcggttttattatagaattataataaaaaaagacaaaagaaaacaaatgttggcaagggaggtagagaagagaacactgacacactgtgggtgaaaatgtaaattagtatagtcactatggaaaactgtatggaggttcctccaaaaattaaaaatagagctgtgatatgcatataattcagtaatttcactactagatatatatccaaaagaagtgaaatcaatatgtcaaagatatatctgtacccctttattgcagcactatttacagtagtcaagatatggaatcaacccaagtggccattaacagatgaatggataaaaaattgtggtatatatacacaatggataattctgccataaaaagaaagaaatcctgtcatttgcaacaatatgaatggaactggaggtcatcatgttaggttaaataaggcacagaaagaccttatttcaaaacctaaaaaattggaatctaaaaataaaattgaaatcatagaagcagagagtttaaaatgtggttaccagagacgggaggaggaagatgggaggatagggaaaggttggtctgtggtccaagttacaatcagatagcaggaataagttcaacttctattatacagtaggttgaggacagttaacagtaagatatggcatattataattagaaaataattagataagcttttgaatgcccttaccacaaatgataaatgcataaggtgatcatcatgtgaaataccctaatttgatcataatgcaacctatatatgtatcaaaacatctgattctaccccataaatatgtacatataataatttttaacctctcctagcatttttaatagtaataacaaaaaaatcttaaaattcacatggaaccacaatataccccaaataactaaagcaatcttcagcaagaacaaagctgaaggcaccatagctcttgatttcaaattatattacaaaactatagtaattaaaacagtatggtactaacacaaaaacagacacatagaccagtggaacagaatagacagcatagaaataaacccatacatttatagccaattgactttaaacaaagatgacaagaacacacaatagggaaaagacagtttattcgataaatggtgttgggacaactggatgtccacatgcagaagaaagaaattagagtcttatctcatactgtatataaaaatcaactcaaaatgaattaaagacttatatgtaaaacctgaaattttaaaactactcgaagaaacgtaggagaaaagctccatgccattggtcttagcaatgatttttttttggatataacaccagaacacagacaacaaaaacaaaaataaatgagtgggactgcattgaactaaaacgtttctacagcagcaaaggaaacaacagaaatgaaaaggcaacttctggaatgagagaaaatatttgcaaaccatatatccaataaggggttaatattcaaaatatatgagttctagtccatttttgcattgctacaaagaaatacctgaggctgggtaatttataaagaaaataaatttattttgggccaggcacatggtggctcatgcctgtaatcccagcactttgggaggccgaggtgggcaaatcagttgaggaaaggagttgtagacaagtttgaccaacatggtaaaaccccgtctctactaaaaatacaaaaattagccgggcgtgttgacgcacacctgtagtcccaactactggggagggtaagacatgagaatcacttgaacctgggagttggagattgcagtgaaccgagattgtgccactgcactccagcctgggcaatagagtgagactgtgtctcaaaaaagtaaataaataactaaaaccaaaaaaccaaaaacaggtctattttgactcacatttctgcagtctgtacaggaagcatgccaccagcttctgttcctggtgaggtctcaggaagcttctgatcatggctgaaagtggaggcagagctagtgcatcacatggcgagagagaggaagacagagggaacaaaagaggttgggaggaggcgccacactcttttaaacaatcagatcttacgtgaactaccagagcaggaactccctcatcagcaaaaggacagcattaagccattcattagggatctgcccccatagtcaaaacacctcccaccaggccccatctctagttttggggattgcatttccacgtgagatttggagaggacaaacgttgaaactatatctaactcatacaactcaatagcaaaaaaaatcaaacaaccagattaaaaaaatgggcaaatgacctgaatagacatttttccaaagaagatatgcaaatggccagtgggtatatgaaaaaagtgcttaacatcactaatagggaaatgcaaatcaaaaccacaatgaaatatgacctcacaactgttaggatggctgttatcaaaaagtcaaaagatagatgttggcagggttgtggagaaaaggaaaacttccatgttgttggtgaggatgtaaattgatacagccattatggacgatactatggagtttccttaaaaaatcaaaaagagaattatatgatctaggaatttctggatttatgtacaaaggaaattaaatcactatcttgaagagctgtctgcactcccatggtcactgcagcattactcctaataaccaagatatgaaaacaacacaagtgtctgttgtaagatgaatgggtaaagaaaatgtgagatatatatctatatatgtaacatgatgttttgatatgcatatgcataatatgcatatatttacatatgtgtgtgtgtgtatatatatatctatatatacacaaatacccagtggaatagtattcgtcctttaagaaggaaatcctttcatttgccacaacatggatgaacctggaggacattctgctaagtaaaataagccagacatagacaaaaaaacactgcacgatctcactcatatgtggaatctaaaaacgttgaactcttagaaatagagtagaagggtggttacccagggccaaggggtaggagaaatggggagactttgcatacaaactttcaaagttataagatgaatacgttctggagatctaatgtacagcatggttactatagtttgtaatactgtctacttgcattgtatgaggagagtacatcttagatattcccactgcacatagacacacacacaaagttaactgtgtgaggtgatggatatgtttattatcttggttgtggtaatcatttcacaatgcatatgcatatctaaacatcatgttacatactttaagaatctacaattttttggtcacttatacctcaataaatcttggggaagaaaagagcgacctcttctgaattctagatttcatgctttttgtcagttcatggcccccagtttgaccgtggttgtgagaccttaataaatagcgatccattaaatggttaatttaaaaaaatcctgctctgaataatattccattctttggatataccacagtttatttatccatagaggaatcttagatgcatattaccaactgaaaaaaaaactgaaaggactacatatactgtatgactccaactatataacattaaggaaaaggcaaaattatggaggacagtgaaaagatcaggttgtcagggattggggaaaggtgtgggagagggacggatgactaggcagatcacagagggttttcagggcagtgaaattactgtgtatgagtagtgaattcatgtcactatatgtttactcacactcatacaatgtacactaagagtggaccctaatgtcaactattcactttgggtaatagtgatgtgtcaatgtacgctcatcagttacagcaagtgtacttctctggtgggaattgttgataatggagaaggctatgcacgtgagggagaaggaggtatatggaatatctccgcatctctctcagttttgctgtgcacctaaaactgctctaaaaagaaaacagtcttaaaagaatatgtactctctctgatattgtttgttagcgtgctctataaatgttaattatgtctactgggctgttaatgtcaacttttctatatccatactgattttaatttcactaattgcattaattactgagaaaggagcgtttatatattaaaaagtagtctaaaaagcaaaaaaaaaaaaaaaaaaaatcctgcttcaaaaatacagttagtccttccctgtgactcccctccatgcaaattaattgccaaatccaccaaatactcctttccgttttttctttttttgttgttttttttgtttttttgttttttttgagacggagtctccctctgtcgctcaggctggagtgcagtggcatgaacctggcttgctgcaatgtctgcccccctgggttcaagtgactctcctgcctcagccccctaagtagctgggattacaggtgcacgccaccatgcctggctaattttcatatttttagtagagaccggggtttcaccatgttcgtcaggctggtctcaaactcctgacctcgtgatcttccctcctcgccctcccaaagtgctgggattatagacatgagccacagcgcccggcccaaatactcctttaaggccccagcaaaccaatacaatcacatgcacctggaatttgacagcttgaagtttatagccttactaaactgtttatcttatctgttgcttttctctacccctcaagatcaattcatataagtcagttatttaagaatttgagaaaaatgtgcgtttgccttaatatgttatattatgttcatcaagatcctgactcatttgtgacatttgctgttagaatgaaaactaattccaacttcattatctttatgtacatttttattttttgccactctcactgtgaaggtcatggacagtgtaattgcggaagatgtgactgcaaagcaggctggtatgggaagaagtgtgagcacccacagtcctgcacgctgtcagctgaggagagcatcaggaagtgccagggaagctcggatctgccttgctctgggaggggtaagtgaggtctctcagggcttcccacggcctctccatcacaattcaaatgaattcaatgcacacacatctttttgtttgtttgtttgttttttgttttctgctttttggtttttttgttttttatttttttattttattttttattattatattttaagttttagtgtacatgtgcgcaatgtgcaggtttgttacatatgtatacatgtgccatgatgatgtgctgcatgcattaactggtcatttagcattaggtatatctcctaatgctatccctccccgctgcccccaccacacaacagtccccagtgtgtgatgttccccttcctgtgaccatgtgttctcattgttcaattcccacctatgagtgagaatatgccgtgtttggttttttgtccttgcaatagtttgctgagaatgatggtttccagtttcatccatgtccctacaaaggacatgaactcatccttttttatggctgcacagtattccatgctgtatatgtgccatatttccttaatccagtctatcattgttggacatttgagttggttccaagtctttgctattgtgaatagtgccgcaataaacatacgtgtgcatgtgtctttatagcagcatgatttataatcccctgggtatatgcccagtaatgggatggctgagtcaaatggtatttctagttctagatccctgaggaattgtcacaccgacttccacaaaggttgaactagtttacagtcccaccaacagtgtaaaagtgttcctatttctccatatcatctccagcacctgttgtttcctgactttttaatgattgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttctcagatgagtaggttgcaaaaattttctcccattctgtaggttgcctgttcactctgatggtggtttcttttgctgtgcagaagctctttagtttaattagatcccatttgtcaattttgacttttgttgccattgcttttggtgttttagacatgaagtccttgcccatgcctatgtcctgaatggtattgcctaggttttcttctagggtttttatggttttaggtctgacatgtaagtctttaatccatcttgaattaatttttgtataaggtgtaaggaagggatccagtttcagctttctacatatggctagccagttttcccagcaccatttattaaatagggaatcctttccccatttcttctttttgtcaggtttgtcaaagatcaaatagttgtagatatgcggcattatttctgagggctctgttctgttccattgatctatatctctgttttggtaccagtaccatgctgttttggttactgtagccttgtagtatagtttgaagtcaggttgcgtgatgcctccagctttgttcttttggcttaggattgacttggcaatgtgggctcttttttggttccatatgaactttaaagtagttttttccaattctgtgaagaaagtcattggtagattgatggcgatggcattgaatctgtaaagtaccttgggcagtatggccattttcacgatattgattcttcctatccatgagcatggaatgttctttcatttgtttgtatgctcttttatttcattgagcagtggtttgtagttctccttgaagaggtccttcacatcccttgtaagttggattgctaggtattttattctctttgaagcaattgtgaatgggagttcactcatgatttggctctctgtttgtctgttgttggtgtataagaatgcttgtgatttttgcacattgattttgtatcctgagactttgctgaagttgcctatcagcttaaggagattttgggctgagacaatggggttttctagatatacaatcatgtcatctgcaaacagggacaatttgacttcctcttttcctaattgaatgccgtttattcccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacatcccatcaatacctaatttattgagagtttttagcatgaagggttgttgaattttgtcaaaggccttttctgcatgtattgagataatcatgtgatttttgtctttggttctgtttatatgctggattacagttattgatttgcatatgttgtaccagccttgcatcccagggatgaagcccacttgatcatagtggataagctttttgatgtgttgctggtttcggtttgccagtatttgattgaggatttttgcattgatgttcatcagggatattggtctaaaattctctttttttgttgtgtctctgccaggctttggtatcaggatgatgctgacctcataaaatgagttagggaggattccctctttttctattgattggaatagtttcagaaggaatggtaccagctcctccttgtacctctggtagaattcggctgtgaatccatctagtcgtggactgtgtttggttggtaagctattattgcctcaatttcagagcctgttattggtctattcagagattcaacttcttcctggtttagtcttgggagagtgtatgtgttgaggaaatttatccatttcttctagattttctagtttatttgcgtagaggtgtttatagtattctctgatggtagtttgtatttctgtgggattggtggtgatatcccctttgtcattttttattgagtctatttgattcttctctcttttcttctttattagtcttgctaccggtctatcaattttgttgaacttttcaaaaaaccagctcctggattcattgattttttgaagggttttttgtgtctctatttccttcagttctgctctgatcttagttatttcctgctttctgctagcttttgagtgtgtttgctcttgcttctctagttcttttaattgtgatgttaggttgtcaattttagatctttcctgctttctcttgtgggcatttagtgctataaatttccctctacacactgctttgaatgtgtcccagagattctggtatgttgtgtctttgttctcattggtttcaaagaacatctttatttcttccttcatttcgttatgtacccagtattcattcaggagcaggttgttctgtttccatgtagttgagtggttttgagtgagtttcttaatcctgagttctagtttgattgcactgtggtctgagagacagtttgatataatttctgttcttttacatttgctgaggagtgctttacttccaagtatgtggtcaattttggaataggtgtggtctggaatgcacacacatcttaatttaaaaaacagctgagatccctgaatgaggggctattagtctttttagaactaataataaatccaatttccatgaatgaaagtacatggagaaatatgattctctttctctctttatatatatcttttgcacacagacactctcactcactgtcaggctactttagccttaaggtatgttcaatttcagttcagttcagttcaatgttacattaaaaaacacagtttagacgtttgcttaaagttttctgaatgagaccatctaattgtccactgacatttatgaaacccagtaacattattttgaggacagtgttggcttttgaaaattcattgtataaacaaatagctatgaataagcttttgtcatttgagaaggaaggcatgtagcctcaggtgtgttcttggtatcagatcagtacaaattggagaaggacaaattcatctagaagaacacgtgttccattcctcttgatttatcaaaataagaaatgcaatttcacttcccacatgagaataacaaagttaatatgaaatatgcttttgaagaagtcgtaattgacattattaccaattttgttcaagaaaggaaacaaagactttcttcacttgaacattagatcagaaatttaattttatgttgcgtttttcttttttaaaaaatatatgttaatagagatataattcacataccacaaaattcacataccactcagtattttgatatattaacataattatgcagccatcaccactgtccagttccaaaaaaaaagtttatcatcataaaataccctgttaccctatagcagccactccccattctcttgtcccagaacccctggaaaccaccaatctactttgtctctatggacttgtctattctgagtattccatacaaatggaatcataaaatatgtgatcttctcgcatctggcttttttcacttagcataagtgtttgcaaggtttatcaaagttgtagcatatgtcagtccttcattgctttttatggctgaataatatcctgttgtatggatacaccaccgttatttaacccttcatcagttaatgggcatttggacataggatttctactttttggtcgttatgaataatgctgctacaaacattcctgtgcgactttttgggtggacatgtcttttaatttctttggggtctgtatctgtgagtggaattgctgggtcatagagtgactctgttttaccttttgaggtagcacaggaccgtcttcaaaatgacaataccattttacattccaccagcagcgtgtggagtttccagtttgtccacatccttgccatttcttggtattgtctgtctttttgattctttagagtattctttataaagaaaactccataaagtgtctcaggttgtttgcagcacagatattttctcatatccattattttcccctaagggttgtaagtagaagagtggaggagtaggatatgggtataataatctttttaatgtcaaaagtatttttgactagccctgtatttcaccagtaaccccagacaggaaccattgttctatctgcattggaatattgtcattatagtgctgcataagccatcatgcttttaaagtaacaaagattgaaattcatatccctcagactgcttagttaccaacacttgtaatctacagcaaaaaataattttacattattattttacatttacacaaagctttatctgttgggcccagacatgtaaaaaaaatgaccataggaaggctaaccactgtctcttttttaaaaaaaatgtgtgtgtattttcaaaaatgtattataatcctagggacaattccatttcaaattaaaaaccttgggaagtaaagaaaatgacttcatctcaaaaatagatttttgatcttgaggatactttttcagttacatttaagttagagaactttaggtacagtgatttttactgttatcttaaagtggtaaacaaagcaaagggtgatctgatatcttaaaacattatttaaagggtttacatttggtaaaattatttaaactccaaatggttatgttgctagtagaagtaaacagaacagaaaccaatagggatatgcacttatattttaaaacaaagaaatgaacaaaatgtatacttttaacaaatgcttttatattttgaagttaaaaatgtcaaaccatataatagaaagataagaaaagcatacaaaatagctctcaaacagagaaaatcactgtaagtatatacttatagcaatggtttttcatttgtctctaaattttttaatatgtagaacaagtaaaatgaaattattggggacttaatatattgatcttttataaactccactaggtttttcctcaaacatgcatgtttcctgtctttctggagattcactaacttatttagctaccattttttaagcaatagagtatgtttaaactttattttattaaaaaggtgttgagtaaatgtatagaattatgatttttaaaattgtttataattcatttcagcctcttgaagtactttaaaactaaataagcttcatcagtttccttacatgagcaaagtaattttgcagggaatcatgacagtatgtaagatttttgaaaacgaaaaccaagaatttatgacagccagttgagtgcctttggtcaaggtcacggaccctttctttctcatagtgctacatctgcaaacacattggtactggatgttttgaagcaaatgaccagtatgaaaacttgtaaagagttcgttttgcaatttatgaatgaaaactgcagctgtggttacatgagttaggaaagcaattataagacccatcagtttctcaatcctgacagccgccatcacctcaccagctggaaaaaaaaatcctagaagaatatactgaagtttgtcagggaccaggtgaaggcaatatatatatatatatatatatatatatatatatatatatatacacacacacccacatatatatgtgcatatatgtgtgtatatatacgcatgtatatatgtgtacatgtgtatatgtatatatacatatatgcgtacatgtgtatatgtatatatacatatatgcgtatatgtgtatatgtatatatacatatacgcatatatgtgtatatgtgtatatgtgtatatacatatatgcgtatatgtgtatatgtgtatatatgtatatgtgtaaatatacatgtgtatatgtgtatatatacatatgtgtgtgtatatgcgtatatatgcacatatagacataggcatgtgtgtatatgcgtatatatacacatatagacataggcatgtgtgtatatgcgtatatatacacatatagacataggcatgtgtgtatatgcgtatatatacacatatataggcatgtatatatgcatatgcgtatatatatacacatatctagacatgtatgtgtgcatatgcgtatatatacacatatatgggcatgtatgtgtgtatatgcgtatatatacacatatatagacatatgtatatgcgtatatatacacatatatagacatatgtatatgcgtatatatacacatatatagacatgtatatgcgtatatatacacatcatagacatatgtatatgcgtatatatacacgtatttagacatatgtatatgcgtatatatacacgtatttagacacgtacgtgtgtatatgcgtatatatatacacgtatgtagacatgtatgtgtgtatgcgtatgcacgtatgtagacatgtatgtgtttatgcgtatacacgtatgtagacttatgtatgtgcgtatatgcgtgtacacgtatgtagacatatgtatgtgcgtatatgtgtgtacacgtgtgtaggcatatgtatgtgcgtatatgtgtgtactcgtgtgtagacatgtatgtgcatatgtgtatatatacgcatatacatatgtatgtgtgtatatgtgtatatatacacatatatagacatgtatgcgtgcatgtgtatatgtacacatatatagacatatgtatgcgtgtatgtgtatatatacacatatacacatatatatgcatatatgtgtatatatatgtgtatatatacacatatatatgtatatatgttatatagcatatatatgatataaggctatccttgtatatatatgtgatatatatatatgctatatatatatatatgctctctctctctctatatatatatatagccttcacgtggtccctgatatacttcagtatattctattaggatttttatatatatatatatatagccttatatcatatatatatgatatatgtatcagaaattaagttaaatttctaatttcttatttctgctggtggtgactaagtgtgatcattatgtcttgaaggtagaataacttagatgatgtcttacattctgtatcctgtgattccttgatttctataccatattggctgtagatatattttcatgtaactagatgtagctcatatagccattatagatataaagacattcgtcctaatttcggttcctgggagtaaaggtgggaaaacactttctctagtctcctagtgttgtgctcaaaaactataatggcttatggtaggctaaacgttagttttacattcttcctgattaaagaatacatcattattattatcgatgttctcctgagcatcagtttgactttggtttaaaaaaaatgtgagtaaagttaatttgcatcacatctgagcagaagctataagaagcagtgaaaaatctgccattgtctcaggcaggaggatttgcagtgctggagatcgtctctgacccattagcttggctctctgaatgaggatgggcaggagaaacctctattaatccaccaaggttctatgatgtgaatgagaaagaaacacctgttgttttaaacaagtgagattttggagggaggtgttcttgcaggagaatccctgactgataatcggttccccatataaaatgtagggaatgtggttaagccaagataaacaaacacagcaaaaatcatgtttacataatttatattttgtattatatacataatttataaatgccataatttatattcttgtagcaggattcatgtacaaatctcttagtattgattcttggatatggaatacataggtctaaaaaaaccatgcatatattttataaatgatgtgtttatgctcttctgtcaacagcatttatgtgcactttgtcaacaggtaaaatgataagaacattgaatacatttttaaaaatttcctaaaaacacaatgaggtaggaagacgtataattattattctttttacagaagaagaaattagatatctgaacagtttgccattttacataattgcaatggtgcaagtttaaaaaaaattaatacatgttctctgactccaaggttgttgttttggataacttacaggttcttgttacatgccaatttattggacaatatatattaaacatatttcctgttacaaatataattctgcagaataattgaaatggctgcataatattccattatatagttgtagcaaaataattcaatcaatcctctttttattagatatctatatgttcttttattcaagttctaaatgccataatttatattcttgcagcaggattcatgtacaaatctcttagtattaattcttggatatggaatacataggtttaaatgaaaaaaaataagttaaatattttgaagaaaaaagtccaatttataatctctaaaataaattatacaggtgtgctctcctgccgggggcttaagaaaagtcttcttcccccaccactagtgacaatttaaattatcagttagctcttctcaatgtatattgctgttggtgttacaaacttttgccatttatcaaacttctttcattgacttctataatcatcaaaacgaatgatttatctgcaggcattattattcagaggcttgtgttttcagtatttgccttctttgatcatcgtttgtccttgtgtctaagtcatcctttcatttgatactgcaatcccatgtgcttttcttatctgtcctgtttgccctttggttttcttttatcagacttgttctatgcggtattgcatatgttttagttccttaaacacataaccatacacccccataagggaaggtgtgaaatgggggaagaatgatagatggaggctaattatttaatattgtaacttctagaaaatagaaaccatgtcctcatttttatcaattagcatgctttaattaatgaattaagaattgtttcaattcccttacctaggaacatactttcaaagaatagtagcatgccaaattctcaccatctggatatttttcaatgaagtcacaatttatctttcctttttattgggaaagcccatctttaatttcctgttttatttttcagagaagttttcatgatacatgctttctttcctttttttttttctttttgacctgtgtgttttttactctatgtaattttggacagctgaatcattacctttcttattcatgtttacagagagtttatttatttggaacaaagagaaagtttaaaaatttggaagttctccaaacattttcagttaagcagcataccatatacagtgattatgattatattttaaaatcctttgtggcttaactaaccatcttatcataagtttgctgctgcaggaaatgtgctgagtgtttaggtaacaagggaacccccaatgtgttcttccagtagtactttgagaaagcaagtgggattcagatttaccctattctgtgctttctgctagattgattcattatttctgccagtgctagaggaccctggaatagtcatgaactgagttatgccatttgaaacctagtttttataaactatagccaaagatgataaataaatgaccctgcaaaattaacttatttactatttcttatccaagaggaatggtcctgcttttagtgtgcatcaaatagggagaaatataaatgaattggtgagttttttcagaaggaaaggcctggactttgtcatgttatggacattaaatgacaagaataagcctgcataccaccagggagtcttccatgcacctttgatcatgctttgaactgacaatgcccactattatgggttgtatatgctctattaccatgcaatagcccataatagtaatattatatgtagaaatagaagagcctgtttatcatttgctttctttatactcattatgatatcttaaactgtatatgcatcatacatttcagaacatgtcgggaatgtaattgttatttattatgaggttattaaggatagtactgatatgagaagactgagatggagggagaattaaatagggtgcttctggtatcctttatctatctttatgatgcacttggatttctgtgttgggacattgtgtattctcatagagatagccaaaggtgcaggtgctcagaatagtcatctacttgaaggtcctagttaaatccagtattaaatctctcagtcatatgatgaagcagcatttactaagctaatgacataatctgcatatgtgaaaagaaattattaaagggaatggaaaagagccttgttaaatagaagagacgatctcattcaggttgatttttcagagattcccctttgcagtaggtatttatgttccttatttctcctcttgtgtttgatcttgcctttcatcttgctattgttatattcaacagaacagagagaaaagaagaatccagaagctgaatttaatacttttgtttatttttaagagatggtagaaaataattcagtggaaaataataaacataatatattttaattaactgaggtttttctaactaatagtccagaaaactgtattactaccaagtaagagagagtatttttttcctgttctaaataaacaatctttatctatggcaacagaacagtttgtatcaaagataggaattgatccaaataaatagacaagtttcattacattttgcattatttttatgttgtaagttgaaaaccagtgaaattctttggctaagataacttcctagtaaagactgcaaccagtattgtcaaaatgtatttgaaatgaaaatagaaaattggacttgaatttaattccaatttctccaggcaagcttaaaataaatgtgacagttatgaaaattttgttactatgattatatatttatttctattaaaatactaaaattatagtgcagattgtagtggagagctttagcagttatttacctgatttcattcaatataaacaggcaaaccagatacttttatgggaaacaatttgctctggttatcagccataatcttcatagaatcagcctcaacagatgttctttctaatagaaaaccaatgaggcacagtgttatccctttgtgtagcctgtagagtcacatagctgatcagaacctgcgatgcccctcttaggatacacaaaacttaatagggctggtcattgtgctatagttgcaaaacgaatgcagatactctacactcacagcatacagacaacatgtacatcatattttcataaacgatgttgcttatcataatcaatctaatatttattgatcttaccaccatgtatctctgggctaagctagtggtcagaaaactagggttaggcctacattctctttttgtaaataaagttttattagatcattgccatgctcatttgtttacgtatagctactttcttgctgtaatggcaaagttgagtagtggccacagagagcacagggcccacaaagcctgaaatatttctcatgcagccccttacagaaaaaacctgctacccctgagctaagcatttgtgataattgtgacaaatatgtcgggagaagggattgagtgtcttgagaatcagaggaagatgacatttgctcaatttgtgtgcaaatatggcttcatgaaatgagtgaacctagtgggtatctgcagagatgagtagtagcattaggcagataataatttagaacaaaaataaaaggacatcccaggtaggaggaagagcagggacagaaactctgagttatgatgggaataatgtgtaaagaacaggaagcatactcacttgtgatgatttagaaaaaataagaaaatggtgggagacagcctggggggaaatatgtctctccctcccacctaacttcttcttgtgtgattgacaggtttcagacagaaaaatccacttctttgcagagctctctatgtcataattgtcttatgaggttaattgttagtaaaatgatgtcatagaaatgccaagttaacgttgcttcatgcccatccattgggtcattgctaaaatgccaagttttatttaactgaatttagcgagattcaagtttttccatgaacaagacaaatactttaacatcctttcatgtgcccttctgcacctcgtatcatgtttacttaactactgacagaagatgagaaaacaagcacaaatccaaaattgttttattcgaaggcatttatatcagcaaagtattaaaatgacaactgtcagcagtcagatttgtattttgagaatgagattactattatctagatattgggtatgtatatagatgcctacatgtttaaaatgggaaagggtcacgttgcacagttagttgaacagtaagctactgggatagaggtgggcagaccctgagttagtctgggttcagtcactagccagctgtgtgacccagcaagtcatacactgaactggcagcagaacccttctcggtgaccttgaacttagctccataagcttgcattgcctccctttaacctctctttgcaataagtgaatttgacactgtgttctgactcatccggacccctagattttatatctactcaaatggacaccatgcctgtcatttctgacataccttcatagcagactttgtgtctggttttgcaaagctaactagacagactaagatctgactaactacgtctcatgagaatcatgtgactaacccatcgttctttcagactctgctttctaccaagagtctgcttgggattcaaactaatatattcttcagttatggcattctttcctttggaatataacaatttaagatggatgagattttggttctccataaatatttatttttcatgtgttgcctactatttggataaaggcaaaaaggcaagattctttggcttcctatttaagtttataaataattttggcctctttgatgctcaaaatattcatgccatgtggatgttggtaaataataccaaatggcctggcatggtacagttgtaagctgcttaagatttggatggtctctagggtgaaacagcaaatattttgaggtcatgtataaagtcctttataaagatgtgaactcttttgccaagatttctttgcagagccctgtattgtataatagttaaccaaaggaagttaaaaggaatgtgaaaaacataagaaaatatggagtatgtagtgcctggtaaagtctctcctactgcttcctttaatttgctggaagtctgggtatggttaatgatactgttgaattatagttgcaatggtgagagagaattgtaaaactcaccctcttgagtgtagcttaatgtaattataaaaaaaaaggtggtagcaaaatccaagtgacataatttatgcttgagtctagatatattctggataactctacatagagaggaaaacccagagggattgcagtttttaggttaggcttcttagtaaataagattttggatgtgttaggaggcctggagtcttgtgaccacacaagggtatgacagggtgagcacagggcgacactattcacccctgctcatctattcatcagtgatactctcctcttcactggcaaggtccctggaaacactattaacaggcatcagtttcttgttcgggtagaaagacacacatgctgccaacaccgtgccttccctcagcgtccgtagcttatcaaaacagccaggctccaactgtgagggcgtgtgctctgagggggcagggatggaagagatggccacgtggctgcatgacaccctcatagagctgatgtctcacaccacttattattaatgtgactttgtagagttttgtatttttaaaaaaactttttggacccttaactttgttatctataaaaatggcattagaacaattgctgtttactctgaaatgttgttgtgagagacccttgaaacagtatatatgaaacttctttgttaactttaatatacaattttacgggcttacaaggttttaagtagatggcataaaaatgacctccagggcatacgatttaatagagaaaacaaggtcaacgttcattcattcattcattcattcacccagtcaacatatatttaccagggtcctcctgtgttcccagaaccactctcagtgctgagaaaaaatagacaaggcaacggatgtcatagagtttgggaaaataagttaaaccagaaaacaaataatttcagatactcctatgagaagggaaatcaagagaatataagagagtggccaagatgaagtctgggggctgctgtaagtacggagggcagggaccctctcccaggaagtcatatttggccagattggagtattgaaagtgggccacatgacaactcagggaagatggcagaggaaacaggaaaacaatttcagactcaagggataaagttttctggaaggagatgtaagtcaggtgggcttcatcctttaaaaaaatcatggaggagatgagggcacttggagagcttgcagaagtatttttaaaataccagtgctgagttcccacccgacttgatttgtctgcaatatggcctgggcgtccgggattttaaaagctccctgggtgactctgctgagcagccacatgaagactcaccactctgcagggttgtataacaggcacggtcctgcagcaggaggatggacactttagtttttgccctacttcccactgagcaaacagggctttagggagtgcttaaaagttgcacaaaacttattgctctgtggtgtcctttcccaaagctttgttgaatagggataggagggaaaggaatgagtcagggacaagaggggtgggtgggtcgggtaggggtgtagagagaaatacagagaggagatcttgaacaatgaaccaccttaggcacgtttgaataccggcagcatacaggacaatgattatttgttctatatgaaagataattggctgaatagatagaattgtcaaagagtccagaaaaggggctttgtcagaaatgcattttgggttttcgccatagataatttctgctttgaaaaataatatggaggaatgtatttagccactctttttcctagaatagccatggtgatatttaataataaaatattatttagttctgttaccacaacagtactaattgttttccatgttgtcttttttcccatgcatattttcttatgtgttgaggagaggcattcctcaggattatattttccttgttaatgaaactaagaattttgtggatgagtctgtgtaggtgcagtttgagcacattttccattattaaatcaaagaactgaccagcgaatccatatcagctccctacaatctgttcccagcccagccttcctgcttggtccgctgctaagctggctccttgtctgctttgtccccaggtttttgtttgggctttcgcagctacggtgagaggcgacacttctgagaagtgaggcgcatgctcaggggagcaatgagccaaggcgagtttagcagtaaaaccattgcatgttgtccagagagaggctcctcaggaccaatgctgggagatagcccagagagagttaggctgtcctcagatgctccccagaaacccttcatttgcatagtgcttcttttgaagagcccgattttgaaacaccacttctgtcttagctgcaggtgaccccttgtgatccacattggaggtataccccaaccctgccctcaggttagattcctagggctgcaaaaacaaatgaccacatatttgatggctgaaaacaacagaaatttattcccacagctctggagatcagaaatttgaaattgaaaaatgtcaggatccctcccaaggatctaggagagaatccttccttgctgtttctaacttgtggcttttggcgttccttggcttgtgactgcatcactccctgctctgcctctctcttcacatggctatcttacctgcctctctgtgtgtccaagctcccttctcctttctcccataagcacaatagtcttcggacttagggcccaccctaaatccaggatgattcagctctagtctttaattatatctgcaaagaccctatttccaaatgaggtgacaccctggggtcctaggtggacatgaattttgaggaacactattcaactgattataccctcttaggggaaatcaagcccgcttctaccagagatatttattcagaaaataaatgtcttatccaccatatactactttatttgctgatttgtgcacattactttggcctgaatgtttgtgcccttcttaaaaattacatgttgaaacctagccccaaagttgatgatattagaaggtggggtctttgggaggtgattaggtcatgagggtggagtcctcatgaaagggaatggtgctcttacaaaagagaccccagagtgtggtagtacatgcctgtagtcccagctactcaggaggctaaggtgggaggatttcttgagcccaagagtttgaagctgcagtgagccatgatggcaccactgcaattcagccgggaagacagagaccatgtctctaaaagtaattataataataataaaataataaataaataacaaaagagaccccagaaagctagcttgacaattccaccatgtgaggacacagtgagaaggtgccatctatgtgtaggaagcaggctctcgctagacactgcatcttccggtggcttgatcttggacttcccagactccagagctgcaaagcatagatatctgttgtttatgagctactcatctatggtatattttatagcagctcaaatggactaagacaagtatcaaagttcaattagatacagcgtaaaaaagaaagagaaaaacataaatcattgcagtagaatgtagtaaatgctctgacggagatatttgaggtgctctctaccagcaaaattaagagggtgagggaggtcttgaatggtcagaagtttgctcctggagaaatggggaagaatatgtccaagacaggaaatcccatcacgaagcacagaaagatgaaaggatatgataagttcaggtaattgtttcatccagcttatgtatatccaaggtaggatgggagtctttatttgtaagtagatctccagtgtgaatatgaagtattttggcttaaattctgggggtataaatctgtttcataaaactttccttctgtggtataagttgctcagaactctgagatcggctttctgccttcatagctagttttctttctttttctttttataattgtttattttttttaaatggagtctcactgttgcccaggctggagtgcagtggcgctatctcagctcactccagcctccgcctcccaggttgaagcgattctcctgcctcagtctcctaagtagctaggattacaggcatgcaccaccatgcccggctaatttttgtatttttagtagagatggggtttcaccacattggccaggctgttctcaaactcctgacttcaagcgatctacccacctcgacctcccaaagtgctgggattacaggtgtgagccgctgcaggcagccgatagctagttttctgagaggtactctctgatgtgcttccttggccagaataatctgcattgtaatgagggagttggggaatcccatatccagggactcttagcctggaattcatgcaaccccagaggatggttaggtatcagacaatgagaacaccttaaaatggcacaaatatattgtgtttaccttttaatatttttgtgcagaaggagtccatagcttctttggctagattataaaagggctccataatatcaacaaaggtggcagtgatttagacatctctgcataaaatcaaacaaagacttttagctgtcacaatatattattttgagctacatatgctttaactaggtactgtattgtttactaagtaaattagtaaattattcaaaaggtagtcaaacatagaagtaccttgtgatatccagttttatttatagtttttgattctgcttttaaaaaattggaataaaaaggtagaccaagccccaaattattttactataagtcataagaatttgtcactgaagtttcttttaaggataattggtaacaagcagaagttcaagcagagaaaagaattcctctcctgttttactctcagaagacagtgatctttgttctataattccttaggttttagtgtgtatccatgagaaggatctctattctgattaatgtggaagcactggatgctcatatgagtacaacctggcatcctagaaataataggaatacagaaacaagaagagaaataattttaatttctatgctaatcaagtttcatttgaaagtcttttaagcagactcatctcattatataaaaatacagtcttttattaaaactatagaaatttaataaaaaatataattgatgttttgcatttcctacatgactctaacctaatatttagccagtttatagactggctaaatcaaccttcagccgtattattactgttttaactttggctagtgaatatccatatgaatcttgtgaatgtgtgggatatggctaaattgtcaaagacaatttcagtgtggcagagcacccagaacctgaggagacagtagtgaagaagtattaatggatcatgaagcagtagtaacagtggtttgttgatattgaatgatccagggcctacctcctgggcttagaacaatttttttcactatatattcatgtacttaatcattcactcaatgtgattagttacattggcaatataaggtaactagagaatcttcctagtattcactttagtgaaataatttgggttgctgctatttacctcttacatatgctgcttatagattctggttgaatccacggactttgtttctatgctattaactagctacatggggggaaattatgtttagtgagaatatttgctattatttgttcaacataggcaatagattaggaaagtgttaaagaagacatggttgatgcctactatagatcaaagacttagcaacaaaaagctatggtgttgctggtaccagatcacactttgcagcaatctccagtttgggacatataaagagttgttcttcgttttctatgtcctgaaagaattctagcttcctttattacgttttaaaatcctttgtcattagttatagtgctgagcatataagaaaactatacagcatctattttaattaaaagaccttagatgaaagtggcagaatcccaattcaaacaaccagaaacaaataaatgatttatgtgctcacaaaccaaaaaggacaggggtacagatgacctttgggaagaatggtaaagggacttagacaacctcccacagactctctcactctttcactttctgtatcacacctacacccgtgtacatacgcatgcacatgggttgacgcaacagcctccaacacacacgtttctgcttttatcagccctttaatctgaatcttgtctactgcagatggatttttctccatacaggaggaacatggattttagcatcgtctaaggttatagttttactatgctctgaccaagaaagattaaaggcttttccttagcagtttaagggagaaaaaaaatattcagggggaaaactcagattgactttgcttggatgaaatggtcaggtttgaaccaatcactgatgatagagggatggtagcgttctaaatttgggtcaccactgggggcaggtgggaattggggcaacgagatgtgagactgtaagactttaaggagtccttctgagcagaccacagttttcactagatacaactgcattcaggttgatattgatcttgagtatcattgattacgtgtacagccttcttaatgtaacaaagatgatacatagcttattttcagacttataaccaaatgacagcacaacaggacaaaataattcattgatgattgtggtaggtagaatactgcccccatcaaagacacccctgtaatcccttgaatctgtgaatatgttagattacatggcaaaagggacttatgattgctaatcaaaagattatactagatcatctgggtgtgcccaatacaatcacaagggcccttacaagtggacacgggaaagaaagagtcagaatcaagtgattcaacatgagaaggactcaacctaccactactgcctttgaagatggagaaaggggaccaagagccaaagaatgcagcctgtctctaaaagcttgaaaaggccaggaaagagatcctaaagcctccagaaggaatgtagtcttgacgacaccttgatttgagcccagccaaaccattttagacttctgatctccagaactgtaagacaataaatgtgtattgtttttaggcataaagtttgtggtaatttgttattgtaggaccaggaaatgaatacagtgatctttggacatattctttggcatagtcaacagaatatacatcagaagctgtttctgaattatgtattcccatgtattttgaaaagcttttttacaaaaaatctgaaaaagaattatgtataaaagattatttcctttactgagagtatctcaactataggcataaacatagattagttgagatatgattttcttcttggcttttttcttgctttgtcttaaaatgaaaccagtcctcttataactttttccaaagcacaactttatagcttactcgttgcacctatttgaagtcttacaatttattccatgttgtaatataatcttggtatattgtttttaatgattacacattaacatattttaaccaagcataatatgcattatattccgtcgtttaatcaatttttctatttaaatggcccatgaacataattacaatattttaatattatggcctaaattgttttactatttttacattgtaattctacattgcaatttgggatgcatgtctttgtctaacatagataagtagattcacattttgcagggtttacattttgggagtcctttttaataaaatgaattcaaaatcaaaagtacaaagttagttaaggtgaatactaacttaggatgaaaaggcaatcagcacaaattacatttttatatcagacagataccataaacctcacaaatctagaatatgatgtaattataattttacacatctgttgtaagtggctctgtatatttcaaaacttgttcattctcaacttcttaaatgtgggctgagcattataggatgcatacaattttattatttgatctctcgtcttaaattgtcatgacccaagagggctacagcagtatttctagaaggcatttctataccctgaaaagccacagaagtgatggtaccccactaatagcaaaatgaatgtgtcctcaacccaccttctctttggctgaatctcagaagtacctggagtctttccagagccactggacatgagaggaaatgtggatgagtcaaagttagaatagaaggagagtcagtcatcttacttcactcaaaatttcttattttggaaaaatttaaaacacgtatgtcatctattgtcatggtccttctcagtgccagagactcccaccagtgaggaaatctaaagaatagttgctgttagttccatggtaaatgtgcctgtctctttgatgattgatactgaacaactgcacctggggctgtacccaaagtggagaacagtgagtttctgtgtcgtgactgtcattgaccttccacctttcctctccaaaagaataagaagcgaatcaattgtgaagatggagcaggtgctgtgattcagcctttctttatatcaccagacaaggtgaagccttcctgggtttatcatggtctcccaaaggactgttgacacctttgtacctacgcagctttctgctgcttgatgctaatatcatacacgttcttctgaaatattaacaggaaaatatctgtttgaataaatagctttgtacaagtgtatgtctccatcccaggcatccttccactccctgggtgtgtatggaattagaaacatgtaccacttcatcagctttcaaacacattttttaaaatctggaagtgtatagcctggggcctcagtgtttctatttctgtttatttgtcatacagagtgttgcttctcacctgaaccccttgcagacattccagcaaaatgaaaacatgaccttgagccttagtttcacagtccatgaaaagctcaacttttattatagaaattcagggttacagcccttcttttttttctcccacttaaaaagggataaagaaactaacccacccagattgctgctaagcctaacatgagctttgcatagccattgaaaaaggttcccacactctagaatttttattccaccttttaaaatgctcttgtccatctcttctgaagactttggagacaggagatttttcagtcttaatgcattgaaatgaagataatacaaaaagaaagctttttcaaaatttttagtctcaaaaagtcttctcttgggaaaaggcagacctttatcttagtcaaaagggaatgagactgttggcaatgacaaattaaagtttgaggggataattgaaataaggaaatggaaaagtatggctgattatccccaaagcctggatcagacaaggaaataagccagaggcagcatagatttgagtgaagatgtgcaccctcaggtcaagagctgaggctggttgggagcaaagaaaaataatagaaagaaagaaatgggaggaaatgttttaatacatttaagatagtggaatataaataagcaggcaggggtttctatttctatttattgtgtttcctttgcctgcacagagtgttgattgacttcacctttctccgtatccagaaatccatctatgtgattaaacttttgttcttaaacaaggcttctaatattagatggaagatttaatgaataatagtagttaacattaagtgagtacttatagagttctaggcactgttctaaatgtttgacttatgtcatttaataatctcatcaacctcatgatgatggtagtatcatgattatccctacacagctagtaataacaccagcgtctctgtctatataaatttaatcattcctatttccatcaataccaattcagtctaggttcttgcttttgcccttctctctgtctagaataaccactgacaccttgtaagcctgaaaaaaatgcaacctcacatgtagctgtgatcacattttcctccatattccagctaaaccggtgcgcacttttagttttgtatttgccgtttactataattatttgttggtgttggtctctctgactccatgagtagtgttgattttctttgtatttctaaaacctagaatctagcaaacatttgactgaataaagaataatgattgactgtgaaacaaatgactacatgagcgcacagatggatccagtgtttttttcttttaaataaatgatcatgtaccagtaattacagaactggttctaaacatggattcttatgtagttagagatccatgaatagaaaatctttatttaatttaatacgaggcctctagcctagtattcagttagttctaggttccccagcactgatctggaagggaaaagaaaattgaatctgaaatgaggctgggatgtgtgtgtggggtatgtatgtgtgtgtgtgtgtgtgtgtgtgtgtgttttcctgtagttgtgacttaatatcaaagacaattgcagataatatgagaacttttcattatttatgcttgttttctctaattgagattagattatattttgcagataaacaatttgaattcgttaataacgtgatttttgaaaatcactgacgcttgttaatgttaactaggataaatattattctctatttaaattgtgtgttttgatctttccctttaaaaataatttactacaaattttaaaatattaaatattaatatgataatgcaatccgaggtttataatttagcttgatcccatgacagagtaagctaatgttaactatataatcaacaacttgtaaaaaatgttcagagattacctcttaaggcccacagtaataaaactatctacacttttctctaaaagtcataaaaatgtttgtgaaataaaatcaagtttcatatctttgtgtactgaaattagtttcttattcctacccaattatctaacatacaattgtcattttgttatgagatacatacacttctcattacacatggagaagcattatgtcattatttttataaaaggctgataaatacagttgttccttcatgtatggctcccatacagattcctggtaagatgattctataaaattatataactcaaatctcctgttgactttcatctgaggacaggcagtgggttcaccgtgagtcactgtagttcaaagatgtaaagaaatctgttgtaatcacacttaaccttcgcagagcacaaatttaaagggagactcatgatttaaaagtggacaattaacaaatgacctttctccttcacattaggtgagatcatcagggcagtgtggtaagtagtctgactgtagaatattttaaaggaatgaaagtttttttgggtataccttctggccttctgggcctgtttttggccttctggccctgttttaaatcccatttttaaaaaccctattgcttaaaacagctaaaagaacaaattttgtaagcattccattagactggctaaacatctccccccacccagtttacaatgtatacaatctcttatattcatgtggcttagtgatttgtacaggatgacctaaagccaccaggattcctggagatattcttagatgtttactaggttgctttggagagtgagaagaaatctgggcttgttgagctttacctaccctacctactgctttctctgggcaaattcacttacatatgttttatttagcatggatctgttaatactttcatttggaatgaaatgtttctgccggtttctttctgttcttgtgcaaatgtgaaaactattgctttagcgaaagcaaacaccgttacttcctgaatcacagctccctccaaaccactcctctccagataaacatttatgttttatgccccaataactacacttccttttattttccctgctctgagccttgaagtgttcacctgaaagcattttaaaatagtctgtaattccaaaggaaatgaagtaattgtccatggaagggaggtgaggactcaggatacagattgacctggggttgctcatgaattgagaccaaaagaaaaacagaggtagaataaaatgaaagggagaagagctcagtgaacatctgtgctttctctttgccgagtcctgacacagcgctcactacccctctgcattttatccctgtcaccatttggagaatcaggcaggaaggcccagcatcagggatttcctctcccttcaaattctggtccctgcaaccagctggagccacccacagattccctttgttgatgagtgcttccggaaggtgaaggagaacctccccatcagggggctgcaatgttccaaactgcagcatcattcatgacgtggctaacatttaccttcatttttgtagggggtggagaaaggtatttttttatagtaataaaatacaatctgtgaattctgccatataccaaattaaaagaggttttgcggtacagctttccatggagacaaggaacaggtaattattcagagataatgcttctgaaacagaacattgtcagtatataatggttccctgccggtagataaatgcagaggcaaagacagcatatttattttttaaagcaagagacattcagtgatgcaattgcaactcttgaaattacctttcctgttttaccagatgaaaggttgtagatttaatcatcatgcctgatggagcactggtgtcacaaagtgacagaaataagcccagtgacagcagccctgctgtgtacagattgacttagtaaacactcttggcacagactttagccgttgaggaacttcttagttataaatgggtggattctccatatagctgctcaaattctaaattcattatattcctgccagttaagccttcgtatgtctttgctttgccaatgaaaactcagccggccaggaacaaatcatatacagacttaatttgaattcaagggatgatattgcttcttctgtaggttaagggttgcagtggtagctcgatagttgtgtaactacactgcactgcaagggctcatcaggtcccactcagtattttatttctaataatagtaatggctaattttttttttttgagatgaagtttcactcttgttgcccaggctggagtacaattgcacgatctaggctcaccgcaacctctgtctcctgggttcaagcgattctcctgctttagcctcctgagtagctgggaatacaggagcctgccatcatgcccagctaattttttgtatttttagtagagacggggtttcatcacgttggccaggcttgtctttaactcctgacctcaggtgatccacccacctcggcctcccaaagttctgggattacaggcgtgagccaccgcacccggccagtaatggctaattttattgagcatttaatgatgcgttagacactgttctaaagactgcacatgtatttttcatcaaccctataatgtatttttaaaatgcggtagatttctcttttacccagggagaaaggagaacttaagggaatggcttggatctgatcacatggctaataaatggtagaacttcgactcattgagttgatgggcctcttaaccattgtacctttgctattcaaagtgtggtttgtagactaacggtatcagcatcaaattgtatttcagatacaacttcagacccagttaatcagaatttgcattctaaagagatcccaggtgatttgtagtcttcatagacagtgtctacaaacttttctggaatgcttttgctattttaaaatgaagatcactaccacccatggatttttatagcctttctcatcatctttgatctattaagcactttgaaaattacactacaatttaatggcacagaaaagaatgagttttgtggacattttaattttagaaaaatgtcattgtaagtgaataacaattttctccgaaataagcagcttaccttagaagttagcttgggactgattgatgtgagtccccgagagatagcccttttgctgaatcagacagatctttcatctatctctaaaaagtaccatctactccaggaaacctggcagtttctactacctttatctgcattgctttgcttgtgacagtcctttgcatatatgatggcctttttcagtgctttctaaagctatttttaatacaaatgaaggatttgaatttaaattaaaatccagctgcacacattattattaaagataatttcgttgtggagaaaatctaatcagtagatatttttattgatgttaatgtgccaattctcagacaataggagtacatctttttttataaagaaatcattttaaaattgatcctaatttcagaaaccttaaaatatgaaaacaacattttagagttaagggtttagctaattaaatgttttccaaatttaatcttagtgtttcttcaatagggagacactggtatatcttaaaaagagccctggactaggaggcagaagatctgagtgaaatcctgattcagacacttataggctgtatgactttgcgtaggtcatttaaccttttggagactccttcatcttgtctgcaaataaagataaaacacgagaattaaataaggattgaaacttgcggttttctgtttcactcatttctgtaacaggtttcatgttttactttcattttcactgcttctcaaagtgtagtctgagttataagattcctctttcatgtaatttttttttatatttcttacaagtttttttggaattatgaccacagaccatagcttgtagaaaacatgtgatatttcaatgctttttgtaatacactttattttttagtgcacttttaagttcacagtaatactgaacagaaagtacagggagatcccatatactccctgccctcacccatgcatggcctcccctgtcatcatcccccaccccaccacagtaggtctattggttacaagtcaggaacctacatttacacagcactatcccccaaagtaattattataatttaccttaggattaactcttggtattgtattttctatgtgtttggtaaattttataatgacacgtacccaccatgacagtaacatatagagtagtttcactgccctacaaatcccctgtgctccacctgttcacccctctctccctacaacccctggcaagcacggatctttttactgtcaccatagttttgcattttccagagtgtcatacagtgtgtaggcttttcagattggtttctttcacttacgaatatgcacttaagttttttaagtgtgttttgatggcttgagagctcacttctttttattgctgagtaatactgccttgtctgaatgtaccactgtttatttaaccattcacctactgaaggacgtcttggttgcttccaagtttcggcaattataatgtagctgctgtaaacgttggtttgcaggttttcatgtggacattaagttttcagttcctttgggtaaataacaaggagtgtgattgctggatcatatagtatgtttagttcagtaagaaactgctgaactgtcttccaaagaggctgtagcattttgcattcccaccagcaatgaatgaaagtctgtgttttctccacatccttgccagtgttgggtgttttcagtgttctggatttgagccattctaacaagcgtatagtggtatttcatcgttttaatttgcatttgcctgatgacaatatataatatgaaacatctttttatgtacttgtttgccatctgtatgttttctttaataaggcatctgttaagatctttgggccatttttaaattgtttttctcttattgttgagttttaggagttatttgtatattttaagtaacagaactttatcagatatgtcttttgcaaatattttctccttgtctatgacttatctttttgttctcttgatatttcttttcttttctttttctttttctttttttttttttaagacaaagtctcgctctgtcacccaggctggagtgcagtggcatgatctcagctcactgcaacctctgcctcctgggttcaagcaattctcctgcctcagcctcccgagtagctgggactacaggcgtgcaccaccatacccagctaattttttttttttttgtatttttagtagagactgtgtttcaccatgttgtccaggatggtcttgatctcttgacctcgtgatccacccaccttggcctcccaaagtgctgggattacaggcgtgagccaccacacccagccctctcttgatatttcaatgctttttacatgatctagtatatgatggatatctctatttttcataaatgttctgtggatagtttagagaaggttgattagagtaagaggcaaagttgacatattaaataaattatccttattaattattttgttctgagttatataatactgcttagactttctcataatagtaatcaacttctcatctgtttctaacagtttttatgtcatatatattgataatgagtgatattgaccaaaaattcatgacttcacatattccttaacattcaaattatagaaaaagaaaatcatatgacctttttgttttgtttagttgttttgtgttaaattctgctgagtctgaaatttaggctaccatgccgtttttctatatgcttgataaatctttgacaaccctttacattttattcttcttcattcctttgagtcagatttgtcactttggggcagcatacactttgatttatgattttgttaattttttacctaatctacaaatctttgctgtaagagagtagggattaaaatatttgagtttactatcataattgacatatttgattttattcctgccaacttattttatcctttcttcataccatttttaattttgtgtcttctttcaattattttataaaatacactgcatacagtttaatgcccaatcctttgaaaataaatatatatttttatttatcctaatggttaccttatattattttaaaaacattgtcagtattcattttatatcaaggtctcaaatttaatggtgtcatttgttcttcatctatttaaaatgaaagatatagcattttttcaattttcctcccatctttactcactggaaattattagtataaactttgctttttataactaggtaaataaaattttaactattttatagtgcttctgttttaatcattaattttgatatttccattgagttgtataaccgtatttatagtggtccttaaatccgactactataggaattgattaacgtaatatagacagccccattttccaattctcccatattttgagcccatttatttatttattcatttattttttgaaatagagtcttgttctgtcacccaggctggagtgcagtgacacaacctcggctcactgcaacctctgcatccaaggttcaagcaattctcctgcctcagcctcctgagtagctgggattacaggtgcctgccaccacgcccggctcattttttgtatttttagtagagacggggtttcatcatgttggccaggctggtcttgaactcctgaccttgtgatccacccacattggcctcccaaagtgctgggattacaagcttgagccaccgcgcctggccttatttatttttttgttaaaatttcaaagtaaattttgaaagaattttatttggacaatttgttttctaaaaccttgaatacctaagattactttttctattgccctaaccatgaacacagtttacctttgttatttaaaataagtattgtcattcaatatttattttgaaaataaaataaatgacaaatcattcaatattttgaatgacaatattttctttctctctaaatgctccatttttgctgttttaattgtaagaaatctgatcctttgtaggtggtctacatgtatttctcacttgtatatttaaattctttcatgatgtgaatctcttaattgatctacccacagagcatggtaagttgtttctaacttcacattgagacctggttttaggtacaaaatgtatacttcaatggtttcttcaacgtcacatctggtactgttgcacttgatttttcttagagaagacccataactcctagattggatagttctacatctatcatcatcttccagtgattttcccttattcatttcctatgcatttttgaaatacttttcagtttgtattccaaatcattgttagatctcccctggtaagtgctgatctgcattgttttcaatggcaaatttaattttacaagtgtacttttattttctttgttgttatctctttcttacctgctcccttgtaatcttagttgcctctctgtctctgtatggcatttttgttattgtttaattggagctatatcttttactgcaatcagtaaagataaagacttcttttagtgtttctgctaaaataattttgaagcatgtgttctgaattcgacttgtcgctttgctggttctgtagctctatcttatgctccaactgatcagacatatgttgatcactctgtcctcttcttggagatgttcagcacttgttggttagttaaagactctgatatatcctgcagtaagaaaagtctttaactctgtccaaccaatatttcctgaaattaattgatcctggaacttttctccccatgaaacaccttacagagctactgtttcatgaaatcatatttgatcgcaaatggttaaaaatatgtcgtcttatagttagtaaatatcttggggaattctttcactgctatgattatacactaatattcatcttcaccttaaggataatttatttgattttctatttaattgcagtttctttacaaatgaaaagaaattgtgatgcagtttcccagtgatttttttttttgcaatgtaaaaatgatttgtagatgttaagtctatatctcatagttctttaaatgaggaggaaaggcatttaatgagtttgtatagacacattttcagatacccacacagagaaactgcagaagagaagtgcaaacacatttacactgtcctactaccatagatgatgttgaaattttgcaagggattactaaaagatgtcaaatgagctaactataggatgtgaagtcatgtttttgcctacatttgctaattgaagaactgtgtgtgagagaggttattgtaaagtgtcaatgactcattttttgtgtatcatgaaaattttgctccattattttatagctacatagaatatgaaaagatatttacacaaaagtatctgaaaaatgaaagtcaagagggtctccacagctacagctagttgccaaggcaagttaatgagtaaaggaaacattttaaacaaatggtactagaacaataatataaatgtttgaaaaagaatgaatggacctcttccacacagtatatacaaccgaatgtaaaagtctaaactagaatctagaagaaaataggaaacaatttgttttgaccttgggttgatgaagatttatatacggtacacaaaaaaaagcaaaaactataaaaattgattgaatttcttataattaaaacaataaacttggcttatcaaaacacactcttaggagaatgaaaaagaaagtcacacatggataaaatattctctctctctctctctctctatatatatatatatctgacaataagctatacctaaaatatataaaccacttttattactaaataatacaaaggtaaacaacccaactacataggaaaaggactttatcagatgttacaaaagaaggtatatgcttggctagtaatcacttggaaaggtgctcaatatcatcatcagggaaatataaattaaaaccccaatgagttatccctgcacaaccactagaatggagaaaattaaagagcctgaaaagcaccaatatgttggttaggctgtaaagcccagaactctcatacattgctgttgggagtataaaatggaacacctgctttggagaaagtgcacacctactctgtgacctagcaatgtcacataggtgttaacccaagagaaatgtctgcaaacaatatgtattggtaagtgaaccaccacttaccaattattccattcataaaatggaatattactcaataataaagaggaataaattactgataaagacaacaatatggatttatttatatagcttgtattttatctccattcatcaaaaatctctacttaatttgggtgaaagatacacattttctttctttacctgagtttttcttgaaagagactatcaggtttacaagtttagaagtaagaatgttagtcttctaaaacatcacttcagtagaggagaacttttgagtcacagactaagtctagccttcagtttaatttcacctgatgatattgctttgatcagataatgattgtgaatggcaaagcagaggttctcaaaccttaatgtgcatggggatccgctggagtttcagatttagctggactggaatgaagcctgagatttctcatttctcccaagttcccaggtgatgctggcactgctggtccaggatagatgagtgctctggataatgaactttctgttggaattggaagggctgaaaagaatgtattttcacaatttgtatttcaaagagtacatggatatcagagcgtggtgaagcctgccctttcaggcatatcacagttgggaccaccgtctgagttcattttaagccattttaggcacctccataatgaatgtatctacttttgccccaaattgaccgttttcctttctacttgacctgttgacctgaggagaagcaatagtgaaatgatgaactagattaagaagggtatgcatattgttttgtatcttctaattgacctggcgttgacaatttcaaaaagtgtatgagttcttaagccatctcgttgatttactgaaataggttgaatgctgtggtggcttcatgactgtgcccagttcttccatccatgcatgttgccctgtgacttctattgctgtgaaactcatgtgagttgtcagccaaaaaaaccaagtggaatgtgagtctgacagttctgagcagaagctttgagagcctcccgtggcttctcagcctttttgctttttcccttctgcagtaagaatggcacgtcacagatagtgactgatctttcggccaaagtaagaaaaatacgtgaagagttgcagctgacatgtaacctgagcaagaaataaataattgttgtatctcagtgagactttggggttattattgtggcaaaatctagaaaaaatccacaaatagtctatatctcatacctggtgtcaggtattgggataggctgattatgtattttatttgtattagtcatcacaataatggttacataatttttctcaaatcataggggagaaaataaggtttacagagagttgacatcactaattctgggaaaagatttatttcaaatgtactgtggtgtgatgatgcataaaattatgaaatatgactaagattttgtacaaatataatgagaaaagttatcaatagtactagtttaaccttttaattataatattctaatcaatgggcagaattaatgcaattatagacaatagcagaaactccttttcactagaattggctttctcattcaaattcaatcgaatatatttttaagaactgaaagcaaaatgttccagttaaaaatttctactctgcaaaacttggagtacaatttaattagctttcttggagtaaatgaactgagattttgatctttgaaagtggaagatgatagactccaatggggagatgaccttagcctagttaagaaatgtttagtcaagtaagtcaacatgataatgtaacagatcattggtattttggttgctaatgaggcagaaaatgaaagcttcataggagacataataaaggccttgatatccaagttttgtgcttaggaggctggttttaatgacgagattaagtttagggatatgcaaagtaagatacttttccagtgagatgggaaagatttcaataaagatgttatataaagaaagttttgagaatccactgggctagtcatttgggactagctttcttaaacatttcattcatttattccttaattacgtttttacagtggacctactcagctaagagtgccaggtgtgtgtcatatgcactgaataggaaattatcctgttctcacagatgtcttacatttcagtgggggatataaacaagaaacaaaggaattcctttttaaaatcagaagtgcaatgaagaaaatgataaaagaagagtgtggctatttgcaaggggcagggatagtatttgcaagaggaaggggtgaatgaaaagggagctgataaggaaccaatgttttatctaagacccgaatgaactaaagaagcatagatatactttcaatataagcaaaaggtgtgtgtgtgtgtgtgtgtgtgtgtgtgtatttctagttttataggcaattatgctcaatttcaattcgaatttcctttttttttagctttatgtgcatatcttaactgtagcagctatgctgggaacatgttaaattgtatattatatagtcaaaagaaaatgagaatgtacaattatctgggaaggtttcgtatcattcatacagacttttagaaaaaaaaattggttccctaaattatctgtgttgcctcagcaaataagagtctctcaagcttttgtggcacaaaatatcctatggagcaaaagatttagtcactgagttatttccacccctggcctaccttcaaaaaagaatgtcataccgaaggaaataaaacacatgttaaatatctgcataataaacgaaataaaagaaccgaaaataacatctatttcaatagaatgaataagaatataatctctttgaaataaactccaatttagtcataaacaaataactcatgctagtcatagatattattacatgccatgtagttgtgtgaggtttaaaaaatcagtctcaaagcttattaaaggaagtacaattgtattatttgctcgtagagtcaagaaatatatgaaatgtggccatatttcaatgagtgctattgttcaaatacttgctgattcccatggtaaagacagaagatacattcttaatctgtatgcactcaggtactatagattaaatgtgcagctctttgtgtattagaattcactccagtaactaatgtagacccaaaccatataggaggtagtaattatatatgcataaagaagggcagattaagtcatttcaaacactttaaagaatatctgggctaattttctactctcatatggaactgaataaaatccagatcaaaattgcatccaccatttatatttaccataacttaattgtggcataattcaatcagtatctaaagaaaactgagaggaaacaattactgtttacctaaccaagttatgtctgttttaaatgacttaatttccaattaactattaaaaattaaagaacataaaaattatacaaattaattatttactcagtgatgagaacttttttatcccaacaggctgagaccatatttaatacttttccttgtattttattcttccatgcaatacacttttgagttttcagaatatgttcctcttttcagtttgtccctatatgttggtcaacagattcctaatggcaattcagaatagaagagtgtttaactctagaaatttgattttgggtaccaacagcctactgcagacactttcaggaagaaaaactactttctaattggccagtgtcaaggatccaagagtcacctattcctttaatactcaaacatatatccacttagtgggaaagttaccttaatttatcatttaatcataatcattttcaatctgaacaaatcagaaacttatgacatgtttaatcaagggctaacaggaggaattggcactctggatcaatataaaatctccatatttgtttagaagcctattcaaacatgtatagactataggcttgttaatatgttacttatatttcttcagtattttttaatgaacagaactattgaaaaattaattggaaccttcttattgactttcgttggagacaccaagttctactcctaggttagcagaggattaatagcattgaactacttaaaaatagctgcatcttgtgctttgcagaagtgggaaggagaagctaaagaaaataattattcctcacactgtgtaatacactggtcctggtgattttcaatattgaaatacgttctatcatctctaaagtttctaatattgatcctgctgtatcttattctgaatatattatttcatattatttatttggatgccaaagactcagtctactgctttgataaattttgttctagctcatcacatcaaattttttgtgaaggaatttaattaaattaattttacatgttatatcaaaatatcacatccacttaattctgaaagcaactctttactggggctgaagtttaaaattgactacatctagaaaattctatgggtattcattagactatttttatagttataaagtgttcatgtgcgtatcaccaaaaataacaaaatgggaagatacatcaaagttatgtagaacaagtttgctaatgttccatatgtgtaggcactttcaatgacttggaggtgatgatattttcaaataaaataatttaaaagcatacctcaattcaatgtttgttatatacccaaagaaatttgtgtatgtatgtaaccatacttgaaatgtcaagtatggtttgaagttaaatcggtgctggggacaacaaagtcaaaatgattggaacagtattttttttttttttttttttgagacagagtctcactctgtcacccaggctagagtgcagtggtgcgatctgggctcactgcaaccaccgcctcctgggttcaagccattctcctgcctcagcctcccgagtagctgggactacaggcacgtgccaccacacctggctgaatttttgtatttttagtagagatggggtttcattgtgttagtcagaaaggtctcgatctcctgatctcctgattcacccgccttggcctcccaaagtgctgggattacaggcgtgagccaccatgcaccatggaacaataattttaagaacattaattgttgacatcttggctgccatcacaccaacagaaatactaccatcactctaagccaactctctcttttacctttggtttacatgggcataccatatctggctacagagaaattctccaggagtctgcagtacactttcacattgtccagcaatgctaacattcaatcttagaggtcatttagcagctcatgactgagttgattttgtgcagtaaggcatagatctataatgaaaaacaaatcttcatttacttctgttgccccatttaatgattatgaagagtaaactcttataaagtaaagtaatactctacttgaaaggaatattcctgttacactataaaatatattaccagatattaatttgatggtagaacaaaggaaggatctgctataaaatatatcaagtaaggttttacatgtcattatacacaactgcagagttttttgagaggctctaatgaaagggtacttctcatgctttggaagctcaagtcttcctcctcaaagagagtcaatgacattattttacagaggattttgtagaaatgaaaggtaattaatgccatataaaagcaaaaacattacatctgtaattgctacatagcatgtgcatgacaagttgctggtgcccataagggacagcacttgaaggtcaaaggaaagagcatacccttccacctctcagtttgatttgagtattaaatgagctagcacacagcttggcacatgttaggctttcagtatttaccttctttcttaaaaaataaaaaaaaaaaactatttgtattagcccgttttcatgctgctgataaggatatacctgcaactgggcaatgtacaaaagaaagaggtttaatggagtcacagttccacatggctggagaggcctcacaatcatggtggaaggtgaaaggcacatctcacatggcgggagacaagagagaatgagaatcaagcgaaagggatttccctttataaaaccatcagatctcataagatttattcactaccatgagagcaatatgggggaaaccacccccatgattcaattatctcccactgggtccctcccacaacacatgggaattatgggagctacaattcaagatgagatttgggtgggaacacagccaaaccatatcactattattcagagtaattatgatcaaatgcaacagtgagattgaaaatattatttaatattgcattttgagtacaaataaattttggcttttaatcgtgaacagtcataatgttgaatgttttacttaactgtacttattattaattttttgaaatggtaaaaagtaacaactaacaaactaagaaaaaagagaaaggaaatgaacagtgttataggcaagtagatgctgtggcttacaagcatatggttttctctcagaaacgccccagtcctgtctcctatctcatctctaggagcccacatctacacatcaacctttcctacctgaagtcaagacctaaaatagctgtttacatttggaagatagtattcagagtattcgctttaaatatcttatctagaaattacaaaaaaattcagacttctcatagattttctataccatattttctactcgtggccaatatttccctgagacaaagttttcttttgttctgaaattcatgggataaaataattgcttgaataatcaatttttggaaagactgataatgttgctcaagaattgaagatacacatatctaatcatcatttggaattgggtgagtcatctccaagttatttcatatgaaataaaatcaaatccattatttaaattacagctcacagatatttctgaaattacaattccttcaaatatatataagaagaagttaaatatttacttttaagatttattctaaaacaaaatagtttactacattgaatagactcagatttcaatttgggtctttaggtataagtaggacctgtcttccttacttttaatttattttagcatggctttattattctgcattacacaccgtcttgtgtgtttccaattacaaaccatgtttcattgggttctctcagcattttagttttgtttttgaaatatttggtggttgcttctcctctaaaatgctttaatgcaatttcggttaaacttcagatcatccaattatcagaatagcactatatagacaacacatgaagaagtgagtcattcacccatttcctgtcttttgtttctttactgattgaagggttcaataaattccttcagctcataatgaccatgaaagttaaatactatttttatccattcagctgggttttaaatacagcatgtggacccatcattctgtcatgggcagaagctctggaaattcttgataacttataatcttccctgcccatattcacaagtgaaaatgattatacttacaagaaagaactttacacactaatttttgaatcaactttcagaaagacaagaagtccatgaaaatcagtgtacactattgcttttgagaaaaaaattatctgagtataaagcattcaggatttaagggttcaacttattacttgtttatcacaagttaaagttcttgtttatcacaagtggaataaaatcaattattcatgataacactttggcttactcaatgtaaattttcttggattaaagttaaattttaaaataaggcagtctgtttgacagaaaatgaaacttttactttaggagaagaatacaatgtcccagaccactcaatttagattacaccaggcactctcttgatttatcccatacccttgtatattctacctgggtacattttttactacctgaaatctcaccgtatatttttttacttctagaagtctattttaccttttaggataaaattacagaagaacgcacacttttcttatttagctttgtggtctttaaatttttttaatttgcatttattttattttaaaaccttcaacttccattttggattcagggggtacatgtgcaggtttgttacatgggtacactgtgtgatgtcaaggtttggggtaggaattatcccatcacccaggcaaagagcatggtacctaataggtagtttttcagcttttgtccccctccctctctccctttctagtagtccccactgtctattgttcccatttttatgcccatgagtacccgatgtttagctcccacttataaatgaaaacctgagagcagtacattagcatgtcaagtactccagtgtcctaataaatagctgatgactaacgttgaaggaatgaaaaatatccatcattacttatttagtattagtgtacattttactaccatggcacttatgactaaaggttttgaaatctgcactgcagaacttcatgggtctttttttatgcctatgttctgagtgtaattattccttagttgtttcatgtgtatatatgagttatttttctcaattaggatgcaaacatgctgatggcaggaacttacaatagcttcatcttttgagttctatcatggctgacatagattagcagcagagtgtcaatgtgtgcagtgagggaatgatgagtcaatgtctgagtgcaacagtaggtgtcaagtaatggttgttaaataaatgcattactttaataatctgccagtcagtttatgaataaggtgaagaaataaacatatatttctttttatttttttgcatattttaaattatttcctcttggtctatatagaaaaggagttaaaatgtgtgctttctaaagtctctctgattttttgattgtctatttatgtcattgtggtttttattctcaattttggggtgtactccttcataacttgtgtttatgtgtctttcttttttattttattttattttatttatttttattttttcttttttttctttttttattatgctttaagttttagggtacatgtgcacaatgtgcaggtttgttacatatgtatacatgtgccatgttggtgtgctgcacccattaactcctcatttaacattcggtatatctcctaatgctatcccttccccctcccccgaccccacagcagtccccagagtgtgatgttccccttcctgtgtccatgtgttctcattgttcaattcccacctatgagtgagaatatgcggtggttggttttttgttcttgcgatagtttactgagaatgatgatttccaatttcatccatgtccctacaaaggacatgaactcatccttttttatggctacatagtattccatggagtatatgtgccacattttcttaatccagtctgtcattgttggacatttgggttggttccaagtctttgctattgtgaagagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacttgttgtttcctgactttttaatgattgccattctaactggtgtgagatggtatctcattgtggttttgatttacatttctctgatggccagtgatggtgagcattttttcatgtgctttttggctgcataaatgtcttcttttgagaagtgtctgctcatgtccttcgcccacttgttgatggggttgtttgtttttttcttgtaaatttgtttgagttcattgtagattctggatattagccctttgtcaggtgagtaggttgcaaaaattttctcccattttgtaggttgcctgttcactctgatgttagtgtcttttgctgtgcagaagctctgtagtttaattagatgccatttgtcagttttggcttttgttgccattgcttttggtgttttagacatgaagtccttgcccatgcctatgtcctgaatggtaatgcctaggttttcttccagggtttttatggttttaggtctaacgtttaagtctttaatccatcttgaattaatttttgtataaggtgtaaggaagggatccagtttcagctttctacatatggctggccagttttcccagcaccatttattaaatgtggaatcctttccccattgcttatttttctcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagcgtgatgcctccagctttgttcttttggcttaggattgacttggcgatgtgggctcttttttggttccatatgaactttaaagtagttttttccaattctgtgaagaaagtcattggtagcttgatggggatggcattggatctataaattaccttgggcagtatggccattttcatgatattgattcttcctacccatgagcatggaatgttcttccatttgtttgtatcctcttttatttccttgagcagtggtttgtagttctccttgaagaggtccttcacgtcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcctatcagcttaaggagattttgggctgagacaatggggttttctagatatacagtcatgtcatctgcaaacagggacaaagaggaaggctttatgtgtctttctccattgcattagtatgttggaataaagtccactgtgatcacagaacacagtttgtggaaaataaagtctaggacttcattttctcatatgtaatctttagtcaccagtgagaatgagctgctttcattccctcaaatttctaatacagggtacaggggagcaatttgagaaccagctggatccactgtaggggctgggagagtagcttgatctcttcacttctctatcccctcacctgagttcttataaataagtcttagaaataagttcttataaataagtgacttatttataagttttgtgttcagcagttctggttttgcaatgagaagtgctacaacttctcaatgaataccaagctctttctcttctttctggggttgtaaactggcggtcctccagagtggcccacacaacgttagctccatttcaaacttagagccaacatccagatttctggaaactctttgaaaagtggaagatccggcaactttggcccagatccctggctggccgtgtcacctcggggcatagtagctgctgtctttgaaggatgcatgcttggccctccctgttgctcccttacctgaaccttagtggaagcttccagttaccctcatacttgtcgagtacagtctaatggagaataaaacactgactctgcaccttcaataaaaactactttggtcactagatatgtgagtttgttctttctccaccagaatataaaacagtggagttttatgtataaagtagagggagatggtcaggctcaattttatccttttcattgcatttggaatctgagtgatattcatggaaaggacaacaaggagttcaaatattagaagtggtgtctaatgtccacttcagataatggtgagatcaaatgattgcgatgcctatggacactgatgtcgccttggagatattaagtaggatatcctcagatttataactactctatactcacagtgagattacagcaggaaaatgaagttcatcaaattttcattgaaaaaagtaaacaaaagctgccaaataaagatttaaattcctctttagggattcagcaaatacttgaaaagcaaagtcatccttatatttacatttatattttgttcaaaatgcgctgtaaccattttgaacaaaatgtaactacgcctctgaatttgtctaagaaaaatccagtaactcttttttagatgagtaatatttactcatttatgtgaataagcaattgacaaataaaggaataaattagatattgtggagtacctaatgaaaatattagaatgtataaggcatggatttctaattcatgtaataccttaagaactagattcttggagagaaaatattgtcagtttcagataaaaggattttagatagaagatgaatgtcatcaaaataagcagcaatggaaaatagagaccagataagtaaattggagaattgcattactcaggaataatttttgactcaataacagacacaccccctcccaatcaaatggcagtttaaacaaattttgagggaggtcttattttgaggaagtgtaaaggtaggcaggttagggctggtgtgaccactgtgtaacatgaccaagtctctcatcagagaccaaggcttgctttggcttgtggtctgtaagatggaaccacacttgcactcatgctctaagatatctgcagggaccctagagtcatccctgcgtctcaggaaggaagaaagtaaaatgccaagggaaaacaaaacgacattgcttgttctttaagtaaagaacttgacacctttaaagccaccttttcaggagcccactcagtggcttctgtttctttttcatacaattatatttcattgactttgattgcattcgacaggatatagctatgcctatctgtgaatgagcctgggaatagagcttcgtatttgggcacattataaacctgaaaaaaaaaatttgtctctaagaaacaagggggtcattatattgtataggcaactagcattctcattgctttttctctcattcggggaaattaagtataatcaataccttgaggcatagtttgcaggttctatgcaaaagccttctctggggtgagccaggtaagcagccagggagtgagacagggaatctgaatacgggctctaagaagtgaagatgaaaagctcagggatgggcatagcatgaggttcatgccccgcaactgcctcacgcaggagggacacgtgggtaaggagactgagtttaggtaagtgtgttttataaattctcatttctcatattttgtgttctgggataatttattttttgttttttggaaattaagtggggaaaaatcctagtatttagcttttgatatttgaattttttgttttctccaactgaacttctcttgcatctgacttcagaaacagtctccagttttgctggaggagcaatataatgctgttctctgcctaatgaaagcagttaataatgattaatgccaaagagtgagtgctcagagggaggaacagagctgctggacagtatccacctttgattgatgtgtttccattggcttttacccttcattgtttctttgcatctgcaatggcgtgaactgcaagcaccattttgaggacagtatgcttcttgttgtagtctctcacatattccaccactccactgagtttccctaagaataaaactcttttacagtaatgggtgtttccttttgagagccaccaggtgtaattattttaccttgttgtatttcagttaaaaaaaaatcattcttaatgtgaaaaagcctaaaaaatatatgaagattgcaaattacataaacgaatggtcaaagaaccttaagaaataacttacccaaaggttaaaaaaaagtaattaaaatgtatatataaaagttccattaatttggaaatatgaaacttttttacttataaattggaaggatgtttttagtgacattcagggttgataagaattcaccgtggagtaactggccagtgtgaataaagagccttaaacatctatacccctttcccaagtagttttattttacagagtccacctcagtaaatgctacaaaatgcaaaggtttatatatatgtattaatacaatctttgaaatttaatttctaatattggaaaaaagaaagcaacctaaaaatctaataagagaattaaatggttaaatagaatgctgaaccacactaaaacaaaacaaaacaaaaaggaaaaaacttttcaaaggacattgaaagacatgagatgttactgatgtcatatgtaaaataagtaagattcaaagatgcaagagaggttcagttggagaaagaaattcaaatatcaaaagctaaatcctggagttttataacatatattgtatataatccgttaacaagaaataatagaaattaaatgggccaaaaatctaaaagtaatggaccctgagtggtacaattatgtattactcttgttttcttctctttttttattttcccattttagacagtgaatctatatttgttcagtcattaaaatgtgttaaatatcttagttagcatgatgtttgttattcactgaaatatatgaagtcaatttctaggacagatgagaacaaaaatgccacataatcatgagaataaatttttagacttctgtttaccacaattatagaaattaattaacctcaagcaagtaattcagtagtaatagaaatagttatccaaattaatatttttcattttcaaaaccatctatgatgagaaaatatttgtctataattcatttataatacaagatttttattgaaaaattttattgttaacacattttaaaaattaatatgtggttcagtttctttttatgatgaaatagttttagcagaccaatgctactgacaaagtcaacaagaaaagctgtataaaataccaacaaaaaaaaatatatttgaaggaatgggaatgccgttaaggcagccagtgcttgagaaacccagatctcatagggaaaagaagctgatttgggtgtgcaattcttccctctcaggccatttgctgaattttaccctgtgcagggaaagagggtgagaagttcagcagataacttggatagaagaagagaagatgtcagaactttctgggttcttacagggttggaagaaaatatagaaggttgagacttttaaagccaccagcccttttgggtcacgaccttggagacaaaggaggtgcgaaaaagggagccagctattccaccctggtttttttctccaaagcatttgccaattcaagaacagtgaaagattagagaataagaagccaagaagaaagtgactaacaaattgattagaactgggtgggagcgctggtgtgcttggaaaacaaatactgaatttcaacatccatgaagaagcatggacctcatgttcttacagaagcgtatggaagtattggtgaatcagagagatcaaacctagcaaagactgccacctccctggcatcagctcagtcgctgattggacttgtgagatctacccctaattttgatgactgccagacaataggataaattatttcaggagaattattacaccgttcagagcttctacagtgtcctacattcaataaaaatatgtccaaacaaacaaaacaaataagcagacaacaacaaactaggactgttaggaaatacagatgatagaaagagaaaggtgagacagatattggaattatcaaatatgtgtgatatatgtttaagagaggacaagatatagaattcaaaagatatttagaatcagtaaaagaatgcagtaactaagatcgagaactcaagtagtgcgtttaacacagattgggcataacagaagagagaattagtcaaaacaaataagagatagacatttaatgatgaaatatttaaagctttctcccagtgatcgaggacaaggcaaggatgcctgatagcaccacttgtattcatcattgttttggtgaacttagtccatatataaaggcaagaaaattataaaaagacataacaaatggaagggaagaaataaactgttattgttcaccaatgacataaagtaatttctggaaaaccattaaaattattaaataaagttcatagaaaataagaatataagaaaaaattagttgtacaactatcctagcaacaatgttagacatgaaagagtatattctgcataattccaattacaaaaatttcaaaaattgatctacagtaatagaagctaggttagtggtggagttggtgggggacagaagaggaaatctgggggtgttagtaatattattttctttcacttgagtgttaaattgatctgttcactttatgacaattcattgagtcatgaattcatgatttgtgcatttctctgtatatgcatgataagtgatactaagattgacatactaggaatatgagacatctacataagattttaaagagtgataagagccataattaaaattatgattaacacacttttattcttaataaagaggagtatgcatatgaatcaagaaattggtaattttagttttagagtcttgttggcttttaaacatctgttcacttttgtggttcacagatattcaatttttattgaaatttaaatgtgaaaacacatctgtttctctgattcatatttttatggtcaactctgaaatgagacagttgtgaactgagaaattattcaaaacacaagggatgtgtcttcctattatttgtgaggaggaagtacaataaagtcctgaaatcagcaacttgcattggtggcttgtttacataaggaatatattaaatatttccttttctactgtggatttctgtctttctcaattagactataaggtcaatgtaagaagggttcctaaataaatgattaaagaaattaaagtgtgaatagcagagctacattttgaattagagatttttaaaaatattgtcaaggtaagggacctgcggatgatatttctcatggaaatctatacttgtttagatattttttttccagtccaatgaggtaatgtctgatcgcctagatgcttctgtcacaaccttagcaaggatcatgatttctcaattgtattgctcaagagcctttggctgctcttactgaccagcctattactcatcttgtacactttgatttatgtattcaccacactaccttcaaggtaatctggccaaaattttattttctaatttttcagcttaaagtttattaagactttaggacacgtctagattcctttcctctaccataccctcttagtttcacttcaaacctcagtgaaagtgtgacctttttcaagaagctctcagggctggaaccagatatctgtgatctagttacatttcccacattcttaccaccttgagttataacatgtaggattatttgtctgctctgcccaataaagtgtaagacacctgagaaggatttagagtaagaataaaagcaagagagagagagactgagagagataattagcgtttttttctgaaaatgcattgtcctcttaatgctcatggtactgttgggtctcagctttctcatcagattctaaaatgctcaaaaactttttgattaaagtaaatgtaattgttgccctgcaccgtggtcttatattttctcagatatatactaacagcattagaagctgtactttactttctttcttttaggaagaatattaagttagtttgtgtttaaatgaactaattgttttgcaaatgtgtttataaggagatgatatacatttttttttcttgtaccttatggtaaatacttgaatgtttgtattatatattttcccagtatcttcctttgacagtaatttttatatcatgacccttatttcatgttgaaaagcataaatacattcatggtaattgaaaatattaattacttttctttagcatttgtccaaaataaaaagtaagtatcaccagtgatttaaaatgcaaattttgagaaatacaaaaattggatcaagttctggctccccatctgctggccaggtgacttcttttttttctttttttttttttttagtcaacttttaatttctagggtacatgtgcgggatatgcaggtttgttacataggtaaacatgtgccatggtggtttgctgtacagatccgcccatcacctaggtattaagccaagcacccattagcttttcttcctgatgatattcctcctcccatgtcccccttttgacagaccccagtgtgtgttctgctcccccacagcccactgatatgtccatgtgttctcattgttaagctcctacttataagtgagaacgtgcagtgtttggttttctgttcctgtggtagtttgctgaggattatggattccagctccatccatgtccctgcaaaggacatgatctttttcctttttatggctgcatagtatttcatggtgtatgtgtaccacattttctttagtctatcattgatgggcatttgggttgattgcacgtctttgctattgtgaatagtgctacagtgaacatatccatgcatttatctttatagtagaaggaattatattcctttaggtatatacccagtaatgaaattgctgggtcaaagggtatttatgcttctagatctttgaggaatctccacactgtcttccacaatggttgaactaatttacactcccaccaacagcgtaaaagcattcctttttgtctgcaacctctccagcatctgttgtttcttgactttttaataaaggctattctgactggtacgagatggtatctcattgtagttttgatttacgtttctctaatgatcagtgatgttgacctctaatgatcagtgatgttgaccttttttcgtatatttgttggtcgcatgaatgtcttattttgagaagtttctgttcatgtcctttgcccactttttaatggggttgtttgtttttttcttataaatttgtttaagttccttgtagactctggatattagacctttgtcagatggatagaaggcaaaaattttttcccattctgtaggttgtgtgttcactctgataatagtttcttttgctgtccagatgctctttagtgtaattagatcttattagtcaatttttgcttttgttgcaattgcttttgacgttttcatcatgaaatttttgcccgggtctatgtcctaaatggtattacctagattttcttctagggtttttatagttttgggttttacattgaagtctttaatccatcctgagttaatttttatataagatgtaaggaaggggtccagtttccattttctgcgtatggctagccaattctcccagcaccactcattaagtaaggagttctttccccattgcttgttttcgtcaggtttgttgaagatcagatggttatagatgtgcagtcttatttctgagttctctattctgttgcattggtctatgtgtctgttttgtaccagtaccatgctgttttggttaccatgtgactttttaaaaaaaattatttatttatttatttatttttagagacaggatctcactctgtagttcaggctacactttatcttagccaaaagaccaagaagtcatgtcgcccaggctagagtgcagtggtgcattcatggctcactgcagcctcaaactcatggactcaagagatcctcctgcctcagcctccagaggatctgggcctgcaggtgcatgccaccacacctagttaattttttttacattttttcagcaacagggtggccatgtgaccttatgtaagttacctaaaccctgtaagtctatgtgcctcatctgaaaaactgataaaaacagaaccctctttatagggtcatggtggagaagaatcaaacagtggacaaggaatatttagtataatgccaggaaactagttgactggtcatagtcacacagatgcttcagggcaggcctatttcttgcatacctgtgatttcaggacattttcagaagtcccagacctagaacccataggtggagaatccaaattttttgtctgaggacaatgaaggtgtcagtgaatatctactcccttacaagagctttgttacaattgttcaaacctatcaacttctagatggggaagactggaagaaggttcaagaagtgtttcctcagaaacacccaaaatgcacgagaaggaaatagacgcaccaaagttacctcaatatagtgatcatcacagaataagaaacttgagcggccgggtgtggtggctcgtgcctgtaatcccagcactttgggaggccgaggcgggcagatcactggaggtcgagagtttgagaccagcctgaccaacatggagaaaccctgtctctactaaaaatacaaaattagccaggcatggtggtacatgcctgtaatccagctactcgggaggctgaagcaggagaattgctcgaacccgggaggtggaggttgcagtgagccgagatcacgccaccgcactccagcctgggcaacaagagtgaaactgagaaagaaacaaagaaagaaaaagaaggaaggaaggaaggaaacaagggggagggggaggaggaggaggagaaacaaagaagagaagaagaggaggaggaggaggaggggaggaaaggagaaaggaaggaaggaaggagaaatttgtgccattgactaactgaggccagtatcatggtggaaaagcctgttactagtgttgaggtgaagaagcttgaccatataagagatacttctgaatttattcaggtgaatattgggatatcactgattttatcagattcattatatttaagagtaagaaggaagaaaagtggaattctgggatcatgaagagttcagaataaatgggaaaaggaaatgcagcactaaaaacatgaccaaaatcaatcaacaaaagtcagtcaacaaatatatgttaggtacatatgtgaattacattggtgttcaaaatagaatctttgactttaagtgcatacattttaattagtaagaagagggctccaaaaacatgtaaataggcagcaagacaatacatgcttttggcaagtgctattatgaactatgaccacacagtaagaaatgaatatgggtggtagagaaggcttctttttttttgagacagagtctcactctgtcgccaggctggagtgcagtggcacaatctcggctcactgcaacctctgcctcctgggtttaagtgattctcctgcctcagactcccgagtagctgggactacaggtgcgcaccaccatgcccagctactttttttgttttttgtttttttttttttgtatttttagtagagacagggtttcaccatgttggccaggatggtctcgatctcttgacttcgtgatctgcccacctccgcctcctaaagtgctgggattacaggcatgagccactgtgcctggcctgagaaggcttcttagatgacttatgtgttgagaaataaatgacaagacagtgaacaaaatttggggggaattctttacaagcggaagtaacaacaaataaaaaatgccaagtttgccgatttcaggaacgaaaaggatcactgtgttcagatgatcataactgaggccgaggaacagagaaagatgagttcagatcttgttctgaaaacagaccatgcagggccctgaagtccaagtttggattttattccaaattaatgaaggcccttggaagatttttagaaggggaaggtgacatacttttctttcctttgagagatcactgtggctgctatgtggtggatgcctccagggacccgaaggtggggacaaaggccaactaagaaacacaacaggagttcaggtagaagatgatggtggcttagactgggagcggtggaaatggtatcataatttccatttgacatccattttaccaaaggtttgagatttggaatatgagtgaaagggaggaatcaaggtcatttttggtctgagttactgtctgaagagtcatgccattaacagagaaacagaaggcattgaggagctgactcgacggtggcatgggcaaatcagtggttctccttcggtcatgttacatttgaggtgcttatgatataaagtgagaagttcaatacagacgtctgaaagtaaaaagagaagtctgtgttagacatgtagatgtcatgtcttcagaatgcagatcggtgtaaagctctgggcctggatgcaaccacccagggagaaagtctacttatgggaaaggctggggacaaagcaacatttccaggtctgggaggagagacctggaaaccaagaagaaagggtcaaagcagtgctgaggaacaggcagatttcagttagagcaaaaagataaaagcaatgttcagagaagaaggtgtatgggtatagatgaccttggtgatgacagattaaatttcacagacattaggaaaggagtgcagaggagaaggggccacgaggaatagatcagaatagtgacgcatttccttttggtggcgtgcaatctggagacagatttctgaagatgactgaggtgaaagtgatgcaaggaatgatgcacttgcttaaaagcaaagtgtgccatgaaggcggggatcttggcaaagaggagaattaattcatcaaagcaccctgcccttgaaatctcaccacactgctagattgaaactagattgatggcacagaatgggtgttttgttttatcttatctctctattttcttatgtgggaggagtggacatattgcaaaaagcagttgccagacatgcacatttaaatgtactgaaacgcaaggtgatagacaagaaaaatttagtcaaatttatgcattaataatttatcttcagaaaatgcaaatccctgttgtagttattttcctatttctacaaatgtaattaaagcattgataacacaggggaaccacagcatcggaattgagaacaacctggtgtgaaagaaaagaagtgttgaaaattttaagtttccctctcctatgctttctattatttctgtgtgtaaacccaattttcacttcccctttctatgaagctaatgctagatcttatctcttgacatttaaaacatccactcttcctgccaacattcatttgcttctccattgttaaatcggatagtcacaactctgatgtgctgtgttgtagtacctgagctgatcgtatggaggcagatcttatgacgctggccattgccacaagtgataattggcaatgcccaaagagatgctatgaaagccttaatattgttgacgaaaagagtcaaactctgtgaaatatttgaagagatttattctgagccaaatatgagtcgccatggcccatgacacagcctcaggagaccctgagaacatgtgtcgaaggtacagcttggttttatctattttaggatggcgtgagacatcaatcaaatacatttaagaaatacattgatttggttcagaaaggtggcacaactcaaaacgaggtgggggaggggggcttcctcgctaaaggtaaatttaaacgttttctgattgacaattggttgagtttgtctgaagacctgggatatatagaaaggaaatgttcagattaagataagagactgtggagaccaaggttcttttgaagttttatagtggctgcccttagagacaaaagatgtcaaaggtttcccattcagatctttaaaaggtgctagacttttagttaatctcttcaggattgggagaacctggaagaaaaagatctagctgttagtagagattctttactgatgcagttttccccccacaaaggacagctttgcaggtccatttcaacatatggcagggaaacatgttttgggctaaaatattttgattttcttccttgttttgtaatgttatgcctgagtcagagtggaaagtaagccacaatatatagggttaaataaaatccatctgatgagaatttatggtttgtagggcatgactttctagacaacttaggaacttgggcaagataaaaaaaatcagagcttagtccttaatatccagagaatatgatgcattttcataaaaaagtaaggatcacccacttaacactctaccctttcaaaatccactcatattgtaatttgtttgtaataggtgacaatatttttctttcatttatagataactaatcttcacctttatcaaacatgtctttcaagagtatgtaatacatcgattgcagctccaagtctacatcatctgtttttgcatccttcttatttacttatttttctttttgtcaataaaatacatcttaaatatatagtcaggctcctctttagctcaaatagtgttgttttgtttaattagactgtgttcccagtattgcttctatttttttttctttttttctttttttttttaattatactttaagttttagggtacatgtgcacattgtgcaggttagttacatatgtatacatgtgccatgctggtgcgctgcacccactaactcgtcagtattgcttctatagaaggctagcccaaatgcagagaggaaaatggcttgacttggccttaaatataatgaagcttgtacagtgtgcattgtgttttaagtttgaatatgaatgtaactgctacatgtattgtattaaattaatgaacttttattatgcttagcccagtgtatcctcagtttttaattcaagttgcacaaaaatttattattttgcttcttgataaaatgatttattaatattttattcaacctcattgttttaagcttttctgaaacatattccctctttaatcaatgatgatatgctagctttaggtaaacggtctgatgttaacacatatacagagagtataaaattccacttgactcctcaagtgcccatcaaacattttttttaaaactcttttgatacatcttagtcccattctgcattttatatgggtcccattctttgattttcatttgttttattacatttgagtctctttacaaattagctaaatatgcccaaactctaatggtgttgttgtagattttttaaagttacaaaatattttgagattggttttctacttgttgaaactggacttcatattgcagggtaatattcccccatggggccatcagtattcataaatctatttgatttacatgttgaacactacatgttccgtaaaatacctagaatgctgcacatgtggatgaatattaatgattgtctctacaaataataaagcaaagaacaaatgacctctctttaataatctagtgttacagcagtcctgaaagaagtgggcagagcaagggtccccagccctcacagctcttcttatcctttgggtagcacacaagagaaagaagtgcatttgagagagttcatgagcaattttaaaagacttctgtaggaagatagatgcttttatccaaaaaatggtctacttactgatttaagtgattacatctgcattctctcttcactaggaaagaatggccaattaatcaaacttaaagtaaattcatctacatttgaaattctgtcaggtataattcaaatgtgtactttggctggtaccaaatatgtatgctccttttaagaaacaatgccatattttgggataaagttcaactgcaatttaagtcatgaaaaaggctactgggagaatgaccttaattaaaataaatcattttcaaattgttcctaactaaaatatttgttataattttagatgaaattatattgcattgtttactcatatctggaaaaataggtgtagttaaaatactagaagaaaatcagttgaaacattaacagtatttgttcctaaagctatgtttaataaggaattttctgccttctacttatgtgttttaaaaaaattaaagtgatcgtgtattgctttaatattatgtgtgttgctttgataatactttttaaatcagttaaattataatctaaaataaaaggtgattttagtgcatatacatgcatgtgtatgcatgtatatgcatatgtgtcttatatacttatattaaaattttgaactggcaattagggaagtggttttttaaactgggataatacattttaaaaatatgtagtggatgggaatctcaggtaatggcataaaagtgctaatgacctgcacaagcattgaatgaaagatgcaaatgagcagcttaatggaaaaaatatgaggaacttggtgctaaatcattcacagtcaacctgtttctgggctggggtttcctaagcagcggagcacctccctcactaccgtctattgaaagtcagcttttaaacaataatagtaataaataataaaaaataataaaaatatacatatatcaaactttgacaccatggtgtacattttagataaatcaatatttgttagactacagcactaacaagtttctatcttaaacattatagtgacccctaatcaggccttagagtggtgattgaattttttttttttttttttttttttgaggcggaatctcgctctgttgcccaggctggagagctggagtgcagtggggcgatctcagctcctcagctcactgcaacctctgcctcccatgttcaagggattcccctgcctcagcctccagagtctacttaaaacacataaatagaaggcagaaaattccttattaaacatagctttaagaacaaatactgttaatatttcaattgattttcttctagtattttaactacacctatttttccagatatgagtaaacaatgagatataatttcatctataattataacaaatattttagttaggaacaatttgaaaatgatttattttaattaagatcattctcccagtagcctttctcaagacttaaattgtggttgaacttcatcccaaaatatagtattatttcttaaaaggagcaagtatatttggtaccagccgaagtatacatttgaattattcctgctgacagaatttcaaatgtagattaatttactttaagcttgattaattggccattctttcctgtagctgggactacaggcatgtgccaccgcacctggctaattttttgtattttgagtagaggtggggtttcaccgtgttagccaagatggtcttgatctcctgacctcgtgatccacccacctcagcctcccaaagtgctgggattacaggtgtgagccaccgcacaggtcctggtgaggtaatttttaagtaactatgtatctgttcatatgtaagtatatgtgtgtaggagtgcagatgccagtgtgtttggacctctggggaaggagagggtaagcaagagatatgatgcaactcagcctcagatgagctcaatcactcacagaattaattaaggtaattgaccctcattcacttctgggttcctcaataacagcactactaacattttggaccaaataattatttgctgtggagactgttcttctgtgcattgtagggtgtttaggagcctccttgacctccaccctatagatgccagtagcactgtaaccaccagacaggttcttcctgcccgctgaacaaagttaattcatggagaccatagcattgcagtaaagaaatagtttaataaagttgaggccggccacaccacgtgggagacagttgtaactcaaatcaattttcttgaaggctcagaggttaggggttttttcaaagatagtttggtggataggggcccagggagtggggagtgctgattggttgggtcagagatgaaatcatagggagttgaagctgttctcttgctctaagccagttcctgggtgggagccacaggactcaggactggttggcaaatgctggtggggccatccagttttcagaaatgcaaaatcctgaaaagacatctcaaaaggctagtctcaggttctacaatagcaatgatatctgcaggagaaattggagaagttgcaaatcttacgacctctggaataatgggtgttaattatgtaactatgtttgcatcttagcagaattcaggtccctctcatcttcctaacctggtggccttttattagttttacaagggcagtttacttttggggaagggctattatcatttaaactataaactaaatttctccctaagttaaccttgcccatgcccaaaaatgtgcgaagacagccacccttgaggctagaagcaagatggactcaaccatgtcagatttctcttactttcataattttgcaaagacagtttcaagacctctctattgttatatctaaaaatgcctccaaacattgtcaaatgtctggcattttgtgagcaggtggttgggatgggtaggaggttgtctgggattgagaaacacaaaacactgctctaaatttgttaccaaggggtgaatcattttgcggggaatatttcatccagatgctctatagtcttttccatacaactgttgacattcaattaaagaaatatgaaacaggactaaggaaacaacaacagacagtagtagcagatgcataaatgaccagttattaggaattaacggatatacatatttaaataactataacaaacatagtaaaaaaaaaaaaatggcaaggtgggtaattggacaatatccagtctaaagtacagataactcaaagaatattgtttttcctgactttggttcatggtggtttgcttccttgtgtgtgtattttttggtcttcagtttcgagcttatcctaaactccggaatatcttgaaacctaagttcaggacacgtttttcaataagttttgtccatttttgagatgaatattactgttcttgcacctcttcagtcctcatttcatgacacctactccccggcttactcaggtagtcttgggtctatcttttccacctttatggcctgaagtaccaatgtaggaatttacccacagagctcctttcatgtgagcttatggtttattcctcttgcttcagcttatagctcttgttttcgggtttcctgaaggatattacttcctataagtccagtaataaaacaaacaattgatatttggtataatagattatttggtctttgcattgctggaagctaaagcccatatactgtgtgcttcattgtaatatatctttcatcatgctatttcagaatgtgacaattactaaaagctgacatttgagatcatatcaccacctaatattttttttcaaaagtaaaagtaaagtggaagataaacgagaaacttagaaaagactaggtttagaaagtttattaattatacttctgaaaaagcaattgtcattttctaaacggataaaaatgaactgcaaattaaaattcccagtggaattaatgcagtgactcattacataatacatcatgggcaagtaatccatcctttgtactctcaggcaatcggatgtatttaagccaaagataattcaagacaaaagtaatcagggttcctccaacatcgctttttatgtgacatagagcttatcattgtttaaagcatcgaactgcttaggcattctttgttctcttttattgccttcatttcattgtctgaatagcttttgtagtatgatgttaactatcactgtttggactgattgaatagtttatttattttgataaccatcaggtgaaagcaaaagtcatttcatggcaatttcctgttacttcaatgagacactgctttccaaaaatggcaagaatgttcttgacaattagcatttacacgtgattttaaaattttactttgtttttattcttccatatgagctcttttgattttattgaagctttgaatgagtgagacataagcacagtttaagttgtatgatgggagctaaagtaagtttaatttcaatttcaagcaaatactatttattctacattttctatagtcagggagacatgagggcttgcatgaaggacctgcatgtcaaattcctctattttctgacttttttccattaccaatatagacataatcacatacatttggttgttcttacttttccaacagcctccctccctttctctttactgtaattggaagcatatttccatctcttcctctgtctccatccctcccactttgatattcttattaaagtggaatatttcctcttatctggtagaatgtgaggaaaatagggcaccctaatttatttgatcaccgttcagtttttctcggtaactaagtttgtccctgaaagtttctggtctcacttatggttacattgttaattatcttggaatagtgaaaaagatagtcaatatttttttttcatatgtcttcccacagtgtctgaactatttccatgattttttgactattcgcttttgtctttgtagaaaatattcattaggatataatttacaaatctaattttcatagttctggatcacttattgccccagtaaattccattatttggaactgtacctctatacttaactactagtgaatggcagaaggtgtttctctatcctagcttctttagggaaagaaagattatttgaagggaaccacaagcagctttgtttctatctgtgatggaagataacaattttaatatttaaatagatgttgaataaatgagtatgatttttatatgtacattacatagtaataatagtaaatgtctttgggaaaaaatgcaaataataccatgatagatgctatcagagtctaatagattatataacttgactgcacatatttgaaacatttaagtagaaaacaggactggtagttacaactggtgtagctttatgaatctctaattctattacatctgagacactttagagatcgcttgatctagtctctttgtgcagaaaacaaggaactgaatctttgagaagcaaaagtggcttatccaggctacataattaaaactgtcatcaaaatgggcctcccagctgccatcacagtgcttggcccataccaaccattgattcttactttcctatcaggcctgggcatattccagtctgtccaccatttcttgtgcatatccttacaataaacatgaaatttatattttataatccaaattgaggtaatgttccatttgactgtcatacaaggtttcccaatcaaaagcagatgagatagtggttgaggccaaggcatcctgggtattagttatgtatttaaattctctaattaattgtctccaggaaggaaacaaatgtgtacactttggaatttgtctgtattactactaatgtaaaataaacattgcactaaaacttggatgatgattgaaaaaacaatttaaaaaccatgaaagaacaccacaaaatatttttcttacttgaactacattaatgttcaaggtggcctaagggaaagagagagaggaagtgctgttttaaaatgttctctctctctcttgagaaacagcagatttattgtcataataatctcaaaatgcttttgaggaggtcagcagatataaagtacatgcagattgagtgtaatcattatatgaaaaattaaccacatgaacaatgaaatggtactgtggtagcagccctttgtcaaattaatgttctgaagagtgttatttgtgaaatacaaaggctctgaaaataagtggactggactaacttcgcagttttatgtgctacatttgtaactggattccagaaaaaattattaggagaaggagaatttagagcttaacattctgttcacctaatataaagttacagagtgtcagatcagatagcatcatccaattagtcaatttacattgacataatatatatgggacttccataatgaacaatagtcaaaatgtattattttgggaaatcttgaatcaaattatttacaggtatcctgagagatctctattataataattgtaaaaggcagcaatagctttctgaaaaatatttatatattgtttcttttttaaatattgtttaattatacttattttttatttatgtctataatgtaaggtaagggttaaaaatactgtttaaatgcagttgggatatataattgatccaggatcaatttattgaaaaataaacttttttcactgcactgtaacattagcccaccataaatcaagtgaccttatgtgtatgaacctgtttgtggtgtttctattctgtttcatttgcctatttgtctgatcttgtactagcaatccattcttgtttgtttggttggtttttgtgagatgaaatctcactctgttgcccaggctggagtgcaatggcatcatctcagctcactgcaacctctgctttccaggttaaagtgattctcctgcttcagcctccccagtagctgggattacaggcacccaccaccacactcagctgatttttgtatttttagtagagatgatgtttcgccatattggtcaggctgattttgaactcctgacttcaggtgatctgcctgccttggcctcccaaagtgctgagattacaggcatgagccacctcacccagccaatacattcttaaatactatagctttacagtatgttttaaaatctgatattgacatctgtccaccaattttttttttctcagcaaggctttggctatttgtatgcctttgcatttgtgtataaattttagaataaacttgtgaattttcttaacatgaaaactgttgggattttgatgtggatgcattaaatctataaatcaattgacagaattgacagcattgatgttctaatctatagccttcctttttatttgtatattttttaattcacttaataatttgtagttttctataaagaggtcttgacatatttcatgaatattcctattttctgttttttatatgttattataaatgacataattttaaaaatttatattttaaatgtttgtttctactatataaaaatataactatttttaaaattattaaccacttgtatctagggaccttgctaaattaatttattaattgtatgtagcttcttttatattttctacctatataatcatgtcatatgtgaataatgactgtagcatttcttcctttctgtactgtttgtatttctttttcttgctttggggcaattagctatggcttctgtgtaatgttggttaggtgtagtgatagtgagcattcttgtcgtgctcccaatcttggagaaaatgctttgtgaaagctatcagaatcaaaatggaatcacttttgtcaaacccttacaaaaaaaagtggggaatatgaagggagggttcttatgcacaattgcctaataacaagaactatcataagagactgccaaaaccgcagcgttgcacaaagaccaccacagtcttacacacacaaaaatatatatacttatgtgaggatctgcccagcaactgcctgcctaaccttggacggacactggctttgttattgatccttgtagccagggataattatctcaaaataacttatataacctcctcattttaccttcaaaaacccttgtcttttgttttcctcccctgaaggtgtctgtagtttactatgctatgttattccatgctgtactgcccactgccagataaacttattatctttggagaatgtctgtctttctgcccattattaagactgacataatctggtatcaagaaatgggacagaagtaagctcacctggaacagccgggcagcccctggaatcaagtgcagtaccaactgaatgaaccctttgtactctctgcttccaggagtcaccttttctgccctggtgattctcctcttaaattcttggactgcctccttttagtgagttcttttgacttgacttgggaccgcactggtttatccggttgcctcaagtagaagatattgcatccctcttggaactgtgagcctgtcttctctggcaagttctttttaatagaaggacaagtatctttccagagagttcttggatttctgcagaacttacattatttgtgaggcatgtttttttttttctcgtgaattcacttttgattttttcttcatgtttgatttaatgttttgtttgatctgtaccactggcttaaaatttttgtgagtacagaattttgttttatttttgtttggttacatgtgtctaatgatttagcaattttatgtttttctccctcttgtttatgaacatcttttgaaagcaaaaataggcattttaaacagtggatgtgggatggcaaattgaaagtcactagagcagtcaccaccatctttgtggcaccttaataataagagcctcagagaaaaagtctcccatgtcaagatcaactgttacggacaggcaaggtcaccttcaggaacccagtcggttccaagaaaaattctatacaatgaaggaaacttggtcacaggtcaaagaattagggcacaagccatctgccaagtatgaaataaaggaatcttgtgccacgtacacttgtgaaagcaaaacgatttgtccaaatccttaaaattccttgacagggcttataggattatctgtcgctctccagagattaataagaaactgaatgacattccaaaattctaagacatgccaaacccttagactgctatacattcaaaatttatggtccattctcatgaacatttttttaaactgatgggaaaattacaccaagaataatgtatggccattatggagattgttttggccttccaagcttgtttttctcagaaatgaattagaaaagtgcaactagagggctaacatatagtcttttaagtttcctatttttctattttatctctgcctatttgaatatactgacgtttttgcttgcattggaagagaaactctctgctgcaattgttcttgaaactaaaataggtcaaagtctgcttggagattatttttctcatggcatttcaatgaaacataaacagcaaggaattaatccttaatctaatttaacactgagaaaaaaaaaaaggaaaagaaagtaaaagggacttattaaaacaaagttgctagagaaactgctttacccaaaatttgatgcacagccttcataatattacccatcaggacaaatgaaaatcttaagtttagccatgtgaacatttcccattgtgtcagaaactgaatttagattcaattgtccttttataaaccattgagtttatattactattttactgtctcatgactaaaatttttaaatgaaagctataagatctttgtgtgtatatgtgtttatgtgtgtttagacacatatgcatgtgttatgttgtatgttgtatatacataatacaatctggcatagttggccagaaatcctttaaggaattcttttcaagttggcttagagataagatatgcaaatgacacttaaaagtgtaaaaaaaaaaaaaacccaaatgccttttagctcatgggattcatatgaatctttgataaataaattggttttaaatttgttggtaaaataaaaatttgtttcagaattgttagcttacattttgttgcctgggtttgctggttagacaggattacattgatctctgttagatgttttacagtcataaaactataaattcagcttaggccaggtgcagttgctcatgcctgtaatcctagcactttgggaggccaaggtgggtggatcacctgaggtcaagagttcgagaccagcctgaccaacatggtgaaaacctgtctctactaaaaatacaaaaattagccaagcatggtggtggcctcctataatcccagctacttgggaggctgtgtcaggagaatcactggaagccagggggcagaggttgcagtgagctgagatcatgccacttcactctagcctgggtgaaagagtgaaactccatctcaaaaaataggtaaaataaaataaaatatattcagcttaatagcaaaatagattttgtttgtgtagctctttaaaaaagatgactaatattgttggtttaagaaaaacagctgtattttctgagttactggcaaaatacccatatatttcaggttcctacttgggtgatgaacacctgatattcacaggcttcaaaaatagttaacagagaatcaacttgaaatgagaactagcttgtctaatatctcagttttcatgaataatctggtataattgtttaaaataaataggtgaatataaatggtataaatgtgtataaatgaacttttcatgtaatttcagatgttaaaattatgttattttgaattaagtaatattcataaactggattatttccaaataagataaaataataaacattaatttctgatcagaggttcatgtttatttaattttggcttcttaaattttacaggaaaacacaatatatttggatctattaaaaattatatcatgtttcacattaaaaatttgttctatgaggaagcacacattcctagaagttgtaagatgtatattcataagctgttgctatatgacaaatagttcaaaatgcttacctcctaggctttaactagaaattaaagctacaaagagttaaaccttttaattaatatatgtaattctatatgtaagttgtacaaggaagtaagatacctttttcgttaaaaaaaaaagtataagcatgggaaatatttaaattttggtaggaaggaagaataattttgtctaagggttatttcaaagtattaaaagaaataacaacaaagcaaaaagaagccaataattaggggagtgagagggatgcaaagaaggttatgaggaagtgtttttaggtaaagaagttaaaagcagaaagtgaataatatgaaaaataatattgtgtggtcagaatgataaagggaaataagaaaaataaatgtttgtgctaaggtagaatttaaaaagaagaaaatataggagaaaactgaaagcttaatcaagtcgtaaaaggtctgaggagaatgcaaaggtttgtaaagtataatcttatgaaaggaatttgtgtgcaatcaagttggcttaagttagaagagaattgtttacaattctttctaaaattgaacattactatactgatacaaaaccagaatctagtcctctgtgtttaaagcaacacagttttcttggattattgatctgctctcagtgaaatttgcagaaagtttttatttttaattgtaaaacttgtttcttttaattttcaatcattttctgaactgcatcttttgcccaatttacagttttcatttattttttcccaattccagattaaaattgctatgttcttcttttaaaataccaatttaatttcacaaattggagtttcctcttgaagcttttcagattcatgtctcagaagttcaacttttcattgcatctcactgcacataatttgcaggtcatacatcattgcctctagctcttcctccttctcttcctgcagaggtacatcttttcatattgttaaagttgtgactctctccattgactttttagtcagctcctactgcctttttttccccctccagttgttactctgccactgtggtctgatgctggaaaatgtcttgaaggcccagaagagcaatgtcttcctccaggataacttgatctgttctcttggcttttcttgatgtgtctgaattgttccatgtaatgaggcaattttgcatgcttttactttttttaagagccacatattaccctgctcaaggtactagttttcttgtttacttctatgatatgaagtgcactcataacctcgggcagacaattccagtgtcttagagaattctggtatcttttcattgggttcaacttccaggttatttaaatggacttccataagcagacaacaatcacactgcaggaggttcgtgtttgtgtgtttcttaaaccttttgatgatgggcctaagaaacaaaaattttgtgttttatcaagataattccctatgctttatgttgtcttactaggtttttcattagtgagggaaactgagctttgaaagagttaaagttttcttacatccttgtaattttctgtatttatttttgacattttctgtcactctagttaagtgaataattattatttcatgatgacatgtgattctgttttaattaaatgttttaaaccttttgacatctttggcaggcttccccagtatcaaagttctaaattaagtctttttgacttcaaattaactttgggaatttctagtcaggaaattctgaaggatgtgtctctcatcttatgaaagagttattaaacgaattaggcttatttaatatgttgggttgtctggtaagcattgtctaataatagagtgatgccaaatctttttcaagttatatttatatgaatatgttattgatatgaatgttccaaagattatgtaaaatttatagaagtctgatggctctggttggatgctgtcaaccataattctggttgttatcttaaaatgttacatgcgatagaaataaccgaatttcttcatcaattttgtcattattataatgaaccctgcagagttcaaattcatcagatttttaaaccatagttattctaaatctttgtcatctactgttacagttttgtttcttctctaaacacatgtgcattcagatgcctagaaaagactccagtaattactcttgcttacaggtttctgataacactaaactcagtaggccaagcgaaaatttccagaactctgataaagaaactgatacattcatgaaactgctaacaaaaatcaagcagaacaaaaattaattacatgaagtgaaataactaacaaagatgatgttttatgacttttatttgaaacattgttgtttctttacttaaaacgtttcagttgcagatttaaggaaactttccctcttaagctaattataatttacagctatttgacaaaagtatacctttgttttttttttgtttttttttgtttttttttgagacggagtctcgctctgtcgcccgggctggagtgcagtggcgcgatctcggctcactgcaagctccgcctcccgggttcacgccattctcctgcctcagcctcccgagtagctgggactacaggcgcccgccaccacgcccggctaattttttgtatttttagtagaggcggggtttcaccgtgttagccaggatggtctcgatctcctgacctcatgatccgcccacctctgcctcccaaagtgctgggattacaggcgtgagccaccgcgcccggccaaaagtatacctttgtaaactaaagtggaaaaatttactttttatccctatttgatcctatcaaaattcagaaactacatgagtattcttatgttttttaatggcagtatatatgtttgtgtaagttcaataagaatctgctttctttataacagaatagaactggaaatattggctatattacaaaggttttgactgagatgtgatatttaagttatttataggtactacagacaaaacctgaagcctgccttggtttgactttttagtctcaagagatatttaagggtccaatctgagattactatatgtttaatcactattcttgctacatttatgtaaataattcagtcacatttgacaaaattaaacttattttacaaacaaattaatcttattctcattatctttagtaaagattgggatgactgtagagagaaaaattatgtttctaaagaaaaactctaatatacttgttagatgttggccctgtgcatagtttcttagtttttattatctatctgtagactagactggatcttgaattcttctgatataggagttaagaagaaattacttaggcagatagtgagaatatgggagtcctcagtaaggttttccttttaatgaaaagcagcccccaaatcattttcttttcttacgaagagcagcctattgctggcagttgtgccaataggaagaaactacctgggaataggcaggctcaaaatggcagctccatcctctctttgccagccacacgtacagtaaggagcagacaagatggttctggccaagtggaaagtccatttgcataataagattagggtggggcgaccagccttcccacacacaatgtaaatgtcacacctgatccaatcaatctgtgggccctacataaatcagacagtgccttctcaagcttgcctgtagaatccagtgcactctgccaccagcaggtctttccttttcagatacctctctctggcaagagacagacagagacggctgctctcctctcccctttcttctgcttattaaactttccgctccttaacccattccatgtgtgcgtgtccatgttgttaatcttctcagcacaaaatgaccaaccccaggtatttaccccagacaatgatgccacttcacttgtaggttcctccaatccacttttctctcatgaaattagtgagaacaaaaccacccttttctaaacccgcgtagaatgaagctagacaatttgatgtaaatttcaagggacaagacttgtgcctgatgtttgagccacacggcaagttcaccaaactgtcgaatgctgtaaccagagaccttcaaaccacaaaccagggtgagaagttgacaatttcatgctgggaaaaattcttcccaagacattgaaataagattccttatcataatgagactcttgcccctcttaatttttccttgcttgtgcctacctttttcacttggcaggataatggtatagttaaaatttcacaatcaatagcttctgcaggaagctgtaaaaaatgttgcatctgtcatgcccatcctaaatatttacatgccctgacagataagcccttagcctgcccaatgggtaacttcaacagcatctctagtacaactgttgctcattctgtgttttaattcaacccagctataagatacgaaatgatagaattgctctagattctctattggttaaataaggagatatttgtgctattgccaataatacatgctgtacctggataaacccctttgggcaagttgtgatgcaaatactcaagaaaataggccacatagttacaacaggacttacctaattccccatggtcatttggctgattcagtcagttgctttcaagcctaggttcttggctcaatattattacataaactagaattttcctattactattaattttactttgtatttttctttataaactttgtacttattgcttgtcaaatttcagcagaagtacaactcctgagagaataatgctggctcagagttttgagatgataacccttgtctatgaaactgatgaagttggacttaacaacgaacactccccacagaactcctgatgctcaaatgtggctaaagggtttcatactgactcctaatcagcaatcacttccctctgacatgggatcagagttacccagaacaagttcatcctggcactgatggatgatgaaaatctaaccacagaatgattagtcagcaatggttttagagacgtattttgatcaaaaggggcaaatgtgaaagttgtctgaatcaaaatgaagtcacttgtgtcagacactgacataatgaagccaggaaaggccatgaagaaagcattttcatacacaattgcctgataataagactttgacaaaactacaatcatatacaaagccattgcaacctaatacacacacacatacacacactcgcgtgcatgcacacgcttctgtgaggatatctgcttgtctaaccttggactaatgtcagacttgtttttgatccttgcaactaagaatagctgtttcaaaataactcatgtaaccctcctcactttacctttaaaaacccttgtcttcttttgccaccctgagtacttccatagtttactatgacatgttctgcattgctgtgcgtgttcctgagtaaacttactatctttggagaacctctctctgttctgttatttaagatgaaacctttcaatattatacttctaaatatgatgtttgatataaatttagtttagattaccttcatcaaaataaggaagttactttctatttctttcttatgaatgattttaaatattgtctaatatagagtatatatgttgagataatttttttttctgtcaaaggtactatttattttgattttaaaatgataaagcaaccctctattccttgactaaatctacttatataaatttttttgtatatttctgggttcaaagttcatgagattgatttgtaacctccttttcctaatgtctttatgttatttctgtatccatgctattctagtatcataatatttacattctagatttagtttaacttcatcttatttttatggaattttttcacttagatttaccctatatttgctttttgtttttctttatttgcttcttgacttcagtgtttctctttctctttttgatcttttatctaatatgtgaagaaattttttctttaacatttcttctgataggctcctctggtcacaacttctgttagtatctgtttgtctggaaaagttctgatttttgccttcaaatgaaaggatatttttgctatgcacagaattctaatttgacaatttttttcagaatttttaaaatgccatttcatcatcatctggtttggccatttgttttggtaattcagttatcagtcttgttgctttttcctttgaaagtaatgcatctttttatcttttactactgtaaaaatttttccctttttctttgtcttgactttgtcatgactgtgttatgtctctgtggatttctttttatttattctctttatgttccatgtctcagatctgtagtttgaattagtttggcatttgtgttagtttgcaaagactgtcaaaaaaattattaaagactgaatggcttaaacgacagaattttaattctcacagtcctggaagctagaaatccaagacaaagatttaagtaaggttgatttcttccaagggcgtctttccttgtcttgtacatagccttccctttgtgtcttcacatgatctcttctctttaatgtgtgtgttcaaatctcctcttctagtaaggtcaccaagattagggtcaccttaatgatctcctttaacattaattaccactttaaagaatctatcttcaaatataatcatactctgaggtactggtaattaggacttcaacatataaatttaggggtgggatatttcatccaataatagccgtgtaaatgtcttatccattatttcttcaaatgtcctttctgcctcattctatcttttctccttctgagaacccaattagatgcatgagatacaatttcaagtccaatgtatctcttatgctcctttccccaattctttttcttccctatctaatctgggtattttctactatcctatcttccagtttgctaatctttccttctgtgtctagtctaccatcgaatatccttattcaatttttaattttactgtatttttaaattcagaatttccactttatttgttttttacagataattgtctagtgagtttctccacacagtaatattttttgaacattttaaaagtaatagatattttagtcaatgactgatgatttaagtttgttacctgcatcattttttaatctctttctattgtctgtttttttctcttttatttttagtgaatctgtcctgtctcttgacatacctgtttttgttttgttttgcatttttgttgttgttgttggttttggtgtgtttaaacattgtttatcaaaatcggtagaattttgtaaatgatatgatcttccttgagggacagtttactttttttctggcagatatatagatatagatataaatatagatatagatatatatccaattaggaattgagataatatctaaagtgaaaatctgtggtgtttatggaatgtttatcaatacctccttcttgaaggttgctgtgttccaattactgtatttgcagcaagatcaaaaagccaaaagttctgcctagtttattcatattttagatattgttttctgcttggcatttcaacctcttgccccaaatagtttcggaagtgacaaatacatcaaagagattatttggatagaaggtagaagtcactttccaatggtcctcttttctctagtatcttggccacttaaatcctggttgcctttgggtttacttaatactgtttattggatttttggtaatctaaaaattatttcttacaacagagacaaaaattccaataggactttaaagtggaaaaggagtcggttgaagaataatgtcagtataagatattcgtataagatattatttaaattaccattaaattaaataagcatagtagcattactggctgggcacactgtctcacacctgtaatcccagcactttgggatgctgaggtgggtggatcagtcgaggccaggagttgggtggcgaaactccatctctgctaaaaatataaaaattagctgggcgtggtggcacatgcctgtaatcctagctacttgggatgctgaggcacgagaattgcttaaacctgggaggtggaggttgcaatgggctgagatcacaccactgcactccagcctgggcgacagagcgagactctctttctaaatatataaatacataaataattagcactacttaatagagaaaccataagttatctgaaacatattgtcggcagagggggaaaaagaagaaagcagaaattcattttagaatgagaaacatattaggtgtgaaaaaactatataccactgtcatatacaaaaatataatatgtgtaggtctatttgtgaaaggcttttactctttaggttatatagttcttgaatttttaaagctgttcagacactgtaccacaacctcatatcacagtggtacccagaaaatccaaatagtagtacttgtgtaaatagatttctatttcagcctctttaaaggcagttatgtagatactcttaattttgaatttttggaaatagggaggatcattatttcctaaaattatagcacttataagtggtagatagggaattctctcgtaggtctcagactccagagcacaaacgaccaacctttatgaaatatgaacttcctggcttcacttccatctgggaggagaaatgtattcccccttatgctaatccattccattcaggacaatgctcatgggtagaatcctatttattatagtatgttaaactctacttctctgtaactcttacttattaatcctgcctatgatgaatgtgctgtaaaatggcaaagtcaaagcaaatttactacatccttaaactttaagcttattatgtttctggcatttggggctatacagttcccaggttctgcatatgtttgacacggcttcatagataaaaatggcttacatcccgaatatgatgctaaaaactgttttccaaaattggatataaaatgtgtgagtaggtgtatacatgattattgatacgaccttatttttgaaaataccatttaactacataaattatatatagttttacttatgtatttttaaattataaactatttttatttgaaataatttcaaacttagaagacttaagaatagtacaaagagcttttttgcataaactatttgaggataagttgctcacatgaatttgcatcatcccaaattcgcatgtacatacattctcacatatgtgtaaactcgtatgtatgcaatattctttctaatgtctgcgacttggggaagtttattttggtagagtcaaaaacaaagactaataaaaagataagctagaagaaactgttgttttatggtgaatttttcttaattttaaaagataagcctatttgtgaaggaaagtatattatgtatttttctattgattttgttgttcaatttgtaaaatatatttgctaattatcccagatttgggaagaaaacagtttaattagcacttctgaaatgtgtattaaggaagtgacagattcactgagactttttttttttttttgagatggagtctcattctgtcacctaggctggagtgcagtggcacgatctcggctcactgcaacctctgcctcctgggttcatgcagttctcctgcctcagcctcctcagtagctgggactacaggtgctcaccaccacacccagctaattttttgtatttttagtagagactgggtttcaccatgttggccaggctagtcttgaactcctgacctcaggtgatccactgctttggcctcccaaagtgctgggattagaggcatgagccactgtgcccggcccactttttaatgttttaaagcgttagtaccaagaagttcaaagtgactagagcctgattctaccctactcctttctcctccccaaataaactcatcttcaagaaacactttttttaatttttttttttatttttttgagttggagtctcactgttgcccaggctagagtgcagtggtgtgatctgcaacctccgactccctggatcaagcgattctcctgcctcagcctcccaagtagctaggattacagacatgtgccaccacgcccaggtaattttttgtatttttagtagacatgcggtttcaccatgttggccaggatggtctccatctcctgacctcgtgatctgccctcctcagcctcccaaagtgctgggattacaggcgtgagccaccgcgcctggccgagaaacactttctatagaaacatttatctgattatatcaacgacaacactttctttcactggtgcatgacgttgattgcctgtgtgtgtccttcagcatttatctcataaagtaattttatggtgaattacagttgagtgtgtttgtttacaatctggaatgaaatcattaaagtcaatgtcaaagatcagccagtatttcataggacttatgtattcagaaatccataactgtgtttcgaaagcagggcactgcctgatgaccaatcaatgggttttgccagctagaaaaaaggagatttttactctaatttacatgggctgcttcatggtggactacactggttaagaacttcagctctacatttcctacctcagtcattcactgactttttaaacttggacctgtcactcagtttcagaattacttttgtatatgagtatgatattactacctaatttatagcgtttttgttagaaaaaggtgaatcttgaatagtttttggtgttgttgtagaagccatctcaaggttcaaataatgagataatctgttagaatcctaaatgacctcctctgtgatgttttgctctatggtttggaaaacctttagagatgagtgtggcctggcgcttctcttcccattttcaattttagacactctaagacagagaagagaaaattatattagtacagaatttgcttaaatgtcttagttcctcacatagtccatgactgattactttaatccttgtgtactaagaaaacacaaatagaagaatcgacatttatctgtattttaaagttatgagcaactttttcttggctaacgattgatctgtaatgtcaacgtggcttgcattatatgaagttttactggctgttttgaaatggaaggtgagggtgcctcttcactttcaaatgtctgaaggaagattactgtattcgcacaaaaatatttgtacttagctgaaatggcacagaatattatagttctcaagtgtttaattccttctcatagaaattgcaagggaacttaggatgcatttggcaggcgctttctctagtgcaatcaggttgctatggcaaacctattattttaggcgaagaaggactatgttagtaaagtgctaatctattttctgttttatgtgagcctctaattactccccaactattgagcacatactgcaagtgtggtttttatcattttaaaaagtgaaaaaaaaaataaggtcatggagagtgtgcctactgttaccacaccagcaggtgcatttgatgatacagtgctctcctgaaatcatctcattctgggtcgggaatacactttttttttttttcatagaaaagtacaatgaaaaaggaagtgaacaaattgtatgtgagtaattgaactccaagcctcccagctgtgttttacttattaaaatatgataataatatctaatatttgttgaacacatactatgtgccaagccctgtactgtgtagtttgtacacattataacattcagcccttacaatcatcctgtgctatgggtattatttttactcccattatgcagccacaataaatgaggtttaacttattcttccaaggaatcacatttagttgtgtatgcaccaagattaaaatccagacctattaaaagttagagcccacatttttaattgtacctgtgccacaaagtgtatttcccttttagacacttaaacaaacacattaagactcaaccccacattatctttgccagaacctttctctaaccctgcaggccctgtgtgcacgtgcattttaccttaatttcccctgctagtaaaagtgttaaaacatccttctttcttttgtatctcaatatctagcatgatacttaccccacagttgatagtcaaaatgtgtctggggaatgatcaaagtaatgcagacatttaagattgtgagccctgctaaacctattcttcagcaagaacatgtgtgttctctatgtggggtagttagaaggaagttagtattcttcagcggaacactttaaatgtgaccatatagggaagaaacgtatgtgtatgtgtgtgcgtgtgcctgtgtgcatatgtgtgtgcgtgttgcatattcagtcatggtttctgaaggtgattacaatttttaacactagcagttcaagtccaggcatctaccctgtggcttctgagtttacagattttcaccctttcacaaatgtgcaaaaatgttactggtggtcatgcagaagagatgtacttggtcctgaataaataatgactttcctgaattagttatctgaggactctcttgattgtcaatccatgaggttagtgggcgactgtgtctgtcttgttcgtcttcttgtctccccatccaagatctagaaacttagtccctgctggtttgaaacctgtgtcatgtggaagtgagaccttaaagcgagaaaatcaaagaaagtgagggaaggagatgtcaaagtctaaggcttgagatattggttgtggttgagattatgaaaaaagaggaatccaagaagaaaagaaaaacctggaagaaagagggaaggagtgaaggtggtgtgtgtctgtgtgtgtgtgggtgtgcgcatgtgcgcatgtgtgtatatgtgtgtgtgtgttgggagagaatagtcagaggggaaagggagggagtagaggatcaagaagaggcagagaaggagagaaaagaggaagaggaatatagcttgaaaaacaaatgtcaaacttcacaatttcacaatctttaccttataccagttttagaaaattaacctctaccagaagttgacaactttccataaggcagtgcttccagatatgagtcatccatgaatgtttaactattaaaaaataagacagacaatagttaaataaaagattgtggaacaagagatgacctttccatttcttctcttaccctctgattatttctactgtaactacactccagcaattaatcaggatgtgaaccaatgaaactactaaagttttaatctatttgtaataatgcaaatgaggcaatctgtattttataaaggtcacaagctactctttttcattttgtcttatactttagatatactgacttaccctataagtaaaagaaaagttcgactttgtctttctagtattaaaataatagtattttgtttatataaatcttgcagtatcttatggataacattccaaaaaaactgtgaatgagagtttcttccaggctatatcaagtaaaatttagtaacaaagatttcagaaatgtcaagtatttcaatgaacacggtaactttcctaaaagtgtaattatttcaagtttgcagttaatttccatcatatttactaaaagacaaaagtaatttcatgttcacaatgatcaatatatattacttctattgtgaataacccatttttgccctcagttcatttttcttttgctcatttattattagttatttttattttaacttatacacatagtaatgttttcttagtgtctatattgtttgtacaaatattttgtccttgtttattgtttatattttagtcttaggttattcattgctctatagaaattgaatattgaatattttatggtcaaatttattaatattgtcctttatatttctgatttggtgtcatatttagaatagttttctcacccaagtgttatgaaaactctcacctatattcttgtctagttttatgacttaaacttttacatttgaatgttgaaacccctggaaacgtatttagttgtaaggagtgaagtaaaggaaatgaatatttttgaaacatggctcaccaattttatcaaacatattttttgaataatccattatgcccagaaaagtatataacataaatttatagcattatgaatcatataaagtaatcacatgcccagattcagaaatagaagaatgccagaatcctaaaagctccattctcacttctctgaaatcagcataccctctccctaaaaagataacctttattctcatgttcatgtaatcacctctatacctgtctttaaagttttccgcctagatatatattcccaaacagtgtgatagttagacgtgacttttttggaattaatccaacagcatgcattgttttatgactgagttctcgcactctacattatgttcttgagactcaggcattacgttgaatgtatttgcgattctttcttttaattgctatagtgtttcatttaagaatatagctgatatgtaagtattccgtaattgatgaacatttggggcatttctcctttgaagttgctaagaataatgttgctatgattattctggaacatttcctggttcacatgtgtatgcttttttctctagggaacttacccaagaattaaattgctgattcttagattatgcatgccaacttcactagataatgccaaacggtccccagaatattctaccaatttatattctcaccctctgcaaaagacttatctgtatttccaaaccattgccaatgcttattagggtcagtttttaaatctttgctaatctgattgggttggggcagaatctttttgtggttttagtctgcatttcccatgtgaataagaggaggagtatcttttcatatatttactggccatacaatcccatttgctgaagtgcccattcagatctcctgcccatgtctttaatggattgtatgtatttgttgttgttgttgttagagttctttaaatagtttggatatgagacagttgtcagatatgtgtgtcactgatatcatctctcattctgtggctcaccttttcactctcttattttctaatgtactagagctcctaattataattcaaatggttaatattttcttttttagttacttactccagcaccatttatgtgaaaagtcatctttcctttgttgcttttcagtgtcaccttgtcctaatccagtatttgtatatgcaaggaattgtttttggattctctattctattctacttggtctccacttccaccaaaatccaacttttatgattactgtgcctttaaaataagccctgatatctatttcaaaaggtatttctacctccttcttgttcataagtattttcgttattggtgctttccatttctgtataaatgtcataattggcttttaagctttaaaaaatcctgataagattttggttgtaattacatcgaatctatagatcaattaggggatatttggtattttaacaatattgaataataagcatacagtatttcttcacatttaaatctcaaagctttcatttgtctatgctgcatatacatatgtgatttatttttgtatatatgtttgctatagggcaactaatatactctcttaataatccatattatttgttagtagtttttgcattgtctacatgcacagttttcggttaagtaatttttgtttccttctttcaattctttatgtcatctttttatccttaccatattctaccgacaaagacatctagtgcaatgttggatagaactaaaagataaatttatctttctcttattcctaatccaaatagaaggttttaaaatgtttaccattagcaccaaccaattattattattaagtgcatgcatatcctttaacattttttctctcttcctctttcttcctttttcactagtaaaacactttatttactatagttagaggacattttatttggttgaataatataaaattgatgacgtctgactatttttgacttataaaaagagtcattttacattgttcagcttacctgttatgacatttctccacttattttccatagatacacacagactctgtttttaaagtatttctgaatattaccatacttgttatttcagacaaatttgagaatcatttcatcaacttgaaaacattcagtgagtttgattggtacaatattgatttattaattcaggaaaaatcagacacttcttaataagaaagtatgtccttttaaaaattataagtcttctcctatggccttcactatgactttatatgcaaagttgtataagttcatttattttacgttgctgatatttttgtacatgaaacaattttccattatattaggttgggttagtgttggcacataaaaattttttcatttctgtatgttaattttgtcacaagataccttgccaaaatgttttattcctttaaatgcatttgtaatttttaaaatcttgggcataaagacagaccatctgctaataatgatcttggctctttattatattgtttgtctaatttttattaaattgcacttaaactataacaatggttgttataaacatctcccatctctaacttagatcactccctgttaaccataatgttggatttcttttgaaaagattattatatatacctgttggcattagtatttaagcaattttctagaatagtgtcttctcaggggatgactctaggccagtgatatatttgagagtgttcatcatgtaagacagttgtttaatccatgggatagcaggaaattttggaaaatatagaggaaagaaggttcagggctgagccatggggcaatccaagatttagatatttgtataaagatgagaatccagtaatatagcctaagaagaattcgtaatccaataatagctaatagaagaaagtatttcccaaaagggcagggtcaactctcaaaagcttctgagaggttatataagatggtacagagaattggccactgggttggggtcattggagacattgctgaagaagtacttgtcacatagcagtatcttgaggtaattggattgggttgagatgagactggagttaagagaacagcagcaaacttctttttgggaagtttactttaaattgtactttgctgctatgcttttgcaacacaaggtgttttctatcttttactcatctatgttttgcccggttcctatgttactcctcccggcaaccaccaccaccactgctttcccctattagaatgaagcagttctaactaagcctccttttcctcctccttattctcctgcttctccttttagctgcctttgaggtttagtctctcatatatggcaaccatataaagagaaaaaaataatgtgatgtatttttcatggattatgctgagataatttttgaaggcagttcactgttagtgggagaaggtgctgtggtctataggtgaggtctggaaggacttcagacaaatattcaagtgctgactaatttataaacccagagcagaggttttacttccagaattatttttacatataatatattcaatctaatagcattaaaatgctatccaagaatacacatagcattctaaaattttaagcttccgttttaatgaatactttaaagattttgagctagtcatatagaagattgggtttaaggttagaatgagataatgtggattatgttgagataatttttggaggcagttcattactagtgggcgagggtgctgtggtctgtaggtgaagtctggaagggcttcagacgaatattcaagtggcaactattttataaacccagagcagagttttatttccagaattagttttacatataaaatattcaatacacaaaatgctattcaaaaatgcatataacattctaaaattttaagcttcctttttaatgaatactttaaatattttgagatagttatatagaaaattgggcttaaggttagaatgagataatgttctagtaaattttagctgtctatatattctattaaacaattattacatatattgtgaccttttagttttatactagtagcatttttttattatgaagttagtaatgctggtcaaaatgtttagggtttaattttggtgatataatcattcctccacattttttggtagtcaatatgcagtaaaatgaggtaaatgctatagaatagcagactttagagacatatatatcttttatttaacagtgtactcccatatctaatcgtgtatttcatacgaaacagattcttaaatatttgttgaattttatataaaatattttggagtaagtgaatcaaggttttcacattttcatgtagttcttatgagaaaaaaatgtactctaaggtgaaaatagacactttatctgaatcttatatcttaatgattgtgggaaaatataaatttaaagagatttaaattaagagtttttattaaaatgattacctgcacatagttgggctttttgcttatatcttgacttataatttgtctatattttacacaagttcagagtctgaacttgtttgaatttttaagtaaaatctattttgatcggaacttctaaaaatctgccttagttcattattcttctttgatagcttataatgagctttaaaatataattcataaaaaatgcagttctttatgaaatgatatcattggaatgattttatatgtgcctaaagattatctactttattaaaacttaataagagtaggcagactcaatgtagagtaaatttcagataagttttggttggatgatattgatgatgttggctgaattaatttcttctcacacagttatttctatgctcctttctgtctgtttctgaattgtcttcttgcaaattacttgctttatttttatttctttgggtatctctttttttagattttcttttaaatatgtcgtataaagtagcacagtgctagaaaggcagatttccattttccttctttctcatgtatgagaatattaatttggtattgatttcagaagccacagttgtatctccataacagtaaaacaatcactgaaataataataataatattatttagtaaacaaaagaaaaagattggactcaatttcttatctgaaatcaagtcaataaacctgtatgtcagcatccttctactacattaagggagaacttagttggctgctaccaagatacaaatctcaccgttagtctggaccgtagtgattttatcatttaacaattgggttgaggcacttgcttatctagtttaaactttgcattcagtattctactaggtatagacaaagggctgtgggatcagaaaggtgacaattcttccaggtaaccaacctgggatggcaaggaaggtttcagaggagattagatttgggctggctatagaacaccgagtaggactttacagagaaaatggtggtgtgcaccacggagggaagaaatagggaacataaagtctctgaacatgagtgctctataattgctggatatatacttgaaaaggttaagttggaccatgtgtggaaaactctgttgaagaatctagtctttgctttgaaggttacatggggccatcagagggatttgtgcaaaggaattacacaatcatatgtatgtttttaaaaagcagattatgtggattttcacagaagacccaagaagaagagtaggtttgtgaatacagatgatgaatttgtcgtgggacatatttaattgatctgaccatggaaaacacaaatgaaggtattcaggcaattggaaatgaatatctattctgggagagatataccatttcaaattcaagttctaccattaatgctcatgtattgtgtgaatatttctatagtatttatatatgattactgtttaatgcacgtgttcaataaatattgattcaaaacattatgattgccgggcatagtggctcacacctgtgatcccagcactttgggaggccaaggcgggtggattgcttgaggccaggagttcaaaaccagcctggccgacaggtgtaatcctgtctctactaaaaatagaaaaaaaaaatcatctgggtgtggtggcgcatgcttgcaatccgagctactctggaggctgaggcaagagaattgcttgaacccaggagacagaggttgcagtgacccaagattgcaacactgcactgccagcactcaagcctggggacagagcaagactctgcctaaaaaaaaaaaaaaaaaaaaaaattatgaggacacataagaagcatacttaattttattgtatttgtgaaattgtgtgagtaggaggatgccaatgtcacagatttggtgaagttttccttggaccttgaagaatgattggaaatttacctgataggtatatgataatgactgaaacaaaattggtagtgatttgtggtagtggctaaatagaagttgtgaagtgaggcagcaaaataataaacttacaaaaattagccaggcacgtgcctgtagtcccaactgctcaggaggctgaggcaggagaattgcttgaacccaggaggcggaggttgcagtgagccgagatcatgccactgcactccaacctgagtgacagagcaagactctgtctctaaaaaaaaacccaaaaaaatatggaatgcatgaagaatttactcttttttacctctctgtctgcaataaattagcctttcctaatgcattatattttaattgttaactttttaaaaaatgttgtggatatatagtaggtgtatatgtttgtgggagacatgagatgttttgatataggacacaatgtgaaataagcacaccatggaaaatgggttattcatcctctcaagaatttatccttttgagttacaaataattcagttacactttttcacttattttaaaatatacaattaagttattattgactgtagtcatcctattgtgctaccaaacagtacgtcttattctatttttggtgcccatcctaatacgttatttttgatttttatcagaagccactgtatcttataaactgtattagggttacatgcaaaaggttaattcatctcatagttgccttagtattagtcattttaaaactccaatagatacatggtgaaaaaagaattggaaattggttactatattctctgatattttaaaaagatatgtgaattgttatttatcaggaaagaaaatgtgccgacgccagaatattaacactttattgtctaactttacacaaaaatatgggacagaaattatccacaatgaaaacaacggaatgttgaaatctgaacacatatgccagtgtttagttcatcttttctgaagaggcacagaagccaatgaggcacattcaggaaaattacttaaaatgtgaattacttaaaattacttaaaatgtgaataaatttgtcaccatgaatacatataccctgaaacgtagaaactggttctatgtaactggaatgcattgcccctcaggaataatgcaactgatgatcatggcttcccacatctgtgtgtgaaggaacagttcaccatatccagaccacactgctgatggtactacagtttgcctctttctccccacagcctgcattattggaatcatttgcacatccacccatgaaaaagattagagcatttatgcacattgaaaggtgactggagttcagaaaatctaggttctaaaaccaacactactaatagatagagagctggccttgggcaaatcatttagccccagcatgcttgagtttcctcatctattaaataaattgaaggaagtcatggatccttctgacattttaccaaaaaaaatgtgtattggtatatttttccagggatagatctgtgttctgccagttatggttcttgattacaaacaacaaaaccaacttcattaaaagggataaaaaaatattttattagaaggctttaggctcagaatgcaactttgaacaattagctcctgcagcaacctggggaagcaaggcactgccaagaaccagttcctgctgccatcacttctgaatgtcagccactgcaggctgagcttcaaggctcccagaattgctatgctgttgcatttgccacactgcccacagacgttgtgcctttgctttcaccctcaagaataaaagccctgaccaagggtgtctgatgtgtgcctgttctagctgccagggtataggaagagggaatatcgttgaaggagggacccctgcctcctgctgaacctgggactacctccaagtagagattagttgaaggtcagccagcacaacactgtattgccatgtctttcaccagattctcaaagggatcgtgaccccatcatgtcagctagaaaatattatgaatcattgcattagattatctttaattacagctctgaaattatatgatcctaaatactaatttttctttcccccatcatccaccaactcagaatttctttaacaagatacaagttcagcaacagagtgactaacaacattgcaaggtcagccctgaagcatcttgtgattatttcagtgggtgtgtaattatgatggttgggctaatgacagggagtaacagatgtctcggagcactgtcacccaagcaaatttctggcaaaccagtagtgattcctcaaacaaaagaaatttactttctcatatagccttccggtgctgcattagatgtacattaagatacaatgtggtttaatggttagttgtgcaaactttgaggttaatgagaatggatgtaaattttgaatctatttcttcctagctggttcaccattggaaagttacttggcctcaatatgtctcggcttcctgtttagtaaaatgattgtaatgattctagtcaatgtgtggtgttggaaaatgaaatgatgtcatgcagggaatgatagtgtttgacacatagttaccactcaataaatcatgatgaaagtcagcataatgggactagttaaggggttcccaaacgatgaaccaaattcattgcaaaaatatttataattttaaattttaagacgaggataataaagatatttaggttatgctctttgacataggttctatgctaaaatgagttctatgaactataaaattgactacaaatagtcactaaaatagcacattgaaatattacctatgaccactttttttttctcatggagcagatagacccaagattaaaacattttaaaatggccacatcatactaaattatgtcagtatatataatgtattatgttatgttcaaggaatcatcaggataagttgtatatgaaatagccagagagttttataatggatttattcaaaaatgaatgaaacaaaaattagagaatagcaaatgtgaatgacttctgagacagcaactgccacttccactccagaccaccacggaatttcttcttgaacttcagcttaccttagggaggttggaaatgtgtatttgtgtaactattatcaggcacagactggaactattctaggagatttgggtttaatagtgtgctcgcctccttgaaagccttagtgattccgggactctcctcataagtgtgcactttctttatactttccaggtaaatgtgaatgtggcaaatgcacctgctatcctccaggagatcgccgggtgtatggcaagacttgtgagtgtgatgatcgccgctgtgaagacctcgatggtgtggtctgtggaggtagtaacctttctcatagctgtatgctacctgcatgcaacttgctttacctgcctttgttattctactgactcttgctttttcaattgctgttaaaaataagataaacagaaagcaatataccattgaacctaaaagcaatatacaattaggtttgtaatgacttttatttccctgaactctttatttagcaggtatgtgaaagtacgcagtacactatcaataaaagatcattgaatctaagtactaagatactttatgatcgtgaaaggttttggggcaagtcagcattttaacatgattttcattactttatttataaacactggtaggagaaagtataatatcacccacaaacttgaaaaaatggagtaagattactcttagaaatcacaagaggtatacgctcagattctatgatgcctctcatacccaaacaagagctcactggcattaataaactgtccagagaatgagtgaggcagatagaaggtagtgagcagaggtaacccacaaaaatgagagtcccaggagtagagtgctgatccgagcacctccatggctgggaatgtgggtcaacattattcttgcattgcattcttgaaaaagttcatatcgctgaggctgatgcatgtgaattacagatctttccacgtttccagtataaatgaagtgatgtggacatggaattacattacaagaaaataattatatccctttattgggggaaagaaacagaatgtgtgtcttttctaacttttattttaagttcagggatgcataggtaggcttgttacatatgtcttattggagggtggagggtgggttgagggagaggatcaggaaaaataactaatgggtagtagagtgtgtgtcttaatggaaggctgaggcaccatccatccatcctatctgtctgtctgtctatctatctatctatctatctatctatctatctatctatcatctattatctgtgtatctattatctatctatatcaatcatccatatgcctgttctctctctaaccaacgataagacatttgaaacctgacaaaaaaatactttcttctttcctttctctgtgagttgaggggaaaagcccttttaacctgttaatgactgaggttagacttttttgaatttttgcagtcagaccttggtgatgacctggagcagtaggatataaaaaactcccacatgcttagcgtcccaataatggaacaccaggcataaattcgtaaaacatctgctgtgctgggcagtttatcttatgccattgtcatggcagccaccctaagagattgtttctactattttttctttcataaatggaaaatagagtgaggttggagaagttaacatcccataactaaaatgtggcagacccagaatttcagctctgatatttagttcacagatcgttccttatgtcagtcacagttttccctagagtgacaccaacgtgttttaacaatatgtcaatattattcttaggttaaatcctctgttcactggtattagttaaccagaaatacctatgtaggttttactctttttgtttgttaaggacatgacatatattaactcatttatttatcatagcaatatgtatgtatgtatatatacgtattcatgtataaaaagcttgcctggccccttgaaagtgccatctacatgtctctgctcttgttaccattgttacttttcttttcttttcttttcttttttttctttttgagacagagtctcactctgtcacccaggctggagtgcagtggtagaagcagagctcactgaaacctcaaactcctaggctcaagcaatcctctggccttaacttactgagtatctgggactacaggcacataccaccacagctggctatttattttttgtggagatttgggggtctcactaagtggcccagattgatcttgaactcctgggctcaagggattctcctgccttggcctcccaaagagctggaattacaggtgtgagccactgagcctggccagaaatggcttttgtatgttttttctgtctatttgttgctttggagtaatctcagtctcttccactttcatatttaggtcaatgtctcttgaaatgattgatcagcaatcagtcatccttggctttagattcttttcaatttctaataaaagattttcatatgggaattcctccaaattacgcatggtttaaactgaagtaattattttttcattaactaaacaaatattcattgagtgtctactatttgccagcactagacattcagtggtgaacatagagcatttgctctcctggagcttatggttgagcgtgaagggaggacattgagaaaggaatgaaaaggagctgagtgatctgaaaagagatttgattcaatgggaatatacataacggggatttaacataggctgaaggctaagaaagacttctctaatgccttcatatctggataacaactatgtaatgcagactatgtgctttacaggtattaactacacctcacaacaatacttggtagtaataggatacatggaacttggccaagtaggggaagtggggtacagtcagagagcagcttgtgctcagttgtgtgggagaaaagagagtgtgtgacgtgtgccaggaacatttgaggaccagagaaaaaccctgtgtgattgcagattagaaaaccaaagggaaaagagtgtgacgtgttttgtaaacatgttaataacttgaggctttactctaaaggtgacaggaaaccaaaggaagggcttaaacagagcttaaacatgatcacagtgttttaaaaagtacttctggttgtcagatggagtatggattgctccaaggactatgtgtgtttgtgggttggtaggtgaatctggatgttaggagatgagccctggtgagagatgaaggtgccttagctggatggaagacagtaaaggtggaggatcttgaatgtgttggagaacatgttagaagcagtggggtcaagagactaacaaaacccttcaccctgctgcaagagactccagcactctgttaaactcctagctctggttccctggcaacagatgaagatggtgcattgcagtgttaacaagcaacattgctcatggtcataatgatttatgattgataagtttcaactacattggaagagatgatgaattgaactataagcagctgatgggaacctcatgcttttggatttcataagtgtcataactctgccaacagtcttgtcccttgtgggctccttgaaagctgtttacggaatcatcgggaaagattttggctcctgttgggcgtgcgacttcttctaagccagaaaagcctcaacatctgtgcagtgtggatctcatctctgtgcatatgggctgtgttatcccaagagaaaatagtccccaattatatgagttcatcctcatgaactcctgcaagaactcccatgggtatatcctggtgcctgacagtgcctgctggtaagatgtggctcctgtcccacagccttcaaaggagactggtggcaagtgtcagcctgagagcttagttgaaacttagagctccctccccagagtacaagcatatttaaggaaattcatgattgcacaatatgaggggcagggtaggatcaaggatgacaccaggtttctgttttgagcaactgaatggtggaggagactatgcttgtcttgaccagttgtctccatttcttgaaaaattggtttcttcacagagagcaacagagatggagaaacttggatatgttgctccctttggaacatatcccttgggtatgttagttccctctcctagtccttattgtcacttctccttgtgaataacttattgtctttccattcttccatgatttttccaaattacctcctataggaagcctctctgaaatgatgtcctacttcctctataccgcaccacctgcatcgtagtgtgatgaagttgtattgagagtgtccctgtgtcccttttctttaagtctacaattctcatggatataatcaatctctctctctcattatcatatgctcaaagctaggataaaggttagtgctcaatatttttatttgaataaatgatcaagtaaaggattcacaattaaggagaatgagaaaggaagaactattccagttttggatacaggattcttcaagttgaggtgaggatgtgatttggaccttgaacaactagtatttagatgtgcagaaataggatgtgaagaatattttaggcctgggaaagctgggcaaaagcacacaggtgaaaagttatttattagatattgaaggaaaatatcgatttcattttttttttttacatcaagagctctttctcagctgcttctgtacccatcattagaaaggatttttttcacatattacttactcatgtattatttataatatatattatgtcaccttcatttcttatacttggctcatctttagatatcaggtctttaaaaatattgttaaattggtgtttttgctttcaaaattaaaaaaatatatagagagaaatggaaaccacaaaataaaaatcacccattaattgatcatcctagaataatatctgatgacactatgttgtatttcttcctaggttttgtttctgaggagtaaaattattttcaaaatataaattcataaatcttctttgggtattttgatattttgtctagagaaagtccacattgtatggtatcctcagttgctttaatgtacatggtgtgcactttgttgcattttttcatgtaagatttaagtgagaagaagtaaccattttctttggaattaagtgaggcagtgccatatagcaagacgaatgggaaccctgtattcagacagaccaggattttaattctgggtctatttcctgcttattgtagtaacttggacaggttgtttgtcttctctgctttggtttacctatgtatttgtttgacctgtctaccttggtttactcctatatacaataaggataataatccatttggctttatggaaagaaagagacataaagacggaaatgtgcctggtactatgtgccagtgaatatttgatgaatgccctgtatctgtaataaaaataaaagattgtagtggccatctgcattacagaacaaaataatacatctgtctcaggtatctggaagcactagctgcagagcgttttgcaaggaagttggactcacacaaatcagcagctctgtacctcggggaggaaattgcagctggtttttccaaagcaattagtcccccccatcatctctccagtggagaacaaatcttactaatatgagaatgtgaaacacacagacatcatccctctgttatggcttcagagaataacaaaataagagagtcactcattttggtaatttttttagttctccaccagacactaaaccataagatctgtggcctttcatatggagaatataaaacctatatatccaacatgtggccagagagtaaaatatggtacttgactccaaaatcagggactgtcttagcattttagcaaacaagcaaataagtaagataaaaaacatgtataaacttaactgatcagcagatgcatgagcactaagagccaatagtgtttatcccctttcctaccaataacactaaagatgattaaaccaattctgataggttggataaattagcaattgtacctgaaggtgaatgtaactaatttcataatttttacagttcagttttgattacaccaaaattacaacctggaaaagagtcatgaaaatgactagcagaaagaaaatcagcatgaagtgagatcgttcttcatttaattaacttgtgagtcatgttcaatcatcatagactgtctgtggatgttctcaaaacatctttattaaaagaagatgttatgcaacctatgcatgcatggatttattatcagataagtcactatttataaaaagcatgacttgtccagtgatagttcgtaagatttatttattttattggtatatcattttaagattacacaagtgaaatatattcacatactggcacatgtgtgtttaattgtttagcctaatataagttaaatcagagacttccctcctgtgtgccatatacctagggtgagaataagaactaggctgcttattgcttttcttctttcctctatactcctggaatagctacccatgagtccaatttaaaaaacaagaagggataatgaagagccacctcttaattacacaatcagttcacatttcttcagggagttctctagttcatcgctgcaatttgaaggagatcatgccgcctgagagtatgaattcagtgactcccaggcactgatggatttcttgtatgaggaagagatcagatcacacactcagactaaccctttcttaactgaacaatacagtcagaatgtgattgtctccaaattacatcttaaaattgcacacctgtttcgtgaatttgtaagaggatcagttagtcctgtgtttggctgaaggtgatagacacaaatactgagtcttcaggttgtcattccagggttggatggtgaggcgactgcctgagcaccacagtgtccctgaaccccatctctctcttctgctctgcccttccagtatgacgtttatcattgttatggtttggctgtgtccccacgcaaatttcatcttgaattgtagtttctataatccccaagtgtcgtgggagggaccaagtgggaggtaattgaatcacgggggtggttttctccatgttattctcatgatagtaagttctcacgagatctgaaggttttataaggggcttcccccttcactcgactctcatacttcttcttcctgccatcatgtgacgaaggacatatttgcttccccttccaccataattgtaagtttcctgaggcctccccagtcatgcagaactgtgagtcaattaaacctctttccttccaaattaccgagtcttgggcagttctttaaacacagatgttgttatcaatgaatggtccatgtagatgattctccaacagttccaccactcctgggtgttcctcttacaggtctaagtggcaacacagtcgtgttggtgagacaaaagatgaataaaactacttctatggtcttattttttaaactcaaatttccaggaacattccacttagtagacctccagtatgggacacgctcctttgtcatttcatgagacaacacaatcttagttttctccttccttactgaatgttcttgtctggcttctctagttacctaactctaaatattggggtccccaagactaatttctccctggatagctgcttcacttctagggctttaagtgccatccacatttgtaagctctaacatgtgtatgcctagagccagcactaacatgttctctgagcagcagcttgtgcctagctgcttacttgacctcactatctcattgtcttaagagtgtctcaaatacaacaggctcaaaacagagctgtttttctgccctcaacctctttctcctgaagtgcccctacccaataaacagcatcattattcacactatttcttctagctagaaaacttgtcttgtcttttcctcacttgccacatccagtccaacattgtgtcccacatatacaggctccatcaccaaaatagatttccatgtacttctctgtgtttccactgccaccactgtcctttaagcttctatcacttttcacttggaaaacagcaagaaccctctaacttccccatattcattcctcccaacataccttaatctgtcccacctagttgccaaatgagtttgcaaagtgtaaactatatcgtcacatcattcacttccttaatatccttctgtcatttctcaatcctcttaaaataaatttagattttttttaccaagagtaaatcatttgctatgttctcatttctgagaagggaatatttctccaccttcattattcagtgtttttgacttactattcttcaaacacgttggccttcttttactgcctgtaacatgccaagctatttcttgtcccaagaacttttcatttgtttttctaggctctgttcctagaacattggctgtctggctccttctcatcccttggctgtcactgaacccttccctgactaccctagttaacagtgttcttgctattgaatatactagcattttctttttgtcttctattactcaaatgttgcttatcgttattttcttccctagaagaccgtaattaccatgaagacagggccaatgcctattttacttactgttatattctaagctgttaatacaattcctgatacatagaaaatatttcttgaagagataactaaattattagagtttattaaaaagagggtattgaaagttgttttgttcttaagtaaagtcatataaatgacaactcaaagcatttgaatattaatgtattttgatgattggctgagctagataccaacttaacttcgtggaaggatataatagattagctaataataaaaaatcatcgccaggcacagtggctcacacctgtaatcccagcactttgggaggccgaggcgggcagatcatgaggtcaggagatcaagaccatcctggccaacacagtaaaaccctgtctctactaaaaatacaaaaattagctgggcgtggtggcacatgcctgtaatcccagctattcgggaggctgaggcaggagaatggcttgaacccgggagtcggagggtgcagtgagtcaaaattgccactgcgctccagcctggtgacagagcaagactccatctcaaaaaaataaaataaaataataataaataaataaaaaatcatctattttcttgcataacattttatattatttgcaatgagatgccataaaattattcttaataatattgtaaatcaaaggcagaatatcaacttctaaaaggggaaaaattgtctcatactacaacatggaaggatctttaagatatgttaaataaaataagccagtcatgaaaagaaaaacactgtatgatttcacttatataggtacctagagtagtcagatatatagacagaagctggaatggtgatttccaggagctgagaagagaagggaatgggacttactgttttatgggtgcttagtttcaatttgggaagatgaaaatattctagagatgaatggtggtgatggttgtacgacaatgagaatatacttaatgctactgaaccatacacttaaaatggttaagatggtaaattttatgttatatctattttaccataataaaaaatattgtagaaaaaagtagccataggtctactttaattatctgtttctttttatgtgggttttaatagattgtgtcttcacggaattggtccaaatgatccaggttatcagattcttggacaaatcattgtttgtaatattctattattatccttttaatgtccataaggtaagatataatcatctctctcttaattttcatattgaacatttgtgtcttctctctttttacttgtttagcctggcctaatatttatcaattttattgatcttttcaaatagccaacttttgttttattgattttctctgttggttttctatttccagttgtattgatttgtcatggaattgattgtatttcttttcttatgaccaatttagttttatattgctcttctttagtgttttaaagtgaaagattacatcactgattttatatttttcattgcttctgattgcattcatgctgtaaatttctttccaagtattactcttgctgtatcctacacattttcataatatgtattttcattttccatatagtactaattaaatttgaaaaaaaaaggcagaaaacaaaaaaaagacagaatatttttctatgcaatacagattaaatgatttcagttgtgtcaaattgtgataattcttaccaacctagggtcagtaagaaacatgagcatttgagaagttcatagcccaattgagctggtactagaagctctctttctcttcatttttggtttcttgtacaacagattctctgccttcaaagatggacaactttttatttaactctttaaggacatctggactttaagtggactttggttttcatggagaagtaaagatgtactcaatttaacaattattcattgagtagataggggcgtaggggtgccagttttctaacttggctctactctacagtttgatttgtgggtaaaaatgagaaagatgttttgaaaaagacaatttcaatctcctccaagtttttgaagatccactgtgtctcaggcattgtgttaggcactctgaagactacagtgctgacagaagtaatactcagaaaattcatagtagagtagtggattcatttgacacataactatataccatgagatggaagtcaaaaaagttccacaggaggtaaaaaaaaaaaaataaggtattacagaaattcagaggagagacaatgagtctcacttagggatattaggtaaatcttcacagaagggtagtcgctttttgctgagctttgaaaattactcagaacctgaatgtgtatagtaagggaaaggtacttctacctctgcaaaaacatgaggtcagaaaagcatgacaaatgtgcaggaaacaatgaatgggccagtttggttaaagggagaagagaaggaatacaattggaaatgtagcttctgtttttcaagaagctaaaacataacaaaggctagagtaggtaaactctatgccatgagtattaggaagttatacgggactaaatatcaaggcaagttgtgctgtaggaatctacgagccagagtattggagagacatgacaggaagttttttccaacgttgtgatggtgatgtaagtgggaatgttggaggtggtttcaacaagacttgacaacaagctggatgagggcagtaagggaaattcaaatgagactcaaaacatcatgaactggttgattgaaaggatagctgttacattaaaagaaatgagaaagacaagcagcttttggaaagaaaatcatatatggatgtaggagatcggtcagggtggtgggaaaaattgtagaagatgcaaaccttcttggaaggctggaagattttacaaaagctttggaaaaggatttggctgaaggcagccagattctcttatctggtgaaactaatctaaataagtaagttaacataggccttggaacctggcctttgatcatctgagtgcaggactactctctctggggaggggaggggacgggagagaccatgtaaattgcccacaagtgtgttgactcagagcctttgtgattaaatctatactgaataaatgcctgcagtgccagcttgtcagggccacggctgctgactctttacagcaccctccttggtgtctggtgtctgtgagcagcctggtcccctagcccactctttcactggatacctgtgtctgggtgcatttgttcatccgttgttccaccagggtctatgggtcggaccctgcctatgtagctctggaggtattaagtggggatgctaatagaacacaaagtgtggaatcatgaaaggggaatgtaggagaaaatcaggggctggagatacagccctgtggtcttggcagttatctgaaagcccaaaatttaatggatttttcaagaaagaaattatggagagattaaaaaagatgattaaagataaacattgggtgaatacctgcacttattcattcagtaaaaaaaaaaaaaaaaaaaagtagaagaataaatagagacaaaggaggagtgttgaatgaggccaagagaattttgtggcatgccaatagagaagagacttgcaaggagagaaagtgcctgtgaatatcaaatatataccttcaaatgatgtggtggttgaaagagacaagaattaagaaatcctgctgtgtctcactttctaaagtgaaatatagaagcaaagcaacacattgggaagagtgtagacattggaatcagaggaactagagtcagttccgatctggctgagccaattatcggtcacatgtttacatgcatgctacttttaaactttaatggtttcagtttttgggttttttgtttgtttctttgtttgtttttactttgcatgtaaatcaagctaggtgaaaaagaccacaattacctcatttatttgtttatttatttacttttttccttttttgctaacctgtgtgacaagaacagtcattagccttagaaagtgccagagcacttgctgattgagtgcatgttaaaggtatggcagcgacatttttcttgcagatttagtagtcccccattcgtatccgatgtttttcccagaatattttttaaaagaatgtcagacattcctagtatcctgtctttctttcaggatcccaattttctccaggggagcaacatatgctggattaaaaaaccgctctcccagaccttctctggctgttaggaggcacttgttgcatggcctgtgaggtagggatgtggtataacccagggaaaatctctcttatttaatttaaaaagcaaaaaaaaaaaaaaaaacaacaacaacaaaaaaaaatagttttccaagaaaccctctccaggagacttctgcttacctctcagtgatcaaaaaccttttcaccacagttacttaccacgtcctaccgatccgcattctcgcaagtgtccttcactccatttactctactgcatttttcactgtatttctcatgccaaaacttgggcttctccaccagtctgcacacgttcatgctctcaattctcacagccatctatttcattctccactaaactgttagagggatttctgtagaaattaaagaaattcctatcactcctaaaaaaaaaagaaaaaataattataataattaattgcaaaccattaagcattggttactcatcctccctgtggagagctgaatggagggggagcagatggagcaaggttcactcctgagggtcctgccagagcaaatggtcaggagagaacggtgtcaacagcttcagagaggctaatcagtgtgaatgatgagcgtatctgtccctgggagaagagcagggaccactttgtccatggtgcttgattttgtatcccctagtgcatagcaaaatgctctgttgataacagatactcagtaactcttcgctaggcaaatagttgattcagagagaccctgctgtaaggtaatgcacatatcaggaaaaggaataaagggtcgagcggaaactgaaatggaagaaattgaaatggaatatcatgcaatctaatggtgtgttggtggcaggcaataaacaggtgtacatcctggtatatagctgtcacaaatacaatgttacatatataccaaaagataaacatctgaaaaaccaggaaccaatgtcaggaaccaaaccaaaaaaaatgtgccaaacatgaatccaagctaatgttaatttttatgcaataatagagagacaccattacttccacttgtatctgttgttatttgtaagcagagaggtatacagataaactaatatagtgccaaatgccatttgtatgaaagttacccttttgttttattagtaagcaataggagaacaatcaataaatactgccaccagtggtaatgtgactagccttgcaaattggtctggatggcatggtgtgtgcaatgaagaatagcgctaagactccatactgataaaaatgcaaatgaagaagtattttctatcaagaaaggtggtataattccatttaaaattattgcaagatttctttctctcaagtcatctcctatgctacattcaaatttattatgttaagctagaactctgttgtaagttctttcaaacaattacatgccaaattgactatgcataaagaagaatgtgttggatgggaaatgagatcctatggtttacacatttctttcttaaaactctctgcttcagctggttatttcctcatcctctcactcctttcctgtggttgcttcacaggccacggcacatgttcctgtggtcgctgtgtttgtgagagaggatggtttggaaagctctgccaacatccgcggaagtgtaacatgacggaagaacaaagcaagaatctgtgtgaatcagcagatggcatattgtgctcggggaagggtgagtatctctgctggtgcctggactccattcctgttctgacacatgatttgtagaacagcatgtagcaactgtctttcccagactgaactttgcatgaaagcaaaccactatgtcctctgctgtccccaacttgaagcttgaagattaaccaaatgaagttttggatctaagaaaatgaaatgcgtgtgagaggattcatgcaaaaatatccttgtatgcaaagttattgctgaatgaaatagaattaatacttttatcaagaaattaggacaacaaaatataccagatactaaatggacccaaaaatggggaaaaaaggcaaaagaatgattattgggctcacctctgaaacaacacagctcagaactacagaaaagtaatcacaagcatctgagctgcccaaagatatgactttgggaacttctggggctaaattatttagctgtatgtggagcaggggaagattgaaggtgtgagaagacataaaaggagacaaaatatttaatttagtttaatttttttaaaaaggaaagaaaagctatgggggaggggtagtatcccacaagtctgatggaattttctttgccctaaaaatcaccaattgttccaagtaaacatgtgcagcctgatataagaaaataggtaattgttcggttgggcaccgtggcccatgcctgtaattctagcactttgggaggccaaggcgggtggatcacttgaggtcaggagttctagaccagcctggccaacgtggtgaaaaatacaaaaatctactctattaaaaaaaacacaaaaaaattagccaggcattgtggctcacacctgtaattacagttacttgagaggctggggcaggggaggagcttaaacccaggacgtggaggtcgcagtaaactgagatcacaccactgcactccagcctgggcaacagagcaagactccatctcccagaaaaaaaaaaaaaaaaggtaataattaaacaaagaaaacaaaagcctgccaaatggttataacctacaagttggttgaatagaagccaccaacccaataaaacatttgccatggaaacatattaaaggaaaaagcaagccttctccatctcccatcctacacacatgcaaacacacacacacacacacacacacacacatacacacatacacacaaattggaagaggattcccctgagtaaagaatgctaatagattaaattttgaacaccttgattttgatgtttctgtatactattcttgaagggactttaaaatcctgccattgtaatgcatatggcatcatctagaaagctgttgtgttcttctttgctagtgactaggaagacacagggagcctgaaagattctcacctcatgtctggggagcagcgcttcaaagaaactgaagttaggggcttcccagctctcctcttcagctcagtatcctctttacaccacagacacacttttttttttctgacaaggcacagctctggctgaagcttcatttaccctcaaaacctctgctggtcaggatgaccaggtaaataattttctgaagaagacagcaaagcaaaagtgtgctagagacactgaatcctgttgccaaagaaccacaccagtgaggctgccacacacgaaggaaggaggtctctgaagcaagatgtgccgtgtgtcccctaaacagtagcttttgttttgcctcgtatgcaagaccaatgctatcaagttgaaagagactttttggcagaacttcagacatcaaagaggatggatgctgtgactatctgtggtgccaagaagggggatgaaaatgaatgcagatgtattcacttcaatagatgacagtgtccttggtttccaggagttctgtgttcaacacttgtatttacaatgctcaggcaaggaggccatgccatcaacctaatgtcattacagcaggcaggtggaaaatgagtttaaagcaatcgctttgtgccttgtttgttctctcactaattcaatctaatctcaagccccaaacagatcttccaccagttctgttctcagggggcttcagcccctagaaacacctaccttgaattcaagctgtgttgggacaaccaaaaagaaggaaaggttaaaaggaagaaaacaagggaaagaattggggagaaggagattaaggaagaaaagcaggaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggtgacagagcgagactccgtctcaaaaaaaaaaaaaaaaaaaaaaaaaaagaaaagcaggaaaggaggcagggatggaattaaactgcaagagagaagtaggagagaataaaagagatgttatcagaggggaatgatctgtgtataaaaagatactgagaatgaatcgtttttgaattagatttttttttcctctgagcatggcttcagacatagagcacttaagtttagatacttttttacttggttttctgtaatggcattgtcactgggataagaatagaagcttttcacagaagctctactgaaaaagatacccatacatattaaaacactagtgtgcttatttatatttgtttattttaagagtcaactattgtttgtgtttgtgtgtttactacgctcactattgaatcattaacactttccataagcgggtcttccctaagacctgtccaactgcgagtacaggaagaacacacaaagccataccctccagggtaacaaatagcagtcttccatttcctaaactgaaggtcatgtaacaagagttgtttcttctcagaaaataaatatgcttatgaaagtcattacagccctaggaaagattctcatctttcagcatcataaatgtagaaaatacaaagaaaaaaataggttgactaaatattgactcaaaggcatttcctgaaaacaaaacaaaacaaagccaaagagtccctctagctaatgcctttgcaaattgtttgctttgggaggtggcgatatattcagagatcaatgaagggttgaaagcatatttgtctaaactatttgtttatccttcaatgggtagggagtttgggagtccttaaacttaaaagggaatatgaaagctgcctcaaggctgcacattttgacattcatgttagtggaccggcctccggactgttggcagcagctgatcgtgatctcccttcttttccccttttatggagacatcaatgctggattatcgatgacgaaaggggataaaaccaggatcatggaactgtgatctatgataggcgcagaggataatggggatgccacagttactcctggttccagtggggagcactaccccacaacccaccctgagaaccacaggaaaagtaatgcatgaaatagactaagggactttaacatggtgatggaaaagaaaaacctgtttccgattttttgactggggccatgtatttctagatcaatttcatggacttgtccaaattttctatcatttttctcaaatttgtcaatgaaagtccctcaccctgatggtcacaaaagatgttcaagttctttctttatttgattatgggacagatcttagcagtgggcatgagatcgccatggcacacagcttggtggcctgtacccaccaaaaggctgaaacgtgcacttcccatgagctgtgaataaagctgtcacctcaggagacgatgaagaaatagcgttttatttctttacaaatttatagccaagacaataaatcactccatagaaaaatttaaaacaagatacattcttgtgaccttcataacagatggagtagttagtacaatagtgaaaactgcctgctgggatgtcaggttgcagcattttgtcaggcttgaatgaaaaagaaagtccaacattagtaatggaatgggcaactgacaaaggtgccttgcccttagactcaaattgtttttgtgaataaccaagagagatgaggttagtgcagtgccgggtcttccctaagcttagctacctttgcaaagtacatgatataattcattgtgggttgttttgttcatttggggatttatttggcttcaagactacacaattatatctttgccttgactacttcaagctagatccagataatcacgtccaatcttcttacagatgctgttgtgtgacaatggctgtaaacacatgtcattaactgtctccttaaactctcacagtgatacttcttgggtcccacatcttccaaagaagtccagcatacacacacactcacccacccacaacctgtcacacatccccagaaaagagaaagagtgaaagatgcttcacaaaatcggcctcagcctggtgttcaagttgcctcgctcaatatgcctgtgcagtcagacctgcaggaagaaacagctcatttttaaactactgtatatgaaagtttttgcctggagatacatcacagataggcagatcactaaaaagaagagtggattgaatcagagtgaagtcttcagttaactgtttgtttattgcctgtgaggtccaggacagtttcctttattctctcttccattctcatctttgaaggtaaaatttcatttctttccccttcctatgtcctaagatgccctgaagacacatgagaaaatgtggctgattccccagggatggaagccagcaaaaatgcacagaagggagatgggaacattctcaagggtccttatattgagaaagaaaatgaatggattagtggtgctgtggtgatgaactatctgccctaaaactcctgccaagatcagccagctgttctctggctaggctgggtctcaggggtgtgagtgggtcttggccagctgagttgaaccatttctcacctcttgatagtcatgcagcctacatctgtctgatggaaccctctccctgtgtgcttcccatttaagagaggcacaatttgacccatgttatggaagaaaacagctagagcgttctacaggaaaagtgctataataggtcctaataactattcacactgtgttattactatgtgctatctagttctagtttcacaagcagtagaataatttcctacctctaagatgcactgagcattgacaaacaggaaagaataacacagctgggaaaatgctgacctagaaatgctactgtttcatgacacatacaaaatcaatcctcattttttattctaagtatttcagcgactagtagactttcagaactggaatttactcatcaaatgttctatccatatatgccatattagctttagctgagcttaccagttttctgaaaatgctctactatggcatgaagctaagcattccagaagcaagagcagtgattagaatagttccagggccagaggataagtttgaagatgaaatataagatatttcatgaattgtgacatatataaaatgatatcctgggtgtatatatgaatattatgggcatataaaatcagcactactttagaaacaactaaagacagccaaatacttcaaataactaattttccttcactcatggaaataaaacactaagtatggtgcctttcgaggaaacttctctgatagtcaatgaaatactccatgtggtctttgttggcagatatatcactatccatttgttaaacaagcagtagagtgctgtacatttttttatgcctagaaatgtgaaagaaagtcttcaaaattaggataaagaaatctctaaaatcaggaaattcctcaccttgatgagaccacaagggaaccagcatcctttgcagactgacctgggagcagcagctcactgggtcctgagaaaccacagggctgtcagtcaattattaaaactgagaagacgtgtatatttcctcaagagcatgcaaatcaacctggaccctcaggaaaacaagtcaagactaaatacaattatgccatagctacgcaagaagttaaaaaacacaattgtcacaatctaaataattctgactgcactcttactttgagaagtgtgtcaagaaatggcaaacatttaatttggactttggggatttttgcagctgaaatgcatataccagtttccctgatatgaaatatcacatagttgagacacatgaacctgaatcctttcatgatatctgtgatgaccacaactcctttttcctgatcactttaatcacccaggctgttaactcatttttaatcactgtgttttaaaagaagcactaatgattgattcttgccccttttcaatatattttgaacttaccaattctgcagttttgttaaatatgtcaaaatactcttttcaactgcacattttttcaacgtgattttgactcaaaaagaatacagccatcttttagtaaatggaagtcatgtttggaaagaacaaccaacccaaggaaacagaaggaaaagaaagtcctttttatttgtttctttttcattgtaaagtctttcctgctgtcgttgaggcagtttttccatgtaagggtttttagtctgtcatggaaagctgtttagactgagagaacttctgtcttggataccattcatcatctcatttattttcttttattttaaatatatcattaataaaatttttactcagtaagtaaagatattttaaataaccaaagaggaagttttttagttaggtaggagaaatgggtgaagtggagggaaaaagagttgaatccagagcctcataaaatatgaactttgggagtaatttgagctatcccagtttatgacagagggtcctgaggatgagtctcacaaggcaaatatactgagtgactgtatgcatttttagcactttaattagccacccaatatgcaggtgtgctcctactccaagaaaatcatgtaaacgaaaatccaaaattataagcacaataatttagtagttgttttaattagaaatgcaacctaatttaatacaattccctattcatttcctttaaagagcaggcactttaaaaacatgattcaatttaggaggaaaaaatctatttttgaatacttttttggaagaccatctataagaatcaaccccatcctgctctcattgacatttcaaccagactgggccatgggacatttgttcaaggctaattgcaactgtctagatccataatgaaggctttcctgggtgacctttatgaattacagtaagtaaagctcccctctgagaaaccagccattcaatacacttttacctttggatgatgggttattagaagcctgttgtcagtgtgtcaacgatattctattcgagatggaaacctttagttataaggtgatggtgagtaatagcctttgtaatttcaggttcttgtcattgtgggaagtgcatttgttctgctgaagagtggtatatttctggggagttctgtgactgtgatgacagagactgcgacaaacatgatggtctcatttgtacaggtgcagtattaaccttttctaattgctctatgccacagtttgttatagagccaagagacactcgtcatgcaatgctttaggtggctggaccaacagggccaaccgtgaatatgaaatatctaccaaaggcgaagtgggcatttgggaaaaagccctcacaaaagcctcacattattcctaggcatagaagaatacaagagaatgaagctaaattttgtgattatttgggatccttccacaaagtaacctccccaccctcaaactcacatgtatgcagttgtatattgaacacagaaaagaattttgttggcaaccattttactttgaacatggtatagggaatgaaatattcttttaaacagaatctgggtaccactagttgatgtgttggttgcttttagggaactggatgtgtgtatgggggagaggtataaagagggctcagccgtgtcatagccactgctatcctaatttattgagtcctcataattggttataaattcatttgtttagccaagttacgaggaaacagagacatgtatacttctcctcagctctagctgaaggtaaaagatgactctttgtgtgtcattaagttagacctttgctttctgcccatccttactacgtaagactctcttcacggattacttggcctgcctcatgttatgtcaaagagccttatgtttttctgtatttattcataagtcagatataacttgctctttaagggaaaacaaaattgtcacctaaaagcctagctggagtgatacaggatggtgactatctgatcggtaaagggtggcaccaaataaatgccactaattgtttgaaagattagatgtctcgcagctgcttaataagatgtaataataacatcattgcacaataagaaaatctaccaaggatgaatgaaatgatttcattgtggacacttgtgatttataatagcatgtttaaatttggcacattttgatcataatcatgatacctatatgtattttattgcagggaatggaatatgtagctgtggaaactgtgaatgctgggatggatggaatggaaatgcatgtgaaatctggcttggctcagaatatccttaacaattacatgagagaggtctggattcttattttttctgggccattagaacagataaatgcgaaggaaaccatgtatattcaccactaggacaggttaaaaagaccattgtatgtttttctatttctgaattacgaatgaaatccgagtacctattagaaatgagttatgcaaatttagatgcaaataacattagaaaaaaaagattcttccataattaacataagtggttcctaacgagagcaatttttccacccaaaagtcatttggcaacatctacagacaattttgattgtcacactgggtcgggtaggaaggtatgctgcagacatttggtgggtagaggccagggatgctgctgagcatcccgcagtgtacaggacagcccccaaacaaggaattatccagccccaaatgccaatagggctcaaactgagaaacattgagttatatggctattagaaatccacattcttacacaagaaagaccatattagaatctaaggaaaacatgcatattcacattaattaatcgatcagatttttccagaattccgtatcagtcaccattttaatatggggacaatgaagacaagcacacaggaggtagaatatcagagtggggctggatcaagggcaaaaactggtcattaagtcatctgacattaaatcatttagccactaagttatttgtctactctcactttaaactcaccaaagaagattctcttaaagaaattatgaaaaatgtacaatttaacattttaaataaatagtgacagaagttgtttatactctgtgtcagtatatatatctactgataattaaaaatgaattgttattcagggatatctattttaggtttctagaaataagggatcacatttttaaaactgggcaggggttatgcgtacaagaaatctgattttttattttaatttattccatggtagtgtggccttttaaaaagacaatattgagttacatataaaatgggcctgaagtatgcatccatttcccttaaaatacttttttttctaaggataccttacttactggaaacctggggtcatgcaaagaagtcaagacgagaaatactgtgataaaatggcaccaatctcagaagctcacaaaagaccaaaaaaaaaaaaaaatctagaaatggcttaaatagaaattacaaatattcactcagtgataggaacaaaatgtttattttcttaatggtgaaactttgctttgtatgaaattcacattgaattatgaaagtgtacaataattgggacttcccttacatatttacaggtaaatctacttatacacattagtttaggcaacctttaattatttagagctaaaaaaaaaaccactttttttctaaaggtgaattactttgtaaaatcctagaataatgtagcaaaatcatttccgtattactttaagatgaaaatttttacttggaaattttattttaatgatgtaaatattctagtcatggcttaaactttataagtcaaatttccaaaaataaggaaaatatgcatccactgagttacttaaaaatttaatattgaaaattattttaagagaacatttaactgatcctgatttttatagtactaacaatgttctcataatgtaatagatttataaaaattgttatctctatcctgagattaaggagtgcaaccatgttgtagttctattattgagtacgtaaattgatagatctcttccgtaaaatgagggaaatataagtagtcaataaataatgtaggttatattctttcctcttcactacctaaacattttaagctgtgaacaacctattattattgttttgtagcaattttgatgacgtattcgctgatgcacagacattggaattcattacattatctagccatcgtaatacaaatgacctttggatttctctatcacggcgcttatcctcctattaaggatcagaaagttaaactttacggaccacgtacgtccctgtctcatattcttctttgttggtttctgtttaatactttaaagctgtaaaaaaaatttaaaaaattccttctgagctcccaggccatacaaaagcaacttaagggtggatttggctggcagctgggcagtactttgtcagcctcagctccactggaactgcccttgattctctatagctcatcacaaaacctcaggtatgtcttatttttcttataatcctctgtatgttattatcctttttattaacaacaacaactacaacaaaagtgctgctctttttcatagtctcatgtaagaagagtgtcaaaaatgtcctcggcatttgttttctcagaaaaagaatttagatattggagaaattatcataccataaaaagttcaaaatgtgattcatctaaaattttggacaaagatgaaaatatagtcagctctgttctagtgttcatttagttagaaaccatagtaccggaactgtattatagtagaagttaatggtacctaaactctaaggaatgctttttctttgaaaacagaaatatttttacttatttctgtccactatgtttgtgtgtatgtgtgtgtttgtgtgtgtatgtgtggttttgatgccagcaatgcaaacaccaatatatctattaagaagtgattgaatttagattggaaaaaataaaatagttacatgtaaagacataaactctttccttcttaaatgtgattttcaactctatgatagaaactccctctaaaaaacaagcagggcaagaacaaacttacttgtaatgggtgagagaaa

SEQ ID NO: 660 - DNA, 30172 bp, Human
  misc_feature (1)...(30172): n = A,T,C or G
agggcaggcactgattgggtctgttgtgtgaacacatctggtcagtgccggggaccctgcttgagaggcgggctgtggaaatgggagttgaatgaatgggtggttcgaagcttggatcttttccactgccagttgattgtcctcactcgtcagttcaccctgctaggcatcagttttcctgtctgcaaaatggggttgtacagcctcccggggttatattgaggatggtggggaagagcaggtacagctcagtgcctggctgacagcagggctgaatccccgtccttccctgtgtagcaggacagcaagggtgctgcctgggcattagaagtagaacatcccatgcaaatgactcaagactgtggccggggagaagcactccgaggcatctctcctgcctaggagactgggctgcctgcgttgcctcgtgcctggaatcctagcacattgggaggccaaggcaggcggactgcttgagcccaggaattcaagaccagcctgggcatgatgaaaccccatctctacaaaagatacaaaaattagccaggtgtggtgtcacccacctgtagtcccagctactgggcaggctgaggtgggaggatcgcttgagcccaggaaatggagactgcagtgagctatgattgcaccactgcactccaacctgggtgacaggagactgtctctcacacacaaaaagcttgtagcaatttgttacagcggccctagagaactccataactgccatagattctgattcgtaggtccatgtaggtgatgcagttagggtttagaatcattgctgtgggcatttggttcttacaggtacagtgtccaatctgtgccctcagttttctcttctgttaactggggctgataatgacacctgggaggaatgtatgaggccatgtaaagcagttaaatgggagtctgggccaggtgcagtggctcatgcctgtaatcccagcactttgggaggccgagggaggaggatcacgaggtcaggagatagagaccatcctgactaatacggtgaaaccccatctctactaaaaatacaaaaatttagctgggcatggtggcgggtgcctgtagtcccagctacttgggaagctgaggcaggagaatggcgtgaacctgggaggcggagcttgcagtgagctgagatcgcgccactgcactccagcctgggcaacagagcgagactccgcctcaaaaaaaaaaaaaaaaaaaaaaaaaaaaaaaggagtctgtagggacatgccccagatgttcacagacctcatctctctctgctagtggaatctgtcatttctttctttcatttcttttttttttttttgagacgaagtcttgctctgttgcccaggctgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggagccacgggagcagcccgtcatttcttatttcaaaaaataccccctaaaacccaaagaaatggggtcttggtatactgtccaggctggactttaactcctggccttaagcaatctttctgccttggcctcccaagtagctgggattgattactggcatgcacaactgcatatggctcaaaaaaaaaatggggccgagtgcagtggctcacacctgtaatcccagcactttgggaggtcaaggcaggcagatcacctgaggtcaggagcttgagaccagcctgcccaatgtggtgaaaacccgtctctactaaaaatgcaaaaattagctgggcatggtggtgggcgcctgtagtcccagctactcaggaggctgaggtagcagaattgtttgaacccaggagagagaggctgcagtgagctgagatcgcaccactgcactctccagcctgggagacagagggagactctgtctcaaaaaaaaaaaaaaagtacagagaatgtgaacagcttgaatttaaaaaaaaaaaaaaaggtacgaggggaaggctgagaacgtggttgctgggggttaccactgggttccttcccggatgtcacatcccttctgaagagaaacattccgtcttcgccagggacgggttgcaagaaaggcgagcacaggaccgagttctggctaaggagcctcaggggtaagtttgccaagaggcctgtgagttcaagtccccgttcctgcccttccttctcctgctggatagccccgatgatgcccacactgtgggtggataggatttttggagctgtttcagccatccatcatccatgagagtcccaaaatcctcagagaaacagagcctgaggtgggctgcagtgagccccgggaactgcctacctacaaacttcccgttaaggcaggaaagggcccccctttaccatctaagccaccactggtattggtggggtcatctgtcctttgcagctgaagggaccctagagcgttactggggctccgccgtcttcctctctgctggacactgcttcctccccgctctccactacagtgaggcttacaaaatgggggaggcacttgcttcacagtttgaggtatgtcccaagtctggcctggcttcctggattaggacaggtgctggatcccagatgccgtggctccagcttgctgctggtgtgtggagggttggcgttgggctcgtcccttccggctgacacagaggccagccctgggctggtcagagccccatcctggcacgagggggctgagcctgtgcacaagcacgcctcgggcctgagatgctgctgatgaccttcagccttcactgcttccacccgactctgccgtgaaaatagtttgtcctctgagtaaaaaggtaatgcggaagcatccacatgatgatggtgcctgggctttggcaagtcagtgtggagagtggcagctggaaatcttcgcaggcttggttcgagtgtgatccgcaggggaagcatccgccagtgtccatcaacagggtttgagacccccacaccctgacagggatgccacccagtacccaagagcaaagcagcccggtctgtgctaacattaaaggagaactcggtgacttgagaagtcaggcaaaacctgcaccgcacaggcccattatgcgaaaaccaatcactgtctcactggaaagcctcttccacacccggatgccttcccagaggtttcacacatatttaaaaataaacagagtcggcctggcgtggtggttcacgcctgtaatcctaccactttgggaggccaaggcgggcagatcatgaggtcaggagttcaagaccagcctgacgaatatggcgaaaccccgtctctactaaaaatataaaaattagccgggtgtggtggcaggcgcctgtagtcccagctactcgggaggctgaggcagaagaatcacttgaaccctggaggtggaggctgcagtgagccaagatcgcgccactgcactctcaggcctgggtggcggagcgagactccatctcaaaaaaaaaaaaaaataataataataattaaaaaaaggaacaatcagtgtatatcaatacaactaaaagtctaatttcgtttcatttaaagaggcagaaataaagaaatgacactttaaataaagggtatgtgaacggaaacacatttattacaaaaaaaaaaaaccccaaaacgaaaaacaaattcacattgtattgagctacaatatggcagcagattaaaaaaaaatatttttacacagtttaaggtaactcctaacagaacatagccttgttgccacgagacaggacacaggattccaagtactcagtagcggcgagtgaagcgggcatcgctgggcctgctcccccggctctggcctccaaacccgccctgcatgccaccgtgtgggatggggtggccccgggaggccccgcctggggcaaagctgccgcgcctaggaacaaattcacattggtttgactgcgaagtcctcctgctccccggcccatcccagcctgcacagcttccctgagtgttgcctgcaggcagggccccttcctaatgccctcccctcctgagtggcagcagcctccacagtaccccatgcctggcctcacgtcacccttggggggaggggcactagctggaaggacttggttgttaagcctccagcaaggtaggccaatatgcaaagcagggggaaggggcgccgcccccagcatgccttaccctgacattcctcctcggttcatcatgtggccaggcccggagtgaccggacatgcttctctcgccacctggaagacagacgtgctttcacacagggaacttgcgcacacggcgtggaacccacggcacatttagcccactccactccctttggtgaggcccccaggtacccacaactagcgggtcccaggaagacacctgggcacagggaccatagaagtccagcttcctcccagcagagagaactcgggaacgcccactgtccacttctgggccagacccacacaaagcaggcggtgtctggagtgctcttcattcctcattccagcactgagagcagagcacctcctgtgctcccccaaggagagaaggcgcggcctccatctttccatcactccccagcacatcctggtcccagcccagagctgctcctcaccttgccacctcttgtgatccctgtccatcatgcccccgtcggccgtgccctgccatgaccggtcatcctctcttcggccatggtccccccagtcacgtctgccccttgaaagagagacatctctgatttggattgcccccatctctggctcttgtgctaataactgtggcggcttctggagagtgaatccctctgtgtttcccaccctgtgcccacatcccagcgacttgcgggcccccttgtgggcggggggggggtcaggtactgtcgggtgtgggacacaaacctggggggaggaggcagcccccggccctcgctcatcctcttgtcagagccatagcccccccagccatcgcgggagtcccggccgtggcgctctggtcctccatggcgttctgggtaatgctggacatcacagagccagaagggaaaaaaaagcttcagtgtcagcgcccagaccccaaggcttttcaggcaacatgctaacgatgacaacgacagtcactcgggacagaagtgctggcaggctgtatcggttcacacaacacagctgccttcctgaaatctgcaggccagaggccctgtgccctaggctcatggcctggtacaaaaaaggtactagtaccaaggcatctccaaggcaggtccccacagcaccaccagagctgggagggccaccaggagtcacccactaaagatgatgcttacaagagagattccctgggtcccacagctcaaatggttagttcccagagccaacagtattctcttactgtcttctactaaagaaaggtcaggtttataaacctttaatgtgtgcatattctggaaataatttttacaaatttcttccttccacagtgaaggaagtatcaaatggagcccttcatccgaccaattgctaggcaagcatccttcctcacagtcaagtttctcggaagtttctgctggatgcccagtccagggtcttgcaccttgctctgctcaggatataagacacaggacactgagagataaacggctggccttccacttggctagtcccacctttccctcttctgtgtcattgtttttgtaagccacgtggctaacacagaccaggagttcttgaccctgctgtttcagggaagaccaagagagggcgagtcacactctatgcctacttatttgatggccaaggttaatatttacacccacagcctatttctgtggctggaagcactttccagcctgactttcacaaaagctagtgaggtagctttggctccacagtcctgttttttctctttccaccaatacatatgtggtctctggggtttttgccccatgaccacattgtaggtgaaaggaaactagaaaggagtcctggtaaggaaacccccttgacacaggctggttgttgtccatgtccaagttcacctccccgttcaacggagagctctgccagggtgaagggagagatggcggcatgctccaccacgtgcacgatgtcccacgttaccactgcctgcttcctggcctatcctcccagcatgtgctctgatgcctcccctcaacaaagtaagaaaagggactcctgaaataagctctccttagtatttgaaaattgaaccaacatttttctgtccaaccaacccacgtaactgttcaatgaggcccataagttctgtgctagttttctctgtagggagatgttaccatttccctttggggtaactctgacgactcatttatgactgtgtatgtgaggagaagggatcaaaccgcgttccactgttaggagagcatatctaacaccttcatgaaagcagctggtggccaggtgtgctggctcacatctgtaatcctagcactttgggaggccgaggtaggaggatcacttgagctcaggagttcaaaactggcctgggcaacatagtgagatcccgtctctattaaaaaaaaaaaaaagtagctggcaatgataaacacgtttgtacagatgcgcccacctcatgtaaacccccaccaccgcaccctttgtaggaggaatattaccctcatttcactcctggggagacaggctcagcaggaaggggtgacaccaaggtgtgacgccagttctgattctggagcctttacatggaaccattggtgtatgctcctccaccaaagaaaatccacaagactagttctacgttttgctgcatataatttgcctccaggagcagggaaaaaggaaccccacgaggctgatggaattcctgaggatcccgagacagagctgagtacttggctatgctcagccacattaaggaaccaagggggacagaagcgggaagcttatggtggagtccagaaaatgctggcaggaggaggaagggctcatgagtggagtcctcagagaggaggcatcttccacacagcaatgtgctgcccccaagtttatagggaaagccactagaggtccaaggctctcctgggaagtctcagtctcaatgtaagatggaaggagaaaatggagcttattgttctaatgtgctagcccccgaagagaatgagcacagaccacagatctagttgttttccaaggctaagctgggccctggggtgatgaaggatgtccttactttcaaaagagggcaggcactcgaggacagacacagtaaccacagcctccccagatgcacctgtctgagtcagctgtgcggctcactagacacttcccagcagagccaggtcacatcccaaggttccctggcactgttgcacatgtgtggtgagtgtggcacacagaaccccagggtcaaggctaaaaacagcttcagagtaactgtttggactgacagccaagactaaccccaaataatcccaaatttccattccacaaacctagacttttctagtgctttacttttctctttcctcattttgcctcttgctcaaagaaagggcaggaagaaggcacgctgaagggaaaagaacccattctatgggaaattctgtggctaccactgtagcttcagacttacctgtccttctcgttctcccatcattgaccttgaaccttctctcctgaaaaggcaatttaaatcaaaccgtaaggggaagaagaggcttgttcacaaagagaggaccatcaggcccccaatgaaaagcataatttccctaactgaaggcaggagacctgcgggtctgactcagcatacatctgatgaacggagtgggttcagagagcccaggagtccttgttctcagtcagaatgagccaggaaaaagaaaacccgcacgcccagcaggggcccaactgacctgtccaccgagtggtcggggtagcggccgcggtccctgtggtcaaagtcgtggaagcggtcctggcggttaaagtcagaatggtagcgctcatccagggcggcccgcttggcttccggccaataggcatcatctcgcctgtgaggggacatgagacagagatagagggatcccccaccccaaatgtatctatcacctttgtgggagctggcccctagcacttcacagaaccaggatgactttcaccaagagtgttctctcctataggaggcaaggtctgatttgaccccagtgactgcacagttgttttgttttgtcccatgcacccacctcccctgatgaaaagcggcctcggttttccaaagagggagccattagttaagcagtcagtcctatgggctgcctgcagatggcttctggagccctacacagccacctccgctcaggaagaccacgtgagcctccaccccgaggggctctgtcaagtgcacctgccatctctctcgccccaaagctgacctcctgccctgccagcagccctggccatgtactgctgcaatacacagatgaccataatgaactgtcatcagaaggatttcgtaccaaagcataatagatcctagaacagtttacaaggccctttatagaagttgcattgtatatatgacctgggctcctcttcaacccatgcaatagaaagaaacaacaaacagcaatttttgccaggttgcagtgcacgtgtaaagcctgacacaatcactgctggaattacacacctgactcctcacagcagccatgctcagcattttgtgttcatacctcctcttcagtatgtttgagaaattaaaattaatcttactgccgggcgtagtggctcatgcctgtaatcccagcactttgggaggccaaggtgggtggatcacctgaggtcaggagtttgacagcctggccaacatggtgaaacccggtatctactaaaaatgcaaaaaattagccgggtgtggtagcacatgcctataatcctagctacttgggagagtgaagcaggagaattgcttgaacccaggaggcggaagctgcagtgagctgagatcacgccattgcactccagcctgggcaacgaaagcaaaactccgtctcaaaaaaaaatttttttttaattctttatttctagaataagcaaaaacaaattacaatggatttaaaaagccaggacaaggccgggggtggtggcttacgcctgtaatcccagcactttgggagtctgaggtgggtggatcacctgaggtcaggagtttgagatcagcctgaccaacatggcaaaaccccatctctactaaaaaaaacaaaaattagccgggtgtggtggtgggtgcctgtaatctcgaatactagggaggctgaggcaggagaatcgcttgaacccaggaggtggaggttgcagtgagcagcgatcgcgccattgcactccagcctgggcaacagagcgagactctatctcaaaaaaaaaaaaaaaggaaagggccttaaaggaggtgcagtagggcacgtgtggcgctctctacgtgcctgagcttccctcctcaggaggtctgtgccacccttgaacctggttagttaaccagcactactttatccagcctcctgtctctaattttttttttttgagaccgagtctcactctattgcccaggctggagtgcagtggcacgatcttggctcactgcaacctctgcctcctgggtacacgcgattttcctgcctcaacctccccagtagctgggattacaggcgcctgtcaccacgaccaattttttgtattttagtagagacggggttctgccatgttggccaggctggtcttcaactcctgagctaaggcaatccgcccaccctggcctcccaaaatgttaggattacaggcgtgaactagcgcacccggcctatgcttcctttgaatgaaagatctcaagctggccggtcgcggtggctcacagctgtaatcccagcattttgggaggccgaggcaggtggatcacgaggtcaggagatagagaccatcctggctaacacagtgaaaccccgtctctactgaaaatacaaaaaaattagccgggagaggtggcaaacgcctgtagtcccagctactcgggaggctgaggcaggagaatggtgtgaacccgggaggcagagcttgcagtgagccaagatcgggtcactgcactccagcctccgcgacaaagcaagactccgtctcaaaaaaaaaaaaaaaaaatctcaagctaactggactgtgaggtccctaacacgattctgaacgccacgtgctaagggcagcatggatctgcttaccggtccaggtcgtagggccgccgcaccgcgggccgccgctcctgctcatagcgcagttcctgctggcgcctcagctcctcgcgctcacggtggatgcgctcctgctcgcgcctgcgctcgtgctccacgtgcatgcgttcgcgctccagccgttcccgctccatgcgctcccgctccagccgctggcgctggaaggccagcctctctcgggcaatctccagccgctcacgctcctcgcgctcccactgcgcctgcatgcgttgttcgcgttcactgcgttcacgcaccctgctgcacaacagtagagctgcagaaggggacctagacacccccagccaggtcccagggctgactttaagtaagacgctgggtcgcacagactccagggctgtgcgtccactacgtggtctgcagaaccgtacactccagcgggaagaaggcttctcgggcccacaggagcagcccaggaagatctcaggagtgaggcccaggctgtgtgtgtgtgatcagaactgggcctcctttctccaacatttcctggagcttgacaagtgatttcaggaaacagccagtcaaaaataagcaacaggccgggcgcggtggctcacatctgtaatgccagcactttgggaggctgaggtgggtggatcatgaggtcaagagatcgagaccagcctggccaacatggtgaaactcttgtctctactaaaaatacaaaaattagctgggcatggtggcacgcacgcacctgtagtcccagctactccggaggctgaggcaggaaaatcactggagcccgtgaggcagaggttgcagtgagccactgcactccagcccggcaacagaaaaaaaaaaaaaaaaaaaaaaaaagccacagagtatatgcttcatagcgagtgagtgtgaattggaaccttcactccctagaccacaggatgaaatgagtctttgtgaggtggggctagcaggccccccaagtgtaaggacattagcagctgtatcttttggatacagatgacattttagtgcatttctccagtctttgtatataaaacagaacagacaggagccaggctgtcttttttttttttttttttttttggtagagatggttgcccaggctgttctcgaactcctgagctcaaaacaatctgcccgcctccacctcccaaagtgctgggattataggcatgaaccactgtgcccaggctcagattttcttctttcgatcctttacctacacagttatagatatacagcctggacaatatagtgagaccccgtctccagaaaaaataatattagccaggcgtggtagctacttgggaggcagaggtgggaggatcaatcacttgaaaccaggaggtagaggctgcagtgaactatgattgcaccacttaactccagcctgggtgaaagagtgagaccctgtctccaaaaaaaaaaaaaaaaaaaaaaaaaaaaggtgtgtgcagggagctacttaaaaaaaaaaagcacctcagtgcagtataccaactactgacacagcattttcattgtattagaagttatctagaagtgatttaaagtgtacaggaggatgtacatgggttatatgcagaaataccacacagttttatatcagaaacttgatcctctgcaaattttggtatccacaagggtactgaggccagtcgtttctgggacaactgtgtgtttctgtcccagcagaaatgtataatcttgcctcatagtgttctggactcaaatgactgcaacctccttagttcacccaacatgtcttggatccgcccacacctgcctctgtggatctcagcaccttccggaggagcccctagtatgaaagggctgcggtttatgggaacttttcagttgtgtccaaatgctcacaacctgacgggatacccaagcccacacttccttgttcataggttcctctacgccagatatggagaggggcctagggtctggaacactctagtgtttagcacggcaggctcctgtgggggccccccaggctgcccgtgttcattactcccccagcagaaatgccacctgccaatgcctgcactcacaggactatgggagactttgttttttttttttttctttttaaaggaataggctgggcgcagtggctcacgcctgtaattccagcactttgggaggccgatgcgggtggatcacgaggtcaggagatcgagaccatcctggctaacacggtgaaaccccgtctctactaaaaatacaaaaaattagctgggcatgatggcaggcgcctgtagtcccagttactagggaggctgaggcaggagaatggtgtgaacccaggggacggagcttgcagtgagctgagatcgtgccactgtactccagcctgggagacagagcaagattccgtctcggaaaaaaaaaagggaataaaagggtgataactttataggcagagcagtgccctctccccctccttttaaactaattgtccttatttcttatttgagacagcgttttgctcttgttgcccaggctggagtgcaatggtggaatcttggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcacgcaccaccatacctggctaatttttgtatttttagtagagatggggtttcaccacgttggccaggctggtcttgaactcctgaccttgtgatccgcccacctcggcctcccaaagtgctgggattacaggcgtgagccaccgcgcccgggcccccccgaccccccctttttttttgagatggagtcttgctctgtcgcccaggctggagtgcagtggcgcgatcttggctcaccacaagctctgcctcccgggttcacgccattctcctgcctcagcctaccgagtagctgggactacaggcgcccgccaccacgcccagttcattttttgtatttttagtagagacagggtttcaccgtgttagccaggatggtctcgatctcctgacctcgtgatccgccagcctcggtcggcctcccacagtgctgggattacaggcttgagccaccgcgcctggcctacatgcccagctaattttgtatttttagtagagactgcgtttcactatgttggtcaggctggtctcgaactcctgacctcaggtgatccaccagcctcggcctcccgaagtgctgagatgtgagacactgcgcccaggggggtccttacttttaaaactaaagttaacgaagtatttcatagaaaaaataaattagctgtaattcgccaataacgtttgtgtttacttcttgacttatttaagaatgaggccctgtcagtccttggagcagtggctcatgcctgtaatccctgcactttgggaggccgaggcaggcagatcacttgaggtcaggagtttgaaaccagcctggccaacatggccaaaccccatctctactaaaaatacaaaaatgagccgggtgtggtggcttgcgcctgtagtcccagctacttgggaggctgaggcaggagaactgcttgaacaggggaggtggaggctgcggtgagctgagatcatgccactgcactccaccctgggcgacacagactccatctcaaaaaaaaaggaagccctctcagtgccctcgctgggtctacctcactgtctctcttcctgctttcacatcttctggagcaaatttggtattttttgttgacgagcactactgacgctggaaggcattccatctccctgcctttgttaccttctacaatctttgggaagagacttatttgaaaagagctgtaagtaggccgggtgcagtggctcacgtctgtaatcctggcactttgggaggccaaggcaggtggatcacctgaggtcaggagtttcagaccagcctagccaacatggtgaaaccccgtctctactaaaaatacaaaaattagccaggtgtggtggcgcacgcctatagtcccagctactcaggaggctgaggctggagaattgcttggaggcggaggttgcagtgagccgaggtcacgccactgcactctccagcctgggcgcgacacagcaagactctgtctccaaaaagaaaaaagaaaagaaaagaaaagagccgtaggatgaaagttaaaacataacaagtctatgaactgaaagctgaaggagcaaaaaggttcacagctctatcccaccccagggaactctgcaaacatccttccagaagacagtcatgaccacattctaggaaaaacaccaaaccgttcctggatccctactcacctatgggactctgagtctcttgacttccgaggctccttgaccttatcaaaggacacgacggaccgcttctctctgctggctgatttgcgatcctggcttttggaagcctagttcaccaaagaacattaaaaagttaaagcagaggccaggcacggaggcttatgcctgtaatccaagcactttcaaagttcagggcgggtggatcacttgagattgggaatttgagaccagcctggccaacatggtgaaaccttgactctactaaaaatataaaaattgccgggcgcagtggctcacacctgtaatcccaacactttgggaggctgagacggacagatcacgaggtcaggagattgagaccatcttggctaacacggtgaaaccccgtctctactaaaaatacaaaaaaattagccgggcatagtggtgggagcttgtagtcccagctacttgggaggctgaagcaggagaatggcgtgaacccgggaggcagagcttgcagtgagccaagatcgagccactcgactccagcctgagtgactgactgagactccgtctcaaaaaataaataaataaaaataaataaataaataaaaaataaaaattagctgggcatggtggcgcatgcttgtaatctcagttactttggaggatgaggtgggaggatcccttgaacctgggaggcagtagttgcagtgaaccgaggacgcgccactacactccagtgtgggcgacagagcgatactctgacaaaaaaaaaaaaaaaaaaaaaattgctggcgcagtggctcacgcctataatcctaccactttgggaggccgggacgggtggatcacttgaagtcaggagtttgagaccagcctgaccaacatggagaaatcctgtctctactagaagtacaaaaattagccgggcatagtggcaggtgcctgtaatcccagctactcaagagggtgaggcaggagaatcacttaaaaacccccgggaggtggaggttgcagtgagctgagattgtgccactgtattccagcctgggccacagagtcagactgtctaaaaaataataataacaaataaaaaataaataataaaataaaaaaatgaaaaaagttaaaagtaggtgtgataggggaacaggaagaatcaggtatatatatccatgcctaaccatcagatgtggaggtcctatgtgatgaataacttttagtgaaaaacagatgagctgtttaatccaaacaagccttacattttgcttatcataattgaaagacacagaatttcatcaacatttaatgctaaaatatgatctaacagtacatttaatagagaaaaaatggaaatgagtattgcccccgaaaacttcatataagatcaaaacaccaattttttatgtcttttgcttcaaaaataaatttcttaattttcctttttccttcaataattaaacacacaatgagttcccaaatgaagcacttccggtacacttgacaagtaccttatttgtgccaatgacattgttaagagaccttctcattttatccctagaacccacactttcctttttccgttttccaaaggtgttttatagaacaagggtaaaaggctatgacatattataatactggcacacagagactgaaagctcctaagcaatccgctccattcaccaagtgaaatggttcctcctccgtgcagctgagggttgaccaggcgggtccaaggtccctctccttccttaaggaggggctgctgccaagattggtccttggctggcaactgggaagttggctctcagagtgtccccagttgacagttaaccagtaagggtggctcggtgtgcacagaccatgcaaataataggtgtgtgtttttttttttttttttttttgagatggggtctcactctctctcccaggctagagtgcagtgcaatgaacgtggctcactacagtcttgacctcccaggtttaagtggcattctcccacctcagccttttgagtagctgggaccacagatgcataccaccgagcctgcctaatttttaaatttcttgtgaagatggggtcttactatgttgcccaaggtggtatccatctcctgggctcaagtatcctcccagctcagcataccaaactgctgggattacaggcatgagccaccatgctcagctcacactgcagcccagcaagaagataagagtacaggaaggggtcaaggtggagagcaggctagagggaggctggcgagatgggccaggtcaccatggcatgctccacactgctgggtgtaggaatgcatcacggggaggtgctgacactttcagggtagacagggaacgtggactgccacacaccgactcagggaaaagccaacagtcccatatgtaaattttaaagttagctttagaaaataagttaacagttatcagagcaaaagtaaggataaaggaaagctttctgcatttcttaaaataatttgaggctgggcgcagtggctcatgcctgtaatcccagcacttttgggaggccgaggcgggcggatcacctgaggtgaggagttcgaggccagcctggccaacatggtgaaaccttgtttctactaaaaagataatggtgtgcgcctgtaatcccagctactcgggaggctgaggcaggagaatcgcttgagcctgggaggcggaggttggagtgagccaagatcgcaccactgcactctagtctgggcaacagagtgagaacctgtctcaaaaaaaatagtttgagatttctacattttcgaaacggccgacaaaagcttttttcaaatgaagcttagtaattccctaagacgcacacagaaatacaaactgaaaagaagagcaaaataccctagttagaaaattaatactcactctctctttggacccggacgtttttacactaatcacaggcacccctttggatttatccattactacagtccgttcggtccctcgacttcctacagaaaagacggggaaagtgtaagtggaaaaccaagaatacccagatgagaaaaaccctctgcaacatgaatccagtttccgttgccagctaatcacagcaaactaacaaactccactaggcacagaaacaagacagaatctcctgggctcatgagctgcccacctgactttgtggctcgagatcgctctgaggggccaggtttctgatcatcttggtccttactcttttctccacttccgtcgtcacccttcttagcatcatcttttctgtcacatttatcatccctcttaaggtttgtagatctataaaaaacagacatgttggctgggcgtggtggctcatgcctgtattcccagcactttggggggatgaggcgggcggatcacatgagaccgggagttcgagaccagcctggccaacatggtgaaaccccatctctactaaaaccacaaatgggcatggctataatccaagcaaatcgggaggctgaggcatgagaattggttgagccagggaggtggaggttcaatgaaaagagatcttgccactgcacaccagcctgggcaacagagtgagattctgtttaaaacaccctgccccggccaggcatggtggctcacgcctgtaatccgagcactttgggaggccgaggcaggcggatcacaaggtcaggagttcaagaccagcctggccaatatggtgaaaccccatctctactgaaaatacaaaaattagccgggtgtggtggtgcacaccttagtcccagatactcaggaggctgaggcaggagaattgcttgaacccaggaggtggagttgaggtgagccgagatcacaccactgcactccagtctgggcgacagagcgcgactccatctcaaaaacaaaacaacaacaacaaaaaacaccctgcccctttaatttagccaggaaggaggggtacctgtcactgttgctcgacttctcctttttcccgtcactgtctcttttgtcagaggttttctttcccacaggttcatttttggcctgaaaaagagaatcaagtattacccccatttcctaatgtgggctatatcctgggaagaaaacggccactcactttctccacggagatcatctttccgtggagctccgtcttgtgcaggtggttaatgcattttgtggcctcttctgctgtggacatcgtgacaaaaccgtaacagcgagctccaggactccgggcatttgtcacaaccttggcgcccaccacctcaaaggaaagcaggcaaatatgactcagacatgaagcccactgagcggggcatggggatatgaacaccccacagggaagtctgctcatcaggggtccgacaagtgttagactggggaggacaatgctactaatgcttctgtttcgctgttgttcctccaaggacctctggccagttctaatcgctcatctagttcctcaagggggccaggagggcaatgtaggggaacagacgaaagggaaatcaaacagggttctgccagtgttcctttaatatggtctaaaacttgtgaagaaatgattccaaatatacagtcatgctacgtaggtggtaaattatgaagtgatgtaatgtgggcaaaaaaagaaaaaagaaaaaaaaaagacttcggcacagactgatgcaaggaaaggtctgtgagccgtgctctggaactcagatctgccctatcattgactgtaacaaaacgcagtgatgtgtttcagttactgtagacacatcctttccagtctacctggttttctcgactccagcaggatgcagttagggtcgccctttgacggcagaagacaccatggctcaggaaaagccctgcagcagccagtggccgaggctggtaatcatgctcatcatgccacatggaatcctagtcccagaggacattctcagagaggcccggtcctctaattaacccacatcaggcctgctgcgctcaagacactacagtctccagggcaacacttccccactgagcacacccacccgctgggggacgccatggagtcaggaaagggggtctagtaggggagacttggcgcaggtgttgccagccacacaccttgtatcactgaggctcaagaagcccttagttatgtccgtaataatgacataattagttttatcctttttttttttctttttttaagatggagtcttgctctgtcccaggctggagtgcagtggcacggtctcgggtcactgcaacctccacctcctgggttcaagttgttatcctgccttagcgtcccaagtacctgggattacaggcatgcgccaccacgcccggctaatttctgtacttttagcagagacaggcttcaccatactggccaagctggtctcaaactcctgacctcgtgatccacccacctcggcctcccaaagtgctggaattacaggcgtgagccaccacacccagcctgttttatcctcttttaagttcttcgaagtcagtatcagggaaaacacttggttttctatattgcaatgtgttgaaccctcactgtgtaacacaaaggattggactccttcctttggtagtccccgaaaccgactctgagagagacgaggagccctgaatgcaggaggctgtttgggaggcaagtctgggaaacaccagggaggaagggagtgagaaagcacagggaggagggccaggcggctgcgctgggcactgcagttagggggggattctannnnnnnnnnnnnnnnnnnnnnnnnnnnnnnnnnnnnnnnnnnnnnnnnnnnnnnnnnnnnnnnnnnnnnnnnnnnnggggttggtgacaccagccccaccttcacgggctcaggaaaggcaggtgctgcagacaagaggccactagaactgcccccagtggtgaactgaggcagcaactttgagagcccccagctgctgaggtgaggttcagtcaatggacccaagacacccgtggtgaggacccctatcatcagactccagggtccctgttctgagttctgagttccagcatcacgaacactgttctaagaacactgctgtctcccagacatgctgaccagcaccccaccagccaaccctggcagcccagcctgagtgcgacgtcctgaggacacagaaatggatccacgagccatcacagggaagggggcaagctcgcagagaagggagggaaatacagtggtgatgtgggctctggaagcttccacaccactctcacctctacctgtggacgggcagaccctccccagccattagcaagtgtaagctccttggtatctctcaaagaactcactgaggggagaggacctccatgtaaaggccacacaacgctggtttcaaagtatcttctccagaaaagctctggcacttaccttcccatatttgctgaaaagattcttcaaatctgtagctctggttgtagaagagagtccactaacccagaaatttctaccacaactgctgcgacctatttcaaaagaaaattctagtaaaaacccaaatacccacaagatcttgagtcttagagacaacctttccaaaagagacatggttcccatttttcctgaggcagtggcagcactaaaagccaaatggggctgtgggcctgaccactatcctcaccaagagcctccagtgcaacaccaggcccagcagcactaccacagggcccgtcacaatactgagtggggctattgggacaatgtgaggtttcctaagaaagttagcaattgcgggccgggtgtggtggctcacgcctgtaatcccagcactttgggaggctgaggtgggcgaatcacgaggtcaagagttcgagaccagcctggccaacatggtgaaaccccatgtctactaaaaatacaaaaaatcagctgggtgtggtggcgggcgcttataatcccagctactcaggaggctgaggcaggagaatctctagaacccgggagtcagaggttgcagtgagctgagatcgcgccactgcactccagcctgggcaacagaacaagactctgtctcaaaaaaagttagcgatcgcttaattacaggaggaagtgcagtgtgcaacggccatgtagcagaacagtcaaccttggtgtcaacaatgcactgtttctctttccacgtatagctctgtatctatcccatgtttttactcctttagaacactgattaagaaggaatttggtagggtaaaattatttctcagttaatgcatttaatgaagggttacaggatgaatgtgctcccaacacaaggatctgcaccaaatcagcctgttaactcttaggacctggtatgcttcctacaacccagaacctgtagcggtaacagcagagaaggagaaagactgcacaaacgtctcaggagtctcctgggtaaggagcatagcacgcgatgaaccagaatcaaatacccgccactgcccaggccatacatgctccaagggactggtgtcgccgaggtgacctacccttttcctctttggaaagcctttttgtatccgagtcatcttcgggagaactagagacaaaagacaatgtcactccacaaggaagcagcatggaggaaacaaactcaaaaccataaaattcgtgctgaggttgcatacctacccgaaatttagttctgaaaaaatgataccccgacaaacttgtattgaaaatctgacctaaccataagatttcagacccacaggagttaattaattctgctgggctaaaggtaattaggaagaatttaagaacacaaccatggtaggttgagaaaaagaaaaggaattgaatcacccattaaaaacacacaaagagaaacgaaacattctttagaagcaaaactacaatttcgtcagtctggctggccaattgcagaaaaaaacagcttatgtgtgtcattacatgaccaatgaaaaggagatagcgtctggtctaaaactgagaaaaaacaaacctcattttctgatcagcgccctcactggttgaggactctttaggagccggagggacttcattacaagcgtcaaaatcaaacttcctcccgtcttctttgctatctctggcttctgggcttggggcttccgtgggtgcttctgcgagctcctcgctagaggcctccgcgagctcggaggccgcactactctgctcaactgccggctctagccctacaggctcacagtccgtcctctcgccatcgcctggctgctccgcgggctcccttttcactaccgctaacaggctgtctgccttgctcgactgagcgtgtgctgttgactcgctggccaaatctaaatcaccctcttccggatgggcgctgtcaaataggtcctcttcctccgcaagctttctgtctggccccacgctacttgtgtcctgtgcaaatggctgctccagctcggaactttcttcttttactggctcagatttacaagtttcccccaaaatgtcgagtattttctcattttctacggatttaacaggaatagaatggcacaaggtttaattaccagggaaataaagcaatcacaaatgtggaactggcacggctgccacactaacacgaagagaactgctagctacacagagattggaaaacccgcgggtacacaaagttatactggttacactacctgcgccgcgaccgcctctaggtaagcctctacgctacacggaagagaaaagcatcccagagatttaacccccaaaaccttctggctgattcttgacagtcttcattctgtcgtcgtttagatatgactcttccaaatttagcttccaaagtccaagttgcttaactgaatgtatcaccattcactgaacagctcaatttccaaatttctttgaatttcttttaacagaacagtccaacatgaaaaccagaatctcttccatccgtgctctgagatatttgcagtccagaaagtgaacagtgtttggaattctcatgaagacactctttcctcttctggaatccagttatgtctcaaatttatgttttaaaatgtatctccctaccactacctgagctgcctcaattaaaaacaacaaaattaagctactgcccaatatcacaagatctgttttgtgggtgcagaggtattagctctcaagagaggcatctggaactctttctctatgtatgattcaatgctgttgatattcaaaaaggcatgagatactttcatctcaccaatacattttgtaaaatgagaagtgagccactttcacagatctggtgatatggctgggtttccaatctctatgatcctggtaggttttggattgtaaacctttagaacaatgtatactatagtaaggtaacttttaaaaatcaaagaattcaaattagagaaggtggaaaactagaatggttccaaacccccgctggtaagtttttcatttaacagtacctggctccagggatggctcttcaatttcctgcaagaaaaaacgtaaataagactgtgccagatgaatgacacctacagtttatttaaatgaaaacccagaataactaaagagggaattttaaaaatccagggagggaaactcacaaactcaagaggtggagaacctgcttgttctaggaatggctccataagactggcatccacttcactcagcccaccctccattcagtctcccctgcaggagcctggaactggtctcacttcatggtgaggcactcatcataagcacgcctgaccctctagattgaactctcaaattcaaggagagcagtgttttcatttttctactgttagcatctagaggaatgcatggcacattaacagtcactttttcactcaatgaagctacgacaactttctgatattcgaaagactgagggaatatgggcccaggtggtatgactcctgctcttacttggcatggtggtgccagcatgaaaaactttgtaaataccctccctccttcatctcctcttccaatcagtgttcccaccaggccagttctagaagtcattcagactcttcccaggaagccctgtccactcaggctggtgccatccttgcctactgtggcatctggttgtattatccccatcccatctctctgcaccttgtgtccacagtaagctcatgtccctctgtggccttcagccttcagccaatggatccctatgccacctccctccctgacaggcccagccctcccctgccccgtccagccaagtcatccacatccctcagtatccagctcagtggcatctcctttcaggaaggctttccctatttccctctaacccaactccagctgtgccccactaagcaaaggagctttttccacatgatgtgatcccccagcctttatgtttcctgtgcacacaaggtacactcctctggaattccagtcaactgatgggcactgactaggttccaggcacaaatgtaagcaccttacatacacacagactcgtcatcggttgcaggaggttggtcctaatggtagcacccttctttttacagagtaacagactgtgaccagacagactgagtaacttgcccaaggacacacagcaggtgggaagcagagacaggctctgagcaaaggccgtgtatgagtgtgagtctgcactgttaaccatcaggccaggccccacgagcatggggaccacccttccttctcattcatctatgtaatgctggtagttaatgccacacctgacacatcacaggggattcacatatacccaataagtaggtgtgactgaattataacttcccctgggaactgccctgccattccaggatgctctatgaaactgtacactttcctcatgctttcacttatttttaatcagttttttccccatgtaccctaccccatgctgggaattctgaccataggactgaagcaaatcatcaatgttggcagaataattcttcctcattttctctaaagagaagcaaatacattcctatttgtttaggagagactgtaggtttcccattttaacatgggagactgtgaccaagaaagagccaggggaaagtgacaagatccggctcctcctctcctttctgagtcgggaatggccgtgtcaatttgcaggtggagagacggcagctctaaaagcgaactgggtttcaccacgttttcttgagatttgtgccctcctcaaggttggagctctggctttccagtatctcccttgcccttgcatggcagaagcaaatggagatcttttccaaaaggggatttctaattacaataacatagatgacatttaaaaagaagacgggaaaaaaaataaataaataaaaaggctgggcaaaagctggctcgatcttcatttctccacaaaaagttctcctaagaattagccagctacctaggtaagtgtgttctaacaatttgtatctatgtaggctggaaaaaaaaaggaaactcaagacccacaaatataaaaatcatacctggaaattctcaactcatctgttctcatctaagatttaatatttacagagatgccaatgaaacaggtaggatgatacagtcattaaatgaaatctgggcaatttcagaaaaaacaaaacaaaaacaaaacaaaacaaaacaaaaaaaacttcccaaagacaagaccagaacccctgagaccccaccttccccaacagggctctgtcaaccctcaatccccatctgggccctactcatctttcccaggtagccatgccctcttgctgtctcatcaaatcatctttctgcaggggatgccacccagggtagatgagacaggctgccttcccctgccacaagcaatgaaattaagaatgccacaaaacatgactctaatgactgctggtaagccacagcgcttggaggccactcgtcgaagcctagagttaagtccctggcaatgcgtacattatatttggaggaaagcagaaagcaaacacccattaacgatcctgacaaaggaaacaacccttgtggtgattattagctggaactggcatatggtgtctgaaatggattccagaaattgtggtctgacctttcattctaaaagtactgagacatacaacagtttacctgtaatatagtgaagtcagatgatgaagtatctaaattgtttatagtttctttgtcctctatctgtaaaataaatggagaaaatacagttcatcacaccaacaataacgtaacataatggtacatctgtacaatgaaaagtgaacagctatgaaaataattcacaacaaaattttaaacccagggcagaaatcaaaacactattatagtataattgcagctaaactgaaaaaaaagttgtatgtaaatgtccacctgcacatagactaggaaatctactaatatggtagctatgtaggttttaagatgcaaaagaaagaaaaaaagtctaagtcaaacagaaaagagatgaaaatgagtgcacagcctctaagtggatctgagcacagggtgagggctgttcttccaggagcaatggctagagtcctgctgaagtggagccttcagccaccgctgctcgcccagcctggatgctgaggatgtgggacctgctgcccctggggtaggtacctccctcaatggaacagcatctcccagcatgagggtgaggacaggagctcgagactggcaatatcctatgccctacttgcaggggaagaatagcttttattctaagaagtaggctctgcccaataaggcaaaggattccccaaacaaagaaagggggttcagataatttgtgactgaaaccaattttggccatctgctctaaagccctgaaatttgagatatacttagggggagacgttttcagatattttataaccagcatgtatttttatcactatatttcactaggaaagacacgcacacgatcagaagactcaaaaggtacaaaagcccattcactgaaaaccactctccactactcctttcttcctgccatgcagtggtcatcgcatatgctacacacgtgtttaagtgccaaagaccatctccccttagacatctgcaccaggggcagcacatcattctgaaccctccccaagtgtcacttctcttttggagattgtttgagttcacacagatgtgcttagttcattttgatggttacactgcagtaaaaactgtattcgtggtggtacatttcataactctacggtgctttctagatgctaggcattgaactaggctgggaaacactttgttggagctgcctagtaaattcttcaggaattgtagaacagatgagtcaggactcctctctgacactaaagcacaaaagcagccatagacaacagtatcaataggtgtggttgtgttctcagaaaacttcatttacaccatgagaccctgtcttgaaaaaaagcaaaacaaagcaaaaacaaaaaaaccccaaaacaaaaacaaaacaaaacaaaaacaacccaggtgacagccaacttgatgacttctgctttaagtgtataataaacatccatccattgaatcttccgaaaacctcttgcaagtgaggagcagaggttaaggagtttgtccagggacacacagaaattgatccatctccagaatctacctctgaactctttttttttttttttgagagtctcactctgccgcccaggctggagtgcagtggcacaatcctggctcactgcaacctccacctccctggtccaagtgattctcctgcctcagcctcctgagtagctgggattacaggtgtgagccactgtgcccagccaagccaccgcacctggcctcaacccttaaaactaaactgcttccaggcatttaggatgtttccagcttttgttgcagaatgtatgattttctgcttaggagggaaaaaaacagccttaagaagatgcagccattcaggaagggtaagtaactcctgctgctgtgcaagtgtttctgctactcctttttagaagctgatgaatgggactcaccaaaaattgcacaccctatttgtatcagaataactctcagccacttctcagactcaaatcctccattcaaatatgacaatctgctacctctaaggatacttggaatcagttccaagaggaaatgcaaaaatattctgaagaaatgcagaagcggattgactggcatacaacaaggtttctgtccaccaagactgcttgagaagcactcactgcggaagacctaaggaccaggacaagaacagggccccccacgagccaacacagaaagggccccacagcttctcatatgcatcactttttctgtctgacaaacattaatcatcaggtaaatgaaattaatatcaaattaatggcaccaagacaacatcgtacataagttaagtacatggcctctggaattagcctgatcttagttcttattctgttatgagctgtgtgtcatctggagatgttttttagttcttgccttcccaatttcctcaactgaaaatggggacaacagcacctcatgttgctattagaagaattaaagggcacatgctgggcgcggtggctcacacctgtaatctcagcactttgggagtctgaggcaggcggatcacctgaggtcaagagttcaaaaccagcctggccaacatggtgaaaaccgtctctactaaagatacaagaaaattagtcgggcttggtggtgggcgcctataatcccagctactcacttgggaggctgagggaggagatcacttgaacccagggggcagaggttgcagtgagctgagatcgcgccactgcactccagcctgggcaacaacagcaaaactctgtctcagaaaaaaaaaaaaaaaaaaaaaaaaagaaaggaagggcataatgccaatgcctggtaggtagtattcaggaaatactacccactataatcttactatccatttgatatgtttctaacaggaaaaaaatttaggtttaaaaacaacatccaggttaatacttgaggttaactcttaagataggtatcaactggctgtgtttttttttttgtttgtttgttttaaacaagagatagggttctgtcagactctgccacccaggctggacttcaattgcacaatcatagcttagtacagccttgaactcctgggctgctccttccacctcagctttctgagttac

SEQ ID NO: 661 - DNA, 188636 bp, Human
  misc_feature (1)...(188636): n = A,T,C or G
ttctcatagtaacacaaaccctattgtgaactgcgcataccagggatctagtttgcatgctccttatgaaaatcaaacacctgatgatctgtcactgtctcccatcacccccagatgggactgtctagttgtaggaaaacaagctcaggtctcccacagattctacattatgatgagttgtataattactttattatatattacaatgtagtaataatagaagtaaagtgcacaataacaataatgcacttgaatcatcctgaaatcatccccctgtcttagtcacagataacttgatttccacgaaaccagtccctggtgccataaaggttggggatcactggtctagaatgttatttttcaatgatcatgaaagtattttctcttattcttcatttagctcctacctgcattttatatgaatcaaaaaatataaaaataaacattcccaagatgctgggcacacttactccctcacctcttgcagcatccccagggtttatttttcatcctggcttcctttctctgggagtgttttcagtggggatgtttgcatgtggcaaaccttctgaggccttgagaatccagaggttttatgatttcacattggagtgacaatttggctgaatacaaaacactatatacaaagtttttctttagtactttagaaatattactcaattgtcttcttacctctagtgttcctcttaagaactcagagggaattctaatcttgttgccttgtaggtgatctgaaagccttcagacttttccctctgtttttgatgtgcttcccttttacttaatgggtctactggtgttttttgtgtgtgtgctgttttcccctctttggcaatttatgaatcttttcaatgtgaggtcttttcttcttctatagttttgaaaagtttccttagattctttcttcaaatgtttctttctttcatcctttatctcccacaggggttcttgataccgatatattagtacatctagttttctccttcatgtctcctaacttgtctttgatttttaaatctccagttctttccaggaccttccatgagaattcctcactcctcttcctgctcactgtccagccacagccatccttcatcacatacattatgggtctataatatttttcacaactatgattgcgatttggctctttttttcgatggatcttccttatgatccatgttagaaatgcaaaatgcttgttccccagtgctgcaagaaaagcttcgaacataaatttaattttctcagccaggcaatttttactttctgcagaaagggtgcttctcacagatgaaacaacggctgcagaaagggtactcctcacagatgaaacaacagcgagagcacatctggacaggggaggggcagcagttcttattcctgatggtggtagcccctactgctgtgtcattcccctagtggctagggttggaccgcacagcctaagctaataccgattggctatggagagggcaggggtatgagccagagtggtggggtgagtagtttagcaggaaggacggttaggaacaggtaactaaaggtgacttaggtcagagcaggtgaacaggatgagtcaggatggagcaggtgaccagaggtgactcaagtcaaagcaagtgaccaggatgagtcaggatggagcaggtgaccagcggaacagatgtgaactattgattaggactggcaggaaagttgtttactgaaactagaagcaaggggccaaagagaaccaggaagttaaactttaaaatggagaatcaaagaataagagagctgaatatactgacatactgattcctagaagagaaacttggggttcactatatttaacaatccacatagttcatgtctcccctcaaccctttagccagactgatcacaggtacttacagttcctggggaatgggaagttcccatagttctgcttcacaagtttctattgttggctgtgttgtcattcttctaaggcagtgcttctaccaagaagcctaggtattttggcttgtgaattcagattcgcctaggcatattagatatgaatctggtaatggggaagaacagaggctaaatcctctgcctgttgagggttaaaagtggaggggaaaagccctagagcagcagtccccaacctttttggaacctgggacctgttttgtggaagacaatttttccactgaccagaatgtgaggggtggtttcaggatgattgaagcacattatatttgtagtgcactttctttctattattattgcattgtaatgtataatgaaataattatacaactcaccataatgcagattctgtggaatccctgagcttgttttcctgcaactggatggccccatctgggagtgatgggagatagtgacagatcattagccattcaattttcataaggagcgtgcaacctacaacccttgcatgcacagttcacaacaggggtcatgctactatgagaatctaatgctgccactgatttgacaggaggcggagctcaggcggtaaagcaagctatgaaaagaggctgtaattcagatgaacttcactggctcaccactcacctcctgctctgcggctcagtctctaacaggcttggggaccactgccctagagcacaagaccccagggacccccattaactgcgtgcttgttctctggttagggttttaccttcaaactccctgagagatagtctgtttgtaatccacccgcgctggagtttgcagggggagagggctacggagcaaatgctctggcagttagttgtctatttccatcaatagctcatggcttttgctgtgctccatggtcccccagggcacctgtgacctagtctattgcagcctattcctccagttaaggggaggccgtcatggcctcaaaactcatgactacaaggataggagcagaatttaagagtattcctctcacctttctctggctgacatctccagccaccatctgccccagggtgcagtcactctattcacactcacccttcaacacaccaacacggtctaaggtttccacattttctgggttccattttgtttcattgcagaaatccatgttgaactgtcttttccatggttcctccacaattaacaacctgcatcctcttcccctttcctctctaacaaactttgagtcatggcctgggggctccacggctgtaacctatgccccaacccaccagagaaggatccttgggtgccctggacctgatttcagggttcaggagctaatcaggccgtcccttcccaagacctccctcccagtgttaaaatccctgaactgaggcctgagatctccatacccagctaaagttaagtctggcactgtcctctccatgctggcgggaggccagggacaggagggctgggacacacatgtgcaaggtgttccatatggactcccctctggggacagctgcccattgtcgtgagaacatggcaatcttctgatcacatcagatagtgcatgtttctctccctaggagacagcggaccctgaaggtagcttcccacaagcccaggccccaagagatcagtcctcagaggcaggcctccctggtttccccttccctgaatctgaggctcccaagctgcctggtgactcctctaatctccccccaccgaggcctccaacctacctgtgtttgttgggagccaggtgagggtccacgtaggagacgtggttggggctaaaggaaaaagacagcaaacactgactctccaggggcccagaagtgagcagggtctaccctatatatgagaggaggtaggggcccagagccagaccctcaggatgccttaagccaggagtggcctgagcctaagatctgcatgacagagttgttggcgtgtgtgtgttagtgtgtgtgtgaaaagaagagttgtgggtgtgcctgtgtaagacaaagagagacgcagagtgacagagagactgtgtctctgtccagggacctctgggggtatcttcccaacagttgaggccaggatgtgccgggtgaaggagaggtgagagtccatgtctgggtacaggatctttgctcccttcggaccagagcagaagacctggcaggatgggggatgatagaggcatgggagtgggtaagtgactttccttcaggtccctggggggtggcacagtggtatttcctcaagaaaagagctcacctgcaaacaccaccaggctgacatctctgagaacagtgacgatgtttttggaagtgttgtagatttcacaccagtaggatcccaagtcctccttcagctgaatcatggtgattttgaagatgctagcatttggcttgtcccagattgtgtaatgagacttctgaactgctgtctggggcttggagctggtgacaagtaaggtacaccgacttggagatgtctgctgacaccaggatttgggctgataggaccctctcttgggtgagtactggcattgcaggaagagggtctgtccttagtgtttgtgaagttcttcaggcacagcgccctttacccaggaacctgcagaaagaaacccaggtcagagctctggagagatgcatgacacacaatttacctaactaaaaaccctgcacatgaacacctgaaactaaaaggtttttttttaaggaaaccaaataatgacaaaaaataaaatgtaatccaccaatcttcatagttcagctgtgaaaaacacttgtaaaaacactagtaaaagggattactgggtcaaatggtatttctggttctagatccttgaggaattgccacactgtcttccacaatggttggactcatttacactcccaccaacagtgtaaaagtgttcctatttctccacatcctctccagcatctgttgtttcctgactttttaatgatcgccattctaactggcatgagatgatatctcattgtggttttgatttgcatttctctaatgatcaatgatgatgagctttttttcttatgtttgttggctgcataaatgtaggattataaatcattctactataaagacacatgcacacgtatgtttattgcagcactgttcgcagtagcaaagacttggaaccaacccaaatgtctatcaatgatagactggataaagaaaatttggcacatacacaccatggaatactatgcaccaaaaaaaggatgagttcatgttctttgcagggacttggatgaagctggaagccatcattctcagcaaactaacacaggaacagaaaaccaaacaccacatgttctcattcataagtgggagttgtacaatgagaacacatggacacggggaggggaacatcacacactggggcctgtcaggggttgcggggctaggggagggatagctttaggagaaatacctaatgtagatgacgggttgatgaatgcagcaaaccaccatggcacgcgtatacctatgtaacaaacctacaagttctgcacatgtatcccagaacttaaagtacaataataataagaagaagaatattaagggataaccccccaaaaatactagtaaaagattgtgaatgatgcatatggacttaaccaaaagctatgatatacctatgtcaggagggtggagacttgggtagtttatgcagctaaatctgcctttcagacaggacaccaataataataaaaattgacattttggtatatatatatacatatatatgcgtatatacgaaatgtacatatatatgcgtatatacgaaatgtacatatatatgcgtatatacgaaatgtacatatatgtgcgtatatacggaatgtacatatatgtgcgtatatacgaaatgtacatatatgtgcgtatatacgaaatgtacatatatgtgcgtatatacgaaatgtacatatatgtgcgtatatacgaaatgtacatatatgcgtatatacgaaatgtacatatatatgcgtatatacgaaatgtacatatatatgcgtatatacgcaaatgtacatatatatgcgtatatacgaaatgtannnnnnnnnnnnnnnnnnnnacttgggtagtttatgcagctaaatctgcctttcagacaggacaccaataataataaaaattgacattttggtatatatatatacatatatatgcgtatatacgaaatgtacatatatatgcgtatatacgaaatgtacatatatatgcgtatatacgaaatgtacatatatgtgcgtatatacggaatgtacatatatgtgcgtatatacgaaatgtacatatatgtgcgtatatacgaaatgtacatatatgtgcgtatatacgaaatgtacatatatgtgcgtatatacgaaatgtacatatatgcgtatatacgaaatgtacatatatatgcgtatatacgaaatgtacatatatatgcgtatatacgaaatgtacatatatatgcgtatatacgaaatgtacatatatatgcgtatatacgaaatgtacatatatgcgtatatacgaaatgtacatatatatgcgtatatacgaaatgtacatatatatgcgtatatacgaaatgtacatatatatgcgtatatacgaaatgtacatatatatgcgtatatacgaaatgtacatatatatgcgtatatacgaaatgtatatatatgcgtatatacgaaatgtacatatatatgcgtatatacgaaatgtacatatatatgcgtatatacgaaatgtacatatatgtgtatatatgaaatatacatatgtgtatatatgaaaaatacatatgtgtatatatgaaatataagtatgtgtatatatgtgtatatatgaaatatacgtatatgtatatgtgtgtatatatatgaaatatacatatatgtgtgtatatatatgaaatatacatatatgtgtgtatatatgaaatatacatgtgtgtgtatatatgaaatatacatatatgaatatatgaaatatacatatatgaatatatgaaatatacatatatgtatatatggaatatatgtatatatgaaacatacatatatgtatatatgtgtatatatatatatgaaatgtctgtgcagatcatttccacatttttaaactggattttttggggttttgctgttgagatttttgagctccatgtatattctggatattattccccctgtcagatgagtagtttgcaaatattttctttcattctgtaggttgtctttccacttcgttgcttgtttcctttgctgtgcagaagttttgtattttgttatgatcccctttgtttatttttgcttttcatgctgtgcttttgaagtcttatcatacaatctttttttacaaatcattatcttgaagagtttcttctttttttctagcagttgtatagtttcagaacttacactttggtctttaatccatttgaattgatttttggatagggtgagagatggaaatctagatttattcttctgcatattaatatccagttttgccaggactattaattgaagagattgcccttcccctaaaacaagttcatgatgctgttcttaaaaatcagttggctgtatatacatgaattaatttatttgttctctattctgttccattagtctatatgtctgtgtttatgtcagtgccatgctcttttggtcactatagttttgtagtatattttgaaatctgaaaattcagctttgttgtttttgctcgaaatagcttttgctaatttgggttcttttatggttccacatgaatttttaggttatttttctatttccatgtagcatgatcattttaacaatattaattcatccagttcccaaacatgggatgttttccattattttgtatctttttcaattcttttcctcagtattttatagttttccttgtagagttttttctcctacttggttaaattattcttggtattttttgtcactattttaaatggtattgctttttaaattttattttagctactttattgttcatgtgtaggaacactactgacttttgtatgttgattttatatcccgcaactttagtgaatttacttatcagctctaagagttttttggaagagtcttaaggtttttctgaatataaaatcatgtcacgtgcaaacagggacaatttgatttccttctttccaatttggatgcccttgctttctgttgcctaattgctctgcctaagacttctagtactaagttgaattagaatggtgagaatgggcatccttgtcttgttccaaatcctagaggaaaggcttttagctttttcctgttcaatatgttgttaactgtaggttatcttatagggtcttattgtgttgaggcactttccttctatacctgatttattgagacttttcattatgatggcatgttgtattaatcaaatgctttccctgcatctgttgagatgttcttatggtttctgtccttcattttgttgatctgatgtatcacatttattggtttgcatatattgaaccatccttgcatccctggaatgaatcccgcttgatcatggtgtataatctttttgatttcctgttgtatttggattgctagtattttgctgaggatttttgcatatgagctcatcaggaatattggcctgtagttttcctttataggtgtatccttacctggttttggtatcagggttatgcaggcctcatagaacaagtttggaagaattatttctccctcaatattttgagttagtttgaggagaattggtattaggttttctttaaacttcaacagaatttagcaatggagtcatctgggctttcctttgttcagagattttttattactgattcaattttgttactcattatttgtctattcctgtttcctacttcttggttcaattctgataggatgtgtgtgtccagaaatttatgtttcttctgggttttttaatttattagtgcatagttgccaataatagtctctaatgagcctttgtctttctgttatatatgtcacagaagaagaatagttgttccagacaccttggaggtctgtctccagctcagattaagtcaccaggtggaacagatggcatggaaagctcagagtgtgctgtcccatcattctcaagcaatacctgggtgtctagtagggatggaggcttaggtaaggccctgaagagcttttatctattccagaacatggcactttctgaacagagtcaaccctaaaagacactctggattcaacataacttgtgtctgaatgaggatcactgcacagaggacagaagaaagcagagtattactttgggattagctgaggccctaggctcatgcctctcttgtggattccagagaaccaggctggaccacatcaggcactatctcctgctccaaaaaggcccagggggtcctgaacctgagcaggtagaatgaccttcccttcaatttctatccccatgccctaacacaagccttagatgtacccacttcaagccagcaaaagtcccattctcaaccccagagaaaaggagctggggcttggagcactatgactatataagcttcttataccccttggacaaggcatcaacctagcaaatgtggtctggtggtgaatgaaatctgagcaatcaggagcctctttcttgcagttaaagaatgggaccaacagctctaagaacctgatgagcaaagagacactctggctgtcacagggtgggagctggaggtgggtgtcagtgaacacttgcaggaggaggagaaactttgaaggtagcagaagatttataaagcatagaaggggttagcattccatgctggggagtactgggagcaggtggtggagacacacgtacaaagcgtcatctacaaacgtagatggcttagctgagtggagaaaggagaaggattggttagagcaggacaataaatttctttagcagagagccttgaatgctgtgcagccctgtcactgtgcactgcagtcaaagggaagtgttaagggcttcctggaggcccctttgtggaagcatgaggagctcagtgcagattcccccagcagccacgagcaggaggaatgaggtgggtagatactagaagcaggagggagacctggtggattcctttggagtgagaagggtttggggctcccaagaaaggttgaggcccatcttccacaggcccaagccccacttgtctgttctgctggccaggaggagggagcaggctgggcttccaagcacaaccttcagcagacacacacacttgtgggttcaggagggtcagacctggggagcccacacttactttgacttggcagacctggcagtgccagccactgttctgatgtgccgattcatcctgaacagaggcctggtgttctcggtcctgtttgtcattctttgaaagtctgggccttgggtgagtgggggctgggccaggcttgaggtggaagtgaatgaggcaatgagacagctactgcagatgctgctgtgggaggactgcctcccaggggctccccagggctcttgtcccctgactcctcctcacttctgttctcaggaggtctttggacaggggcagcgccaggccctgggacaggggaaggatgtgaaccggctgggcttggttcccagatggacgacctgagcaggagggcaggagaggctgtgctgattggaccccaggctttccttcagggcagggagggcaggcttaggcctggcgggctcagatggacccttttcaagcaccgtcctttctctcactcctcaggtgaggtggcctcctgaagaatctccacaaggccaaccctggagaccagcagactctcccttccaggatcccacaggtgcacccttcctgcccagcaacatcacattccctggatctgttcagtggtcaagaaaggcctccttgactacctccctgagctcactgcttagtcccccaaccccaagagggagacatgagggtggtcctcagaaatcacagtgacggccatcggtctgggcattaaatagagcaattgggactcacaaggtgtaactcgagagggcctgacatccatttcccactgccttcctcactccctctgctgggatgtctctggcccttgggcagaccccgcaccgagacacatacctcttctggggagtttaagtaatcaacttgtttttagagcagtttaggttctcaaaacaatgagagaaagtacatagagttcccgtatacctcctgctcctcacatgcacagccccccactatccacatcctgcccaggggtccggctgttacagccggctaccctacattgaggcaccctgtcctgtcatcaagcacacaaccgtcctgagggctcactcttgctgctgagcacacgctgtctgtgctttgacagacgtgtgatgacatcaactcatcattgtgggatcacacagttgccccactgccctccaaatcccctgtgctccctcgttcatcccctctgtttataaatagggaaaaggttattccaaaactggcttcagttcagtgattagtgtggaggaaaaagggctccatgtaaaataaagcttcttccccaaagcctcggaattttaaccctcagagggcagagggcccacgttggctttcctttctttacttggtcttctctgccctccagctgcagtttgggaagcctccaggcctggagcatggagaggagaagaggaagggtcaggaaagtctggtgatgacccaaagagttcaagctgaggtttctcagagggcaccgttgtgggctcttccgatgacaccctgcctgtcacctgcagcttcctcatgtagccttggatctccttcctggtgggtgctcctgacatctccttcagcctccaagcctttcgcagtccacttccagcttcctgccatgcgtccctccacctccagcaggccttttggatgggatctacaaccacccatgctgggtgcctcacatctgtgcagcccaacatctggcccacggaagccatccacttccttcaccccaacaaagtcatggagcctgggggcccccacaaggtcacctctcctccattccaccatcaggacagcttgccgcctgctgtctctacccaatacagctctcagactgaatccaactcagctgctacatctcccagactgcaggggccacaaccatctttccaagttgtgaccctatctcaagcctctccctaggtttgagataagatgcaggaatctaaccctctcctcccccagggtcacagcacaactaccagctgtctccaaaagtcctctcccaatcttcacactcctcacaactttctacccttgatgtgtgtgagggattcattcctcaaagaaggtttcaataccttttggcatgtgcttcacactggcctcccacctcactctgacagatagcatatattttcttgggacttgcattagtcaagatttagctgcaaactacaaaatccaagctacggattttaaggagaaagagatttttaaaatcaaacattaaatgctttacagaatcagatcctgtgtaatttctgggcatcactcttaaagccacaggatgggctactaagggaccactgcctttgccacagtcaacaccctttccaaatcaggcaactttccaaatctggaagctgccatcacagccctggctgcagaacccctccatctcacccatagtctaccggcacaatggatgcctctcttcccattctagctcacttcctcatttaagtctcatacaaatacattgaatgggtgggacctaaaatatatctggaaccctagctgcaaaggaatcagaaatgatcttgtagaccttttactatagaaagacccatgaaaaagaggtggcagccactcacagtggctcacacctgtaattctagcactctgggaggctaagctgggtggatctcttgagtccaggagttcaagacaagcctggccaacatggtgaaacgttgtctctatgaaaagcaataataataataataaccaggtgcattggtgtgtgcccacactcccagctactcaggaggctgaggtgggaggatcacttgagccctgggaggtcaaggctgcaatgagccatgatcacaccactgcactgcaacctgggcgaaagtgtaaaactccatctcaagaaaagaaagagagagagagaagaagaaaaaagaaagaaagaaagaaaagaaaagaaaaaagaaggaaggaaggaaggagaaagaaaaagagagagaaggaaagaaggaaggaaggaaggaagggaaggaacagaaggaaaggaagggaagaaagaaagaggtggcaatgaatatatagtgagttcacagtgtctacctgaatactctcagccaaaactgagatcacaatagttaaaatttataagttttgttgtttcttttgctgtcaatgaaagtcaaatatgactaagtgaaaaataaacatatagtatttgctttgttatgtcaaataaacgctatttgtaaaaatatagtatttgccttgttacaccaaataaaccctattctgtagtataaacgttatagtaacaaattttcatttacagcaatcagtacatcggacactatgtgtgacatatcacactgaaggcatcaaatgatacagatgcagagaataaattcctattttcctcttccagaatttatcatacttttcttagaaacttcagtgtgtttaagaaaatgactcttattaccatcaagtgttagtaggtgctttacacctagccgtactaagatttcttaaaactttgctgtttgttatgtacacgctgtttgttatgtatcaagtgattattcatatgctttgtgtaaatcgtttctatacatgttaaaactaatcttttacacttagaatgctttcagattcacagaagagttgtgtaggtattgcatacttccctgatgtgctatgttcaatgtcttctattattaatatagtccaatagtatgctacatttctcacaattaatgagttgatattgatacattactataattttacaaaattgatgagtagaactcatatatttataatgcgtggtaggatagtttgatgtgtgtattaactgtgaaattactaaatcaagcaataccacatatacttaattgttttgtggtgagaacatttaaaatctattttctgtcattttcaattgtacaattcatagttatgaactgcattcaccatactgtgcaatagatctcttgaacttattttttctgtctaacatattgtgtttcttcaacaatacctacccagtttgtccaattcccagcctctggtaatgccattctactctgtttctgtggtagattttattaattgaagtccttacttcattcagattaccctggcttttacctcatgtactttctgtgctccagaatcccacctaggaagccacattgcttttagtcttcatgtctgcttaggctcctcttattcatagcaatttctgagaattatttcttagttttgatggccttgacagttttgaggaacgctgctcaggtattttgtagaatgtccctcacgtggaatttgtttgatgtttttctcctggggccagcggctttggggaaggagactgcacagctaattgccctgtcatcacatcaagtcaatgacacattctaacaacctgagttatccctgtgggtctgcactttggttgcctggctgccacagtaagtgtcaggtttctccactgtacagttactcttctcttccttcccatgctatcctctggaggaaagtcacctgcacagcccatgcttaagccgtgggaatttatgcttctgccttgagggcagaatacctataagaattgtttgcaatctctctcagtcccttcaggctgctatgagaagatgccttagactggagactttctaaataatagaaatctctttctcaaagttctggagtctgggaagtcaaagatcaaggtgtcagtggatgtggtatctgctgagggctgctctctgcttccaaggtggcgctttcttgcagtaacctcagttgactgaaggcatgaacactgtcctcatatggcagacagcgcaaatctgcttcctgcaatctctggtataagggcattaattgcattcttgagggtgacgccctcatgacttaagattttcccacaagatcccacctcttaacgctatcacatggaaattaagtttgaatatatgagatgggggaacaacattctgaacacagcagaatccttatgcatgggatatttgtctattcccccccgccagttctttattcagtcatttacttacatcagcatggactcctagagatttaatatatacattgggtagtaatccagtaccacttggttttgttgctagatagttctcacttcggccattttctgtttctgtacattttacacatgcgttgttctttcatccactgatgtattcatccaacaagcactgattgagatgatcccaagctaccataactgatccactcctacctgccttcccctccaactttccctgaccagcactctctttcctccctgctttcctggccccaccatttccagggaacatcttgtaattcctgggattaaaatctgccctctacaaaatgtctcagggtcaaaactcatcatcaacccaccatggctagaccagaaggactcaggggtctggtcgtgcctccaagggccctgaccacctataggaagtgcacagagagaaggaaagagggatgaccccagctttattcaccagctttattcttggccatgctgagagctgcccctagcaatagaggagcagtatgactggctggaaggcataaagcagcagacatggggagaagttcagtgaaaggcggcagagcaacgcagcagggctgaggtgcccaggcccagagacagaccctgtagctggtggcccctttcaaggcctggctgcccctcctcccctggtctgcagagcccgccctcccaggccgaccatttccccagcaagacactgactctctcaattttaccagctgagagacactgggaacctggggcagaatcagacccagtgtctgactccttctcctgagagggctcccttttttctcctctcctccgctgtcagaaacagatttgggctggaatggcctggggtggggtccacacctgctgcttccacctgtgctgctgctgctcctggcctcaggtgacatggagggaaagagtgcagggggtgtaaggagtgggatgaagaatgagtggggcagggagcagcatggctgtgtgaccataggacagaatttaggggccctcttccatgtgtgggcatcagaactagttccccctccccttccccagcctgtgatgggggaggttgggtcccttcagagctctgacctgggtttctttctgccggttcctgggtaaagggtgctgtgcctgaagaacttcacaaacacccaggacagaccctcctcctgcaatgccagtactcacccaagagagggccctatcagcccaaatcctggtgtcagcagacatctccaagtcggtgtaccttacttgtcaccagctccaagccccggacagcagttcagaagtctcattacacaatctgggacaagcccaatgctggcttcttcaacatcaccatgattcagctgacacagaatgactcgggattctactggtgtggaatctacaatgcttccgaaaacatcatcactgttcttagaaatatcagcctggtggtgtctccaggtgagctcttttcttgaggaaatacctctgtgccaccccccagggacctgaaggaaatgtcatgcaccccctcccatgcctctatcatcccccatcctgccaggtcttctgctgtggtccaaggggagcaaagatcctgtccccaaacatggactctcacctctcctccacccagtacatcctggcctcaattgttgggaaggtaccctcagaggtccctggacagagacacagtctctctgtcactctgcatctctctttgtcttacacaggcacacccacaactcttcttttcacacacacactaacacacacacaccaacaactctgtcatgcagatcttaggcacagaccactcctggcttaagacatcctgagggtctggctctgggcccctacctcctcttatgtatggggtagaccctactctcttctgggcccctggagagtcattgtctgctgtcttttctctttagccccaaccacgtctcctatgtggactcttccctggctcccaacaagcacaggtaggttggaggcctcggtgggggaagattagaagggtcaccaggcagcttgggagcctcagattcagggaaggggaaaccagggaggcctgcctctgaggactgatctcttggggcctgggcttgtgggaagctaccttcagggcccactgtctcttagggagagaaacatgcactatctgatgtgatcagaagatcgccatgttctcacgatgatgggagggtgtccccagagggaagtccatatggaacaccttgcacacgtgtgtcccagccctcctgcccctgtcctcccgccagcatggagaggacagtgccagacttgacttcagctggttatggagatctcaggcctcagttacccttagcctgagggacccttaggggctgcctctggcccctctccccttcctctcacacttttgggacccaatcccattctctattctggtgccctgggcagccactgtcttctctgtgtcctctttagttctgatcacttctccagaggggacctctggccatccctccatcaatggctctgagaccaggtaggtcagaggttttaacactgggagggaggtcttgggaagggagggcctgattagctcctgaaccttggaatcaagtccagggcacccagggatccttctctggtgggttggggcataggttacagccgtggagcccccaggccatgactcaaaatttggtagtgaggaaaggggaagaggatgcaggttgttaattgtggaggaaccatggaaaagacagttcaacatggatttctgcaataaaacaaaatggaacccagaaaatgtggaaattggaggccgtgttggtgtgttgaggggtgagtatgaatagagtcactgcagcctggggcagatggtggctggagatgtcagccagagaaagatgagaggcatactgttaaattctgcttctattcttgcagtcatgggttttgaggccatgacggcctccccttcactggaggaataggctgcaatagactaggtcacaggtgctctaggggaccatggagcacagcaaaagacatgagcgattgatgaaaatagacaactaactgccagagcatttgctccgtagccctcttctcctgcaaactccagcacgggtagattacaaacagactatctctcagggagtttgaaggtgaaaccctaaccagagaaaaagtatggcagctaatgggggtccctggggtcttgtgctctagggcagtggtccccaagcctgttagaaattgggccataaagtagggagtgagtggtgagccactgaagttcatttgaattacagcctctttccatagcttgcattactgcctgagctctgcctcctgtcaaatcagtggcagcattggattctcatagtagcatgagccctgttgtgaactgtgcatgcgagggttctaggttgcacgctccttatgataattgaatggctaatgatctgtcactgtctcccatcactcccagatgggaccacccagttgtaggaaatcaagttcagggctcccacagattctacattatgttgagttgtataattatttcattatatattacaacacgataataatagaaataaagtgcacaataaatataatgtgctttaatcatcctgaaaccatccccgactctcaggtccgtggaaaatttgtcttccacaaaacagttctcaggcgccaaaaaggttggggactgttgctttagggctttttcctctcatttttaaccctcaacggctagaggatttagtcttccgttcttccccattaccagatccgtatctaatatgcccagtggaatctgaattcacaagccaaaatacctaggctcttagtagaagcactaccttaaaagaatggaaacacacccaacaatagaaacctgtgaagcagaactatgggaactgcccattccccaggaactctaggtacctatgatcagtctggctaaaggggtgaggggagacgtcaactatgtggatcatgaggacgatccattggaaaaaaaagccaaatgctgatcatagttgtgaaaaatattatagaccacaatatatgtgatgaaggacggctgtggctggccagtgagctgtaagaagagtgaggaattctcatggaaggtcctggaaagaactggagatttaaaaatcaaagagaagttaggagacacgaaggagaagagtagatgtactaatgtatgagtatcaagaactcctgtgggagataaaggatgaaagaaagaaatatttggagaaagaatccaggaaattttttcaaaattatagaagaaaagacctcaaattgaaaagattcatacattgccaaataggggaaaacagccaacacacacacaaaaatacctctagacccattatgtaaaagggaagaacttaaaaagcagagggaaatgtctgcacgctttcagatcacctacaaagtgataagaattagacttcttaagaaggacactagagaaaagaagacaattcagtaatatttctaaagtactaaagaaaaactttgtatccagtgttttgtgttcagccaaattgtcactccaatgtgaaatcataaaacctctggattctcaaggcctcagaaggtttgccacatgcaaacatccccactgaaaacactcctggaggaaggactcagctaggatgaaaagtaaaccctggagacgctgctagaagtgagggagtaagtgtgcccagcatcttgggaaagtttgtttttatcttttttgatttataggaatggcagctaagagcaaaatgaagaacaagagaaaatacattcatggtcattgaaaaataacattctagactagcagtccccaacctttatggcaccagagactggcttcgcagaagacaatttttccatggacttggaggtaggggatggtttcaggatgactcaagcgcataacatttactgtgcattttatttatttatttatattattattacattttaatatataatgaaataattatacaactcaccataatgtagagtctatgggagctctgagcttgttttcctgcaactagacagtcttatctgggggtgatgggagacagtggcagatgatcaggcatttgattttcctaaggaacgtgcaatctagaaccctcgcatgccccattcataatagggttcatgctactacgagaatctaaagccaccactgatctaacaggaagcgaagctcaggcagtgatgggtgcgatggggagtgtctgtaaatactaagaagcctcccttgctcaccagccactcccctcccgctgtgcagccagattcctaacaggccaggaactggtactggtctgtgactcaggggttggggacccctgttctagacaatatcaacatggggtgagaaggagagaccagaagcccatgaaagaatggttgggtacttgtctcatgagaggcaatatgtagatattgataagctcaatgtagcaattgtactaaatcaatgtagataagagtcttcaggttaagtcaagagaatgtataccctttcatccagcaaaataaaactctagccaaaggaaagtcggaatcgaatttttaaaaaataaagcacaataaatggaaaaaatgaaataaaaaggtagaatcaagtcctaaaataaatgcaattccaataaatttaagtggattaaactcacaaaataaggacagggacactctgagttttaaaaagtgcaatgttatactatctataagagataaacatacaaaagattttaaaaggttaaaagttagaaaaatatatttgactattaggaaacaaaataaactcttctggcactcttaatatggaacaaaatagaatttaaggtaaaatattatgtctataacatttgtttataaaaaagacaaagatatgtaatatatactgatgaaagatgcacttgaatatgaaaatagacccatcataaacgtatatgtgcttaaattttggccatgaaatatatcaagcaacactatcagaaatgcaaggagaaataaattattagccattgtagttggaggttcacatacctctcagaggatcaaagaccaatgagacaaaactaaatagaggggtttaagttttaagccaaataactaataaattccagtataataccatcacatatttatcaatgttacatattttattaggtatttataataatataggatacatataaactatgcttttaaatatataatattttcaaatatataaaatatgtagttacagattgaaaaatgttctaaactatataaatatagttctaaactatataaatataaaacatgtatattatgtatgttttataaaatacagtattcataaatataaatagtgtataagtacacatatatatgtttataaccctctacataataaaaacagatagtatacattctttcaaatacatgaaatgtatttacaaaaggacaccttgtataaggacatataagaagcgtgaagaaattctaaagaatcagtacgacacagaatatattctccaaacctaacgcaatgacattaggaatgcataagagaaataaaatagcacttttcaaactatttactaatacattcatatatgaatgtttaagtatgcaataaaatatattttgataatatgaccactatatatcaaaaagtatgaggcataaaatattagggagtaattagtacctttgaatatatttgttggaaaacatgaaagatttcaaattaatgagctaaggaagcatctcaagaagatggaacgcgagcatcagagcaaacccaaagaatcatataattgaatgattgaaaaaggagatcaaagaaattcataattcattctttaaaagtttgctaagatagacatgttcttgtcaagacaaaagaagataataaataaacaacaaatcaaagaaaaagaagaaaataaccacacactgattctacagagattttaaaataaataaatcctgaataaaatcttgttgttttaaatcctagaagcacacaatttcctaacaatatgaactgctaagattaacacaagaagaaacagatttcaatagattaataaataggaaaactgaaacagttgataagacccatcctcacagaaaattcaagactcatgtggttttcaggtaacccaatttttaaagaaacatttacatttcatgatttatatttcatactagatgttgcagaaaatagaaaagaagcaaaaacagcccaggtcatttgaacaggttagtgtcatcaaaatctcagaactaattaaaggagatacaaaaaaattaaattataggttcatttctctgatgcacatggggtccattccctaattaccattagctaactgaattcaagagtgcattgaaaagaagactgattataatcgaggagagtcttatcacaaaacaaaaaggatttttcaactttagaaaatctattaatataagtaaaccaaattcataaactacaggaaaaaagtcaactgctgcacaaaaagcatttggggaccttgagcacatttatgttatctgaaaaagctcttaataaaatggaagtaagaacagataacttggtaaagattgtacaccaatgattaccataaagattacttattggaggtataaactcaaattaaggattttcatagctaccataaatgtcttctaaaatattagagattctgatcaatgcttgaaggaaaggaaaacaggttacatgaaagaagattagacaagaagaggaaaaactgtcatgacttgcaattgatgggatcatctacccagaaaaagaatgagaaacaacaaactattagatctcacaagagagtttagcaaggctgccagatacaaaatcaactgacatacattacaaatagatttctatgaggaataatcatttagaaaaataagatcgttttcattacagtcacaaagtctataaagtttctagaaagaattaatttaaccaagacctgtttggagaaaagtataaaatgctaaaaaatgacaggtgatctgaataaatagaaacaatccatgactttggaagaggcaataacattgtaaatatgtcaatttctcccaaattaaaaagtctttaaatgtaatcccaaacacaacttctttacttttgtaaagaacttgaaaaatttactctaaaattatatgaaaaaggaagatacatgagtagctaagtcaaccatgaaaaagtgaaaataaaaagagctcactgactttatcatatattatgtaatactgaggcagaaagttaccaaggccacaagagaaaagcagatttgctgggacagggtagtcctagatcagagctaggcaggccaggagtgggggctacacagaggggatgagggaggacccctgggaccaacagacaggaggtctaggtctgtgctgtcaccactcctaagggtctggtcaggtcctgtgcagtctctaggcctcatttcctcagatgtgatatcttggctggtcttgaagatgcactgggctctgattcctaaggtcggatggtcccatccgacctgacctggttagggagaattcctgctcccccagctctatccctccccttccctgaactccaatcccttgttcttcccctggccagctttttcctccgttcaagactttgaggttccttctgactaggtcccctctcagtcccagagacctctgtggctcctgccccacacccctctgtcatcgttcagggtgggcccttacgcaaacagctccagctacaaggggcctgcctggcttagggacaccgcaggaggtggtgacatcctggcccaagtccatcctcctttctccttcttccctgcaggaaatcaagagcccctgcctgccttggctcaggtggccccagattcctggtcttggtgctatgtggactcctcctggccaagggcctgatgttgtgagtcctgttagtgctcctgatctgcaggtgccacaggtgagggggcctggatttcacctgggggcaatggagctggggccagattctgttcctagaaagatggctaggaagaagcagccaggtcacagaggcaggaaaaatgacagctgggaacaatttaaaagtgtgtttccttgcaatctctgccttcctgcagacacagaccttagaaagagacagaggctttctgggagtcccatcccagggctctgcctctgtctctgtcctgagaggaaaaagaccaggaggacaaagctgagagtgcctgggtagaaggtttaggagacaggaaggggcagggaaggaagcaggtgacagggagaaggcgggggaggggcgggaagaggagtaacaggtaacagggacagggtgagacaaaggatcagaaaagcatcacttccattcatgactttccccctcttgccccatctcaggacagcagtgacgaggtttctgattgtcccagcacagccttgtcccaggacccttgggtgcatgagccacaacatggatcctggatgaatcccagttcttcccctgcccagctattgggagctggcctaagtattgctccccacctccttgtgaggaaaggctagcgctaagcctattggagagaactttcagcccctgaactccccggtggtgacccctcacccctgcactgagcccccttagatctactgcccctgccctgactttcgccattgggaagacctggggtgggggtttctgcatccgggtcaatgcccagctcagcatcttcagctgtgcccaggctcctctccagcactctgtcgttctctgagccccacctcagcaggtctccaggatccctcacatttcccctgtttgttgcctgtggtctgccctagagtcctatgaatttcctcttgtgcttaattaaattcaacctctgaactgaaatgtgtcaggggcagctgagcaagacagcagttgtatcccctcaccttcctcccgtcccaccccagatatcctaaatgagagagaaatgacttaaaaataaatgataaaattgaaactaagaaaggctgtaatcagcagactggaagctgaggaagatctagaagtaaaagaaaaaattagatgcgttaaaatgacatgagcaggcgactcagtggcccaaaacaggacccagaacattcatccgtaaatggaatctgataatctggggcccaaattctgtttacttaacatgtgagaagattcacagcctaaaagagaaaatcaagttgaactaacaataaatgatggtgggtgaaagataaatgttttagggaacagaagaggagcacatatttatgaagcaagaataggtacagtcattttccaactaacatctagtgagactgggattcaccactcagaatgggggtccaccatgagcaaccgatttgaggtaccagtgcatagcagctgaatgccagccctgtaaaagaccaccataaagagagctccatgttcttttgctcttttggggatgggacatcaaacaaaagtctcttcgtgtatatctcagctcctgccacatgatcatcacctatctgtgagaggcatcgcttttgctttgtttatttatttttttaatcctcattccctatgtccacttgccttcctctccgaggcaactactctaatgcatttggtatgtaactttaaatttgaatgtattcttgtaaaacatccagtatttttttttctgtgactatgttttcacttacataaaagaaattgtgatagacctttttcatatgcttgtcttactccttgctgggcacatatacacagcccacttcttttcagtgcttattccattgcgtacatatcccacagtgcatcattccgaacccagggtgcatgtgcttttttgccttcacttttctatatcataaatgatgctgtgatgaataccctccttcacgttctcttgtggaatcatgtgagacttcctttaggacttatacacaggtggcatcagctgggttgtgggatctcagacatctaattaatactgccagcttgtgttgcctgaaccaagaatctagacactagcgattatgtgttttctctgagtctatgtgaagtacacagcacaacctatggaatggtattgccaattaaaaaaaaaatggaaggcaagaataaacgtagctgagtgatgctacatggggctagatatatgattatctctacttttgtgtatgcttggaaattttcataattaaaatggtacctaaaattaaacacttgtgtcttgaagccactgctatttggttttcagtcgtatgtggctgaacccagttctttcttattgaacttttacaactgcagtaggttgggaaaagttgacttgtcgtatggaaatattgagcttcacttaaagaacattgatagtgggataaaaatggactaaataaaaataagtcttccttaatcagatgctaagagcttagcatttagctataacttttaaatattttatcttaacatccttggcctcaaaattgtcataattcccttaaccacaattttcaagcaggtggtaaattctgtgtcataagttaacatctaaaaaatgtagctttctttaaaattttgaacatttcttattgttttcttaccttcatagtgttgctatggaaatgtctgataataatctgatagttattcatctctactgaccaattttatctctggaacattttataattttctttttgaaatttgtattataatgggtgtaatgtggggtaattatccattttttccttttttttttttttttttttctttttgggcgaaagagggggaaaagagtcagggggtggttgggaagcccggcgacaaaagggggaaagagggagggagcaggaagccaaaagcctatatcacccggtattcccaggcggaatcccatccaagtactaaccaggccgaccctgcctggggcgtgcctcgggcactttcagggtggtatgaccctagaggccagcagtggcgcctggctgccccaacagcccgcggtgctgcagcggcagacctccacgaagaggtcccgggctcccgcgggggcgcaggcgagcggaaaagtgggagaagagtcaagaggtggttgggaagcccggcggcgacaaaatgagtaaagagggagggagcaggaagccaaagcttgattatacattctatttggaactctctgaacacattcagtctgatgtcttacatatttgtttaattcggaaaaatccttggtattattttttcaagaagttcttctactccatttactcctttttctcctttgaggacttctttgaggagatattgacatttgtttctatcctccatacctcttaatgtttcccttacactttctatcactttattccttcctaatgcctttaggaagtgctccttgactctttcccttacctactcattcttctgctagtcattgcattcagagttttctttcagcaatgatcattttcttaatcaatatttctaattttttcttcttcattattgcttgcttctgttttatgcttctaatattgttccttattgctctgagaatatctgctatgcttattgaaatcattgttttcccactggttctgctttctctgtaatagattattcaatttatttctttataagaaatttgttctatttgttatctttttatagcatttggtaatttttcttgtattctcatcttttattcccttcccaccccttttttttgaggatcagttaattactgcagatttcactgcctaaggaagccccagaggtaaatagagttgatgagtttgccataaaccatccaaatatagagatactatatcacaaagatagccattcacgtcagtgagtttatttaacaatgaaaacagcatatgtggccgggtgcggtggctcacgcttgtaatcccagcactttgggaggctgaggcaggcagatcacaaggtcaggagatcgagaccatcctggctaacatggtgaaaccccgtctctactaaaaatgcaaaaaaaattagccaggcgtggtggtgggtgcctctagtcccagctacttgggaggctgaggcaggagaatggagtgaacccgggaggtggaggttgcagtgagccaagatcgcgccactgcactccagcctgggtgacagagcgagactccgtctcaaaaaaaaaaaaaacaaacaaacaaaaaaagaaaaaagcatatgtttaactatttggaaaaaattaaatgttaccctcttttcatactataatctaaaataaattttaaatagatcaaagaattaagtgttaaatgagaaaattttaaagaactaaaagaaataactctataaggattcaattctagtaaggacaggcataagtaaccaatataagtgagacagaaatcatagagggaaaaggctgagagattttccaaaattaaaattttaaaactaatctgtgtccaaagtaagtcatcaagaaaacgaacaagaaaagaacaaactcaaaagagttttttggaattaaactagaaatcagtagcagaataacaaaaggatatttggaaacaaaaaactacaataaccaaaattaaaacctcactagatggacaccataggatagtagaaatgagaggatataattagtgaactagaagacagaacaataaatttacccagactgaacagagagaaaacagactgaaaataaatgaacaaaacctcagctatctgtgggacattactagaagagctaacttttgcatcaccagtgtcccagaagcaaaggagaaaaagtgtgggactaaaaaattattcaaagaaatgtctaagctcctcaaatttggtcaaagacataaagttactgatccaagaaagattttggggatgatggcacccttctctcttgattatggcattggatacaagtctccggaactctcagaactgtttattaaaaagggtgaatagtactgtatgtaaattagaccttaattttctaatgggaaaaataaatgtaaagacaaaatacactgctgtattaaatcaaatgatggatgtaaaagtctaatgtatacatatttttaatgactttgaccaatgcttccaaatttctcttaaaaaagtttgaatccagtacatactttcctcgatcagtgagtgagtgtttgattccttctaccctcatcagcacagtgatcccaagggtcacagttttaatgatccctggcacagtgctgggcacactgtatcggtttcatagaatcatggattgcaagcacacgaagcccccgaagcaacttactgttctaatgggggaagggatgaacgaacatactgtgtgtgctggggaggggagatggcccctgaactcagggagctcaggaagttctaaggactgggtgggaaacattgaaaaaggaagggtgaataaggaaaacaaaacacatctgtgagctgagaggtctcaagtgacaatcgtgtctcattcctatgcccccagtgcctacctagccccatgcatagcaatgaggttgtgggaatgaacaaatgaatgaatgaatgagtgagtgaatgagttgagagactataaaagcttagggtcagccgagatagacttctttgcttggagcttgggggttcaaggtcagtttaagattgtggccatgcaagcctgaggactttttgctctgagacctgttaaaattaatgaaaatggagaccaggcctgaagagtccctgagcagacaaaaccagttaggcctcataagtaacctcaactttgcttgatttgcaaacatcagtgaaacttcacttgagctatttcttgtaaatgtgtgtattaaggaagaacagaacttaagctcaaccaatcagaagccaacaaacttatgtaggtaactagggtctttccaacaggataggccaaataagggaactttataactgtaactaattaaatattttcttcagtttacttgtcctgtaggagtcttccccttgcattcccccagtggagctcctcaacctcttctgtttggagctgcctgattcatgaattgttgtttgctcaaataatctgtttaaaattttattgtacctcagtttactttttgacagtcccatctaaggagtagaaacatggcactggtgagtagggggagcatacataaccacgggcgtccagctgggtccccacacactgaaggaggagatgacacagatactggacatcagaaatcaatgcttctgattctaggccttggggtaagtgaaggatgtggtcttgggccaagtgctgggtcatttccactggagatggaagcagcacaggcgagacagggttgagcagggggaagttgaaggggcttgcctgaatgctgacggaggctggaggcaggggaggaaggggctcttgagatgaggtgggtgagggaaagcactgtggtggctttaggaagcctgcacgaggagctaggagtctagagggagctggtgatgagtagagacaacaggaggagaggcagggagagggacagaggagacacatggatagggaaaaggagaggcggctggagggtgtgtgagactgtgtgcatgggcgtgtgtgtgtgtgtgtgtgtgtgtgtgtgtgtatgagagagaaagcaagactatgtgtgtgagtgtgagtgtatgtgcactcacacccatgtgtgagagtacaggaacccctcccacaacccaaactttatgggaaaccaaacagatttcaagtaagcctgtaagaggttatttacaagagggaacacaagtgactgttctgagcagatagaagcctgggagagaaagagaggcaggaacagaaagaatccatctgcaataaatgaatgaattagagtttataagaatttctttgtgaatgtgtgtatgtaagaaactagagttcaactccaccccaaatcaacagaatatacattcttctcagcaccacattgcacttattccaaaattgaccacatagttggaagtaaagcactcctcagcaaatgtaaaagaacagaaattataacaaactgtctctcagaccacagtgcaatcaaactagaactcaggattaagaaactcactcaaaactgctcaattacatggaaactgaacaacctgctcctgaatgactactgggtacataatgaaatgaaggcagaaataaagatgttctttgaaaccaatgagaacaaagacacaacataccagaatctctgggacacattcaaagcagtgtgtagagggaaatttatagcactaaatgcccacaagagaaagcaggaaagatctaaaattgacaccctaacataacaattaaaagaattagagaagcaaaagcaaacaccttcaaaagccagcagaagtcaagaaataactaagatcagggcagaactgaaggagatagagacacaaaaaacccttcaaaaaatcagtgaatccaggagctggttttttgaaaagatcaacaaaattgatagactgctagcaagactaataaacaaggaaagagagaagaatcaaatagacacaataaaaaatgataaaagggatatcaccaccgatcccacagaaatacaaactaccatcagagaatactataaacacctctacgcaaataaactagaaaatctagaagaaatggataaattcctggacacatacaccgccccaagactaaaccaggaagaagttgaatctctgaatagaccaataatagattctgaaattgaggcaataattaatagcctatcaaccaaaagcagtccaggaccagacggattcacagccgaattctaccagaggtacaaagaggagctggtaccattccttctgaaactattccaatcaatggaaaaagagggaatcctccctaattcattttatgaggccaacatcatcctgataccaaagcctggcagagacacaacgaaaaaagaaaatttaagaccaatatccctgatgaacatcaatgcaaaaatcctcaataaaatactggcaaaccaaatccagcagcacatcaaaaagcttatccaccacgatcaagttggcttcatccctgggatgccaggcttgttcaatatacacaaatcaataaacataatccatcatataaacagaaccaacgacaaaaaccacatgattatctcaatagatgcagaaaaggccttcgacaaaattcaacagccgttcatgctaaaaactctcaataaactaggtattgatgggacgcatctcaaaataataagagctatttatgacaaacccacagccaatatcatactgaatgggcaaaaactggaagcattccctttgaaaactggcacaagacagggatgccctctctcaccactccttttcaacatagtgttggaagttctggccagggcaatcaggcaggagaaggaaataaagggtattcagttaggaaaagaggaagtcaaattgtctctgtttgcagatgacatgagcgtatatttagaaaaccccatcatctcagcccaaaatctccttaagctgataagcaacttcagcaaagtctcaggatacaaaatcaatctgcaaaaatcacaagcaatcttatacaccaataacagacaaacagagagccaaatcatgagtaaactcccattcacaattgcttcaaagagaataaaatacctaggaatccaacttacaagggacgtgaaggacctcttcaaggagaactacaaaccactgctcaacgaaataaaagaggacacaaacaaatggaagaacattccatgctcatggacaggaagggtcaatattgtgaaaatggtcatactgcccaaggtaatttataaattcaataccatccccatcaagctaccaatgactttcttcacagaattggaaaaaactactttaaagttcatatgggaccaaaaaagagcccgcattgccaagacaatcctaagccaaaagaacaaagttggaggcatcacgctacctaacttcaaactataccacaaggctatggtaaccaaaacagcatggtactggtaccaaaacagagatacagatacaatggaagagaatagagccctcggaaataataccacacatctacaaccatctgatccttgacaaacctgacaaaaacaagaaatggggaaaggattccctatttaataaatggtgctgggaaaactggctagccatatctagaaagctgaaactggatccctttcttacaccttatacaaaaattaattcaagatggattaaagacttacatgttagacctaaaaccataaaaaccctggaagaaaacctaggcaataccatttaggacataggcatgggcaaggacttcatgactaaaacaccaaaagcaatggcaacaaaagccagaactgacaaatgggatctacttaaactaaagagcttctgcacagtaaaagaaactaccatcagagtgaacaggcaacctacagaatgtgagaaaatttttgcaatctctccatctgacaaagggctaatatacagaatctacaagaacttaaacaaatttacaagaaaaaatcaaacaactccataaaaagtgggcaaaggatatgaacagatatttctcaaaagaagacatttatgcagccaacagacacgaaaaaatgcttatcaccactggccatcagagaaatgcaaatcaaaaccacaatgagataccatctcacacctgttacaatggcgatcattaaaaagtcaggaaacagtaggtgctggagaggatgtggagaaataggaatgcttttacactgttggtgggactataaactagttcaaccattgtggaagacagtgtggcgattcctcaaggatctagaactagaaataccatttgacccagccatcccattactgggcatatacccaaaggactataaatcatgctgctatgaagacacatgcacacgtatgtttattgcggcactattcacaatagcaaagactttgaaccaacccaaatgtccatcaatgatagactggattaagaaaatgtggcacatatacaccatggaatactatgcagccattaaaaaggatgagttcatgtcctctgtagggacatggatgaagctggaaaccatcattctcagcaaactatcgcaaggacagaaaaccaaacaccgcatgttctcactcacaggtgggaattgaacaatgagaacacttggacacagggtgaggaacatcatacactggggcctgctgtggggtgagggggagtggggagggatggcattaggagatatacctaatgtaaatgatgagttagcgggtgcagcacaccaacatggcgcatgtatacatatataacaaacctgcaggttgtgcacatgtaccctagaacttaaagtacaataataaaaagaaagaaagaaagaaactggagttcaagattcccaccgattcccacctcattctgagagcccgcacccctgggactctgagcccagaagattccaggaaagtctatacctgacgttccagaagcctcaccttcctggatcctagggatcagtttctggggcgggttggggatgacgggaagccctctgactgtgagccctccctgggctgggggtccagactgggtagagcagccacacctgcctgaatttccgaggaaaggggcagaaacagctgccagtgctgctctcgcgataggcttgatgaacccctgcagtcggttggggatggtgggtcccatactgcctaacttccctaattgggtagcttcacttttagaaccccaggtccttccctggcaggcccaggtggcacgtcctgtgtggggtgggccctcaccctggatcccccgggtgccctggccccttgctgggcctgtgactgcccagctggatggagccatggctgctgcgttcctgctgctgttgctgctgtggccacagggccgcatctcagggaggggagaaggggctgccttgtggaggagggagtgggtacataagcaggagctctagatctttatcaaaaaccacccttcttgcttttctggcccaattgtcttgtttagttttttgtgggttcagtgaggaagaggttggggctgacttcgtagctctttaccagagaccactgggcatggtgggggttggcaaaactcactccctactgcctgtgaaaggggtgggaggtgtaggcacacatgaacacagtgccctggagacccatcccaaagtcacccaactctgcacctcccagggtcagagaggttcctccctctgccacagcaaaaaagggtctctcctgtgctaagaaattctgggctcatccaccatgcaatggagttggatcattctgcttagtttacaaagaacagagtgatgctcagagagggtgctgcctcacgcagagcctcagctctagtggctgctggcaactggacagatgtcctgggttctgggcccttgactatcacagctctgggttccactggaggatctgggagcccccagcgtgtgggaaaatacagcatgcattgagcacgcactgtgtgaaaagcactgacctggggcagaattctcacagcaacctgtgagggatgtggtgctattctcacttgactgatgcaaagacagagattttaggtgccccgatcacaccgttaagtggtagaaacaaggttttgacccgtgtttattttgatccaaaatgtgtgctctctattctgtactatgggggagagtctttttatgtgtggttttgtgggagactctggggtgaaattatcagaagagtcagctgagcttagggcaggcagaggggtggagggagcccacggcagctttctccctctctctgtcccctgagtcaccttgcacaccccagttctgctctctctctaccagactgtggattatgaaggcttggaccacatcttactcctcagcatagagagaaagatattgcaggtggaaagtgaataattgtagaatcctgtggttcatactccattgggagtttgtttacatgtacatttggacaggcttgatctatgggttttatgtaactagaatactttaaaactaaacaccagctagaatgaactaaggtaggttattatttaaagaggactacagtgaacctatttgtgaaataaataactattaatcattttttcaaacactggattttcttatctacctaattagttgggcactgaaatttcagaacttaatgacctgtgtttgtgtctctgcatctttctcactgggtttttcccacaagaatgtcactctcccatcagactagaaaataccatgaggaaaggggctgtgtctgatggagctccaagtgtaagtgctgcatttcctccattagactgggggctcactgtgggatatacctgcctcctccatcagactgaaagctccctgagagggggacctctgtctgccccctaatactgggagctagctgttttcagggcccatttacctcccttcagactggggcaagctccctgagggtggggctgtatttccccctcaatctgtgggttccatgacagcaggacaatatccaccccgcccttcaccatgatcttcaactttcatgatgtcttcttcctctcctcttgccagaccttattcaacaagtcttgtctccacaggcccctctgctgggagcgcatacacaaaagtgaggctccttgaaagggggactctgtctgtgcagtgcttctgtaagggctacaaaaaccgcatggagggcaaggtttggtgcaaaatcaggaagaagtgtgagcctggtttcacccaagtctgggtgaaagggccccgctacttgctgcaggacgatgcccaggccaaggtggtcaacatcaccatggtggccctcaagctccaggactcaggccgatactggtgcatgcgcaacacctctgggatcctgtaccccttgatgggcttccagctggatgtgtctccaggtgagcgggctgcaggggcactgggacgggtggagggagtcctccctgccccacactccactaacatcagagataataaggataataatccatcaatggtcatgttgcactgtagtgttttcaaagtgcctttatggcactattcgtggcactattgtcaccattttacagatgaagataatgagacctgaaaacccagtgtgactctgagcttgtccggggtcccagagctagcaggtggctgagataaagttcaaacttggcactgtctgtgctgtgttttattcactcattgcttcaacataattcactgagcccgtattatgtggcaggcactattctaggctctaaggagacagtagtgagcaaaaacagacacaatcttgctctataataattgcaaataacaaatttttgtaagaaaaaacaacacttgtaaacaggaaagttaactcagtaatgcgggagctgtggaaatactgaggatcagaaaacacctccctgagcagatgacaccaagcagacccctgaatggtgagcattctccagctctgttgaaatctgggtgctttgaagggcactttgtggcaagggctgcatgtgcaaaggtcctgaggtcagaaggtgcttggcttgtacaagaaagacttatttggctaggtgcaatggctcacgcctgtaatcccagcattttgggaggctgaggcaggtggatcacctgaggtccgaagtttgagaccagcctggccaacatggttgaaaccctgtctctactaaaaatacaaaaattagctgagtgtggtggcatgtacttgtaatcccagatacttgggaggctgatgcaggagaattgcttgaacctgggaggcagaggttgcagtgagccaagattgcaccattgcactccaacctgggcagcagagtgagaccctgtctcaaaaaaaaataaaaagcaaagaaaaaaatgcttatttagtaactccatattgagtgcaggacagtgattgatgaggctgggagtcaagcagccctgaagcctatgagatgaagtttgggtgattctaagtacaagaggaagctactggagagctaagagaggtgtgtcacagcttatttttaagtatgtagtggccacttgtcgaggatggtctagggagggtatgagcatgggcatggaggccattgtgagcacagtggacagagttgcttcccagcctggagggcgaggcaacctctgtaaaacaccagtactagccctcccaacatttacaggtggaaagctggtgcgggaaaatatcagccaatacatgtgccatagtaggggacagtcccaggacagcggcctgggaccctcgatacttcatccaagatgatcgcttctatggcgtcttcaccgtcaccatgactgagctcagagtagaggccttgggattccatgggtgtggaatctctaaatcccctgagatctctattgtcagaatcatctgcctggtggtatctcaaggtgagttctgtcccttcgtatttgtgggtctcagacttcctgaatcacaaggtgttagagctggagaggatcctagaaatcttctccttccaccttctcatcactgaaaactggggacatggagaagaaaagcccctggcctaaggtcacctgctgctgaagggcagagccagccccagaatgcaggcctgctggcttttggttcttccttccacatcgtacgtatcgcccttaacatttttgctgctactaacaggactcctccatttatttggaatgagtttaaagtttccccatgcttgagcacaaagggcttaatggtccattccagacatccctacccttgactctaactgccagcatcttctcaaagggctgtagtcaagaaagatcactgagtaatggggtggggggataaatgtgacataggagatagccaaacaatgaggctgacatgagacttagggggtgaggctgggaggtgtagtagccaggggctcaggggacctggatcctctccctggacctgcccttatcagttgagagtcattaagcttcaaaatgagaagctaggggtcaccactaatcctaaggcccctgggcattccccctgaaattagagttgccaagctctcctgcctttttctgtgatggttagaaacagtggtgctttttccctgctgctgagtgtgcccagccacttggtcaaatgggcatctggaggaccccaataagcttctctttcttcactgcccaagctttggctcactgcccattccctggagggcacagggctaagctaggccctggatggggactcaaaagccttgagatcccatccggagctggaggagcccacagttgggccagagaaacagcatgtgatgaagggttatgacgtaaggtggtaggtggcattagagaaatatggtggacggaagaataatgaaagacagaaaggagggagaaggtttaaattcctagcaccaggggaattctaagcttgaggaaaacaaggtgcatatggaatacattaataaaagataacttataaggcaatatgccacaggcataggtgaatgcaaggtagaatgaatgatataaagtaaaataatcaaggatttattcttgaagttggggacatatggattggtgaagaatagcaggcaagtgcagttccaataaagtgaatagcctgaatatttcttttttcttccttctttctgcctttcctccctccctcctttcctcctttccttcttcctgactctaacctaggctgatcacacagtattcttaggttatagcaaaagaaaaccctgcttcttggccatgtccatttccttccttagctccatttaccctaacacctacccattcacccactcatccatcttttcatctacttattcttcctacatcctgtccattcctccactcatccatctatttatccacctacccatccactcacttccaaatagtttatccgttaaatcacccacttatccatccatccattcatccaatgttcttttcacaggtctcttaggtacccctgcctccaatgttaatcctacccagaacatgcctcagattcccacagttcttcctaccaccactaaggccctgagcccactgtatgccagcccaagaaccatgacccagccttcacccaagtcaactgctgatgtctccactcctggcccacagtcaacaataaaaatgtgacaaatgtcatcaactatgatttcccagcctctgagccccgggtttggacatcaagctctttgttccccagttcgtgtgctgagaggatgtgggagtgagggaaaggggaaggtggggcaggagcagacttgagtcacattagtctgggtagaaatgtccaggggaagaaggaggtggtgatggagaataggggaggctctcagccaggctgtcattctccctagttcaccttccttgttttcttgcaacctgagtattaaggagagggaaatggcatcctccccaaattccaatggagctcatccaaccccaggggcctgatgagtagtgggaacgcactctgaatgagggaccctggatctagtatctacctgactaactgactgtgactttgggtgagtcaggaaccctctctggctttagcttccttgtcaattcagtaggcatgctagaaacccagagctggaagacattgttcacccaacagctctcagcaggagccacatgttagggctaaatgcaatattggtttttgccttgtttggttagttttaaaaaaaaaatactgatgtgtgtgttctcatacacagaccaatagaatcagaatttctggaaatgaagcccatctcagtatttttttataaatacttcagaaagaaactcagagaggaaaggacaaacaggctgaggaatgagaaagaataaaactctttcttttgaaataaaaaaaaaatttatgcgatttttttccctttaagaggaaaatctgctttaattaaatggaaacaatgatccaagctacttaagtataaaagcacattgtactataaaatgtttaatctgtattaataagaagctaaatttataacaaggagctgaatgctttttagttgactatgttgaggcaaaagtctataaaacagcatttcctacaatggtggaatgttctctctccctgtccaacatgggtagccactagccatgcgtggtaattgagcatctgacctgagacaaatgagagtgaaggactgaatttctatttatcatttaatttttgttaatttaaatgtaaatagccaccttgacaaaattttgggagtgttttaaggcaagattaggacttattgagaagtttgatttaaggtaggtctttcaaagcaggggctgggctatgattaagtaaggatcacgatcaaacagtcctggattggtagaaacaataggatgaggattttgaagtgggggattcaaagaatcttatgttgccaactacctcttagggctttccatgaaagagttgatgaatctttcaggaatttcctataatgaacaagcaaaccattttcccagacaagaaaactcctggtaaagtagtattcacaaagacagaggaatagcaaagtcatgttaatgtagacagcaaggtgtgatttcagttctcagtgtcaagactgaatgtgggtatggatggtttctattcccaataaaaaaattatttttctaacaaaatatactgtggacaaaagcaacataggggaacagctccatgatattgtcttgacaaccttgcatatgccacataggtcacactggcagacacatgaactacagctaatttgaagcatggcagaatgcctgcaaccctcctagaacataaaaggatggaggcttgtgagaaccatggcccagtaacttctctgtctcccctgaaagacagttcctcatgccctcctgagttctgatgaggccagaggctctgtcccagacctcagaatagggctgcaggttatgaaaccacttatctgcctctagagtagattcctcagcagtggaatgtcccacaactcatattgcagttgtctggccccttttgttttggggtgtgggacaagagccatgaggagctggcacctttgcctaatctttcccttgttgtctgtgtaaataataaattgactgaaagtaaaagtggctcattgctgacattgtgccactgcactccagcctggcaacagagcaagactccttgaaaaaaaaaaaaagcggctaattgcattattagcagtcaaatcagtcaggacttggctttggcgcagccttgtctcacatgagcttaacaagtgacaaatgacagactgagacaagatatttgcaatttctaacatagaataatatctagttttttttccaagatggctgcctggaagcattttaatcacacctcatccacttagaagaaccaaatagtgtgtagacaatcacactttgaatacattatccaagagggaacttgagagttcaacagaaaagcaaaagaaaagtccaaaatcaaggaaatagaaagaaaacaggaagcttgtgtagttgggaccagctgggaaccagaacagaccctcccaaatgggagagagtgagtgagagtctttctgtgatccactttcccactggggaatcatacaatccaggacatgggagtgcaacttgactctccaatccctgaatctaacttacagagcagctgggagactgtgagaagaaacttccccatggaggtagcatgccctgggtttcacacccttcctgagacctaagaaactgccattcttgatccttgctcttaaaaaattgtgtgtggtcctaggaaccagtgatggcagtcttaggcattaaggaaactcaggctgcaacttgcagaaccagggcttcagtgaggaataggttcccacaaccaggactaagaagtaagcatagtgtggacttcagcttcaatgctggaacagggtacacctcctccccaaaacctgagcaggatgagatttgcctcagtgacttggttgagctgggcaggggttcctatagcccagggctaagttacaggccaggtgcaaactgcctggcctgactgaacactgggtttactatgacagccaggatatgggagggagccccaccacgacgggggcataagaggaatgcaaatcctcaaccagttgccaaatctgtggctactgggaccacccccacactccctgtagcaggacctcagtgcaacaatgcttgcccctcactgaagcattttgccaggggcctgagtactgctccatccccctgtagcagctggtgcatgcactcgccattggagggtctgagtatcagctttcctggccaagttgtgcccagcttcatcctacctcccaccccgagacagagtgcagaatctaagctccgaggggtttcacaacccaatccaccacctgggacacccacacacttccccctatgcaggacagaagtcaggcaaaaacaccctaccactcccacctcagctggcttctaccttcaagctccacctactgacctgaaggccggtccacacagcccattgcaaccactgccaacacaaaaacacagcactcaggaccaagaagaagaactcgccactactgctattgccatcacccatgccactttggctgtccaggagttgagagcccactcacctgccaagtacaccactactgcaactgaccttagaaaaagccaccccagatgcccaagaatcagcctgcctgggcccatcaatacaagtgccagtgtacgctgccctaggtcacaagaatagacatgcttagcccaccactgctactactgaaacctaaaggcccatctggcatttcagtccccagcacaacttcaccatagtctccaccaataactacatccaaacacaccaaggaaaccacagatactaccaacactatttatagccaaataactcatacagagtcttcaccactgcacacatccagaagcaaagcttaagggtactaccaaaacaagattatagtcacatcttcaagaaaaaagcctccccctcccctcatgagagtaaattcaaacacagaagaaatgactattacaccagatgtgcagaaattaatgtaaagaaatgtggcaggccaattctccctgacaatcacatagacagacctgcatagcactccagttacacagacagatttccacagcactgccttaacattgagcaaatagttaaacctaaggaaatcagtgcccagacatcaaagctaggaatgaaacatatggtcagtaggaccttacctgggcttctccttaacctggagcaagccaaatagtagaggcagtcttacattcctagtgccagggcccaacttgggttgacaaaatctgagatgacccgaggtaacaggggcagctgtttgaatagattcattgcagagtctaaagaaaatctctggaccaaactataaaggagataagatagaaataatcactccggtaccgcagtagacaggccttgaaggtactggggctctcaaagcttaatcggacttaacaagccttttttttttttttttttttgcctccgaccttctagttgaaacaaaattagttaccaatagacaggtgaatgctatactgcacataggcacataacccaacctacgtaagcactaagaaaattgtaaaatgtttagttggtctggtggaattatctctggccttctccctgtatccagttacagcaataaattcccttctttcctagtttgcctgcttctcattattgggccttgagaaaaagcagctggacctggcctggttccaggaacagaaacaggaaacattaaaaagcaaggtaatatgacaccctgaaaggaacacaataattcttcagcaataaatcctaaccaaaaagaaatccttcaaatctcagataaagaattcaaaatattgattttgattcagagacaagatgaaggataggagacagggcgaatgtgcagctcccacttggacagacagaacagtgtgtggagactcacaccatgatcttttgctccaagaaccactgcagaaacatatcaggaaaaccaaaagaatccacagattctttgaaagaagcagcatgccactgcaaattccatgagacaggcaaaaaaaactgtgagttcacaaagtgtgagggggggaaaacctgcctccaaacacacatttcaccagggaatctgaaaatccatatcatgagagaaggatttaaccttacctggagctaaaatggatttaggaagttgcatgacacataaaactagaagaagcagtgggaagtgccttccctgcagacactcccagtctccagctcaagcccagggaagccacccctgactatatctcacacaggccctcagggaaggcatccagcagaattagggaggggtcacagggtgaaagaagctcccaactgaaattagtagtaatttcaactgggcacaaattttcttgagcagaatccaggggatgaatgggaactgctgcagatatgagcacaggagctgctgccaacagtgtgggcagatggggagggttgaagcctgaaagccatgcttgctttctcagtggggaagctcatggcttggggcaagttctgaatggagcactgagggggcaagactggccttgccaactgcatgagagctggatgaggcctctcgctaccagctatcccccacttccctgatgaactataagacacagcagaagcagtcaaaatcccctctggaacataataccattggcctgagaatcaccccaccatccttcacagtggctatggcaagctctgcccaaggagagtctgaacccagacccacttaactctgccacccacctgatggtatttctctatgttctctggtagctgactaaaaagaaactcttgggagctttatggccccacccaacacctgagaaactaaaatacttatcttgtccaactcaggacatacttggatccccctactattaccacagatggtgctctcttgaaaacccaacctcttgtttggaggccaaccaacacaagccatcacagcaactcatgacagaacaatcctgatcccaagaaagagaagacaacagcaattccactgcttgcaatatcctggctggccaaaggtcctgagtgtgtccacgtgatatggttttgctgtgtccccacccaaatctcatcttgaattgtagctctcataattcccatgtctcatgggagggactcagtggcaggtaattgaattatggtggcaggtctttcccgtgctgttctcatgatagtgaataactctcatgagatctgatggttttataagggggagtttccctgcgcaagttctctctctttgcctgccaccacccatgtaagacatgacttgctcctcctttccttccaccatgattgtgacccctcctcagccacatggaactgtgaatccattaaacctctttttcttcccagtctcaggtatatctttatcagcagtatgaaaatgcactaatacaccacatgataacttcactgccagcataaccagcatttgacaaagccagcacactaaacatatctacaaccaaagactctcacagagtgtacttcactcccctttcaccagagcagctgttgggagacctgaagatgggtcacatcacaggactctttgcagacattctccagcaccaacccagagcctggtagtcccactggatggccacaaccagaagagcaataacaatcactgcagtctggttctaaggaagtctcatccttaggggaagggagagagtgccacaccaagggatcaccctttgaaacaagagaatctgaacagctgaacagcaggccttgagttccagatctttccattgaaatagtctacccaaatgagaaggaaccagaaaaacaattctagtaatatgataaaacagggttctataacatccccaaaagatcacaccagctacccagcaatggatccaaatcaagaagaaatctctgaattgccagataaagagttcagaaggttgattattaagctcctaagggagataacacggaaaggtgaaaaacaacttaaataatctttttttaaaatacagaatatggatgaaaaattctccagagaaatagttatcataaagtaaaaacaatcacaacttctggaaatgacatacacacttagagaaatacaaaatgcaatggaaaatttcaacaatagactagaacaagtagaagaaagaacttcagagcttgaagacaaggcttttgaattaatgcagataaagacatagaaaaatgaatttttaaaaaaagaacaaatcctccaataaatttgggattaagttaaatagccaaacctaagaataatttctgttcctgaggaaaaagagaaatctaaaagttgggaaaacttacttgaggcattaattgaggaaaatttccctggccttgctagagatctagacatccaaatacaagaagctcaaaagacacctgggaaattcatctccaaaagatcatcacctaggcacatagtcatcggattatctaaagtcaagatgaaggaagaatcttaagagctgtaagacaaaagcatcaggtaacctataaaggaaaacccatcagattaatagcagatttctcagcagaaaccttacaagccagaagaggttggggtttgatctttagcatcctgaaacaaaataattatcagtgaaaaattttgtattcagcaaaactagcttcataaatgaaggagagataaagcctttttcagacaaacaaatgctgagagaatttgccactattaagcagcactacaagaactgccaaaaggagttctaagtcttgaaacaaaacctcaaaatacaccaatgttacatacactgcaggtttatagcagcacaattcacaattgcaaaaatatggaaccagcctaattgcccatcaaccaacaaatggataaagaaaatgtggtatatatacacaatggaatactattcagccataaaaaggaatgaaataaggtcatttgcagactcacctggatgaattcggagaccattattctaactgaagtaactcaggaatggaaaaccaaatgttgtatattctcacttataagttggagctaagctatgaggacacaaagacataaggatgatataatggactttgggggctcagggggaaggatgaaagggtgtgaaggataaaagactatacattggatacagtatacactgctcagatgacaggtgcaccaaaatctcagaaattaccactaaagaacgtatccatgtaaccaaaaatcacctgttcccccaaaactactgaaatttaatttaaatttaaaacacgaaacaaaatattgattttaaggaaactcaagatgcaagagatgcaaaagaaatcaaaataaatgcaaagcactcagaaaattaattcaggatatgaatgagaaatttaccaaagcataaatatctaccttaaaaaaaaccagaaactctaaaactaaaaaattcattgaaaggaatacaaaatacattcaaaatcttcaataatagactatgccaggcagaagaaagaatttctgaacttgaaggcaggtattttgaaataatccagtcagacacaaataaagaaacaaaatgaataaagcctttgagacatttgggactacataaggtgacaaaacttacaaattatcagtattcccagggatgaagagagatccaaaagcttaataaaactatctaatgaaataatagatgaaaacttttcaagtctagcaaaagatttagacatctatttagaggaggctcaacaatccccaggcaaatacaatgtaaaaagtttgccacagcatattaaaagcaaactgtctaaagtcaaagtgaaagaaaaaaatctaaaatcagtaagagaaaagatgtctaaccatttatagaagaacccccatcagtctaacagtggacttctcagcagaaaccttcctggccagaagaaaatgggatgacatactcaaagtgctgatagaaatttttaaaaaactggtagccaagaattctacatacagctagattaagctttgtaaatgaaggagaaataaagtctttcccatccaagcaaatgctgagggacttcatcaccaccagagcagtcctacatgaaatactcaaaggagtcctaaacttggaagtgaaaagctgatattaaccatcatgaaaacacatgaaagtataaaactcactagtaaagcaattacacaaagaaggtagagaaaagaatcaaatgacactactgcaaaatttcaccaaaccacaaagacaaacaatgagagaaaaagaaaaaaacaaagacttgatagaacaactagaaaataattagcaatatgagagaaacaaaaccccacatatcaatattaactttaaatgtaaatgcattaaatgctccacttaaatgatatagattggctgaattaatttttttaaacatgattcgactatatgctgcttacaagaaactcacattatctataaagacatatacagactgaaagcaaagtgtggaaaaagatattccatgcaaatggaaaccaaaagtgatcaggagtagctatacttatgtagtataaaacagactttaaatgaaaaacaacataaaaagacaaataaggttattatatactgataaaaggattgattcagcaagaggataaaacaattctgaatatatatgtacccaacactggagcacctagattcataaaacaaataatattagacctaaagagatagacagcaatacaataataatgaaggccttcaacaccccactcacggtattaaacagtttatctacaaaatgatctaaaatcaacaaagaaacattggacataattggacgttagaacaaatcaacagacatctagagaacattctacccaacaattgcagaatatacattctttcagcagcccttggaaacttctccaagatagaccatatagtaggctacaaaataagtctcaacaaatttttaaaaatagaaatcatatgaaatatcttctatgatcatcaaaatttattccacatcacagtggaataagttttttaaaatagaaattatataaagtatcttctaggattgcagtggaataaaactagaaatcaataccaagaagaactttggaaactatacaaatacatggaaattaacacactcccaaaaaaaatcactggaccaatgaagaaattaagttagaaatttaaaaacttttagaaacaagtgaaacctgttaggtttctacctaacagagatcttgccattgcactccagcctgggcaaaaagagcgaaactccatctcaggaaaaaaaaaaaaaaaaaaaaaaaaagaataaaagaaaaaataagaaaagctcaggaccggatagattcatagctgaattctactaatcctcctcaaaaagacatcttccaaaaaaatcaatgaggagagaattcttcataactcattctacaaggccaatagatccctgataccaaaaccagaaaaggacacaacaaagaaaagaagtctacatactaatattcctgataaacatagacacaaaatttctcaacaaaacactagcaaacaaaaaccaacagtacatcaaaaaaaagtacacgatgattaaatgtgttttatactaggaatgcaaggatggttccacaatgcaaagcaataaatgtgatatagcacataaacagaattaaggacaaaaaatgtattatcatctcaatagacacagaaaaagcattcaaaaattcagcatcccttcacaattaaaaaccctcaacaaactaggcatcaaaggaacatacctcaaaataacaagagccatatatgacaaactcacagccaacagactgaatggggaaaagttgaaagcatttcctctaagacctggaacaagacaaggatgcctactttcaccagtcctgttcaacatagtactggaagtcctgaccagagcaattgggtaagataaagaaataaaagacatccaaattggaaaggagggagtcaaattactactcttagctgatcacatgatcttatatctggaaaagcctaaagacttcaccacaaaactctcagatttgataaatgagtttagtaaagttgcaggatgcaaaataaatgtacaaaaatcagtagtgtttctatacaccaataatgatatagctgagaataaaataaagaaggcaatcccatatacaatagtttcaaacaaatttaaatatgtaggaatagatttaaccaaggaggtgaaagatctacaaaacactgatgaaagaaattatagataacaaaaacaaatggaaaaacatttcatgctcatggatcaaaaaaattagtatcattacaatgaccatacttcagttaataggattactattaaaaataaaaataaataggctgggcgtggtggctcatgcctttaatcccagtacttttggagaccgaggtgggtggatcacctgaggtcatgaatttgagaccagcctgaccgatatggtgaaaccctgtctctactaaaaatacaaaaattagccaggcatggtggcgtgtgcctgtaatcccagctacttgggaggctgagacaggggaattgcttgaacctgggaggcagaggttgcagtgagctgagatcacgccactgcactccaatctgggtgacagagtgagactccatctctaaataaataaataaatatatatatatatataaataaataaataaataaaatgaccatactgcccaaagcagtctacagattcaatgcaatccttatcaaaatatcaatattatttttcacagaattagaaaaacataatcctaaaattcacatggaaaccaaaaagaacccaaatagccaaaacaattctaagcaaaaagaacaaagctggaggcatggtgttacctgacttccaattatattacaacactaatataacaatagtaaccaaaacagtttggcactggtataaaaatagacatgtagatcagtggaacagaatagagaacttggaaataaagccacttatttgtggccaattcatttttgacaaagttgacatgaacatacattggggaaaggacacccttctaaataaatggtgctgggaaaattgaatgtccctatgcaaaagaatgaaactggtcccccatctttcaccatatacaaaaataactcaagatggattaaaaacttaaacataagacctaacattataaaaataacagaagaaaacctagggaaaactcttctggacattagtttaggcaaagaatttatgactaagacctcaaaaacagagacaacaaaaacaaaaatagacaaatgagacttaaaagcttctgcacagaaaaaaaaaagatgaacaacactttagaatgggagaaaatatgtgcaaactgtacctccaacaagggactaatatcaagaatatacaaggaactcaagcaattcaacaaccaaaaaaacccattaaacccaaataatctcattaaaatgtgggcaaaggacatcaacagacattttataccaatcagaatggccattgttaaaaagtcaaaaaagaacagatgttggcaaggatgcagataaaatggaactcttatacaccgcaggtgggaatgtaagttagaacagctactaacaaaaaataaatttctcaaagaattaaaaatagaactatcatttgatccagcaatcccaactgtatacctaacaaaagaaaaataaatcaatatatcaaaaggatacctgcacttgtgtgtttatctgcactcttcacaatagcaaagatatggaatcaaccaaagtgtccatcaacagatggctggataaataaagtatgatatatatacacaatggaatactattcagccataaaaataatgaaatcatgtcttttgcagcaacatggatggaactggaagccattagcttaagtggaacaagtcagacacagaaagacaaatagtgcatactttcactcataagctgaagctaaaatatttgtacacatgaacatagagagtagaataatagacaatagagactcagaagagtgaggggatgggggtggggtggatgatgataaattgcttaatggtataatgtacatcattcaggtgatggataccctaaaaacccttacttggacactttgcaattcgtgcatgtaatgaaattgcatttgtatcctgtgaatttatacaaataatttcaacatctaaactaaccaagggctgattaaaaatcaacaagcggaaggaaggaagccaaatagaaaatggttagaaataggttatacattgcagtaaaaaactatatgcccaagaaactcataaacagatgtttgatcgtgttagttagagaaatactaattttaaaacatggaactgtcactttgaactcatctgaatggtgagcacatggaaggtggatgacactaggagttggtgagagtggaggaaagggggatccttgagccctgctggggggaatgcaacatgacccaacattctggagaacaatctggagcctctgtggcataaatatgtggctatcccatgctcaatgttccatccctgacttatgctctgttatgcatactattttttacgtcctgtttagaaaatatttgacttctccaaggtcattttttctacattttcttccagaaactatattgttttcaccttttatatttaggtctatgatgcattttcaattaatttcatgtgcagtgtgaaagagttaaaaacctattttgttttctgggtgggtatccaactgatcattaccctttgatagaaacaacatcttttccacactaaattgcagaggccctttagtggcagtcaagtgactgtctatgtgtgggtatgttcctaaaccctctattttgttcctattttctatttggcttaatgccaacttaacatgtagtttaaaaaattcttatatggctccttcaagagcatgaatggaagtgtttattttgaggtattttgtttgcttgtttttctgtttgtatgcttgtgttgttttgtggtagtaaagagttgaagcaacttaggttcccatcactagggggaacagaaaaatgaaatccaatactgcccctacattatatgaaatcctacctagcagccaaaaattgaagatttagatttacatatagcaacaacggatagtctcagaagcacaatgctatctgaaaacatataactagagttataattttcaaaaaaaaagcttaaaccatgagacaaaaataaacacatgctaaaaattttatttaactcataatacataatttatttgagaagatgttataccagtttaaaaatggaagtcaaaaggcacaaatgtatatgaagtaaaggaatattgaaatgaattgtacgtggaagcatatcagtttggggtttgcttttccctctcagcaggggaaggaagacagggcagagtttgcttgtctatcaataacctgcctttgtgaaagttagacttctctcacaaaatgattaccagataacataaagaagagagtgcaatagataatgcagaagtttcagtttaattgcagatttttttctacaacagagtgaaatgtgtaaaaaacaaaagcacacaaaatcaattctatatattttcaagaatctacatgcatgcaaatagacatggaaaatatgaaatatgattattaagaagatgcctatgagggaagggtaggcagtgcagctcaggatgaaggtagtaaagattaaaaaaaacacacacattaagctaggagtggtagttcatggctataatcttagcactttgggaggccaaggagggaggatcacttgagcccaggagttcaagaccagcctgggtaacatagcaagactccatctctatacataaaaatacacattaaaaaaacacatgaaaccaaatgagtggtaaagtgtttcctttaaagtgggccatgaaataaggagtctgtcaactcagtttggttacatgaagatcttttgtgaaaaaaataagacaaaagctaaagctaaaacaaaaacacagcatgtttgcatttttgtttgcttacagttgaccttgccatctttcagggcgtaggttttcctttataacatgaatgcaaggattgagttccagcctgggagaagaactgacttatccgaaagtgcccagtgtgcagtggtgggagaggatgggattccacatccagccttctgatgccaaatgtcatgctcttttccctgcaaattcaagcgggggaaatgattgggtcagggagcccatacaggagataggcaaggacgtttcacttggcatcctttatggtccctctgcaacatcagaaattcccttagacaagaacaatctgtacgggatgctgcttctctggctagattagcctcaagttttctccagttcctggagagaaggaatacgaagctgctatcaaaatggcactgcctgttatttatggttcaatgaagataattatgtttaagcgtatccttattaaacttgatacagttctcatttaacagtatgcgctcagtctttctcaaccatttctcttgtcttttttaagacttaaattaaagaactgggcagaactccaatgatggattcataccagaaggaccaagccatccactggtgcctgaattgggccaactttgctacatgtgaaatataggcctttatttccctgaactcaataaagatcaacaaacccaaaaggttggagccactgaatgtcacagaggggaagccccactgccaggggtttactgaggcctagaaaagggtgaggcacttccccaaggtcactaagtatgatcaaggcagagagggaccaagaatccacaatcttctattgccctgtgatggctgcccttacctttgcaaaggactgaagttttagtatttatgtaacaaagaggcaataagaccaaattaataaaatgctcctgagtcaggagcagtgggtgatggacctgcttgaccaattgcatcattgatttgtaatcagcctgtcagtgaccgggtatccttggatgtttctcaagaaccgggaagttattttattctattacatgggttcagtagattccaaccatcctgcccatggctctgtccctttgcttggtcaactgtttatttgcagatgctatgaagtctgacttcagccccagcctgtcctgatattcacatattcagattagcatatattcaaatagcagaagagcaatgtcctctgctaattaatggaggcctctcaaattcactagcttgaaaagagttttatagaaaaacttgaggcaaaagcactgagctccaccatcccagttccacctccccatgtaggcaggaaggcttgctaacaaaggaggagggggaattggcagtgtttccaccaatgagaagcaaccgaaggtcaccaaaatgtccttcattttcctccctaataactgtgcctcatctactgctattgaaattcctgagaagaggaacagcttttcattgaccaaacggggcccatttcattgattcaccaggtatgatgaaatcagatgggttcctgtaagtcccagctgcaccacttatctgcagaatgacatagtgaataacttaatctctttgagtcttctcttctgcagtgaagacagcagcacttatttcagagtaaagagattaacaaggtacatgcttggctcatagcacatgttcaattaaccagtttctctagcggccctctgccacagggtaagataattttttatattacctagtccaacatccttgtcttacaggtgagaaaacagaggcccagagagaagctattgactttctcaaaaaagtcacaaagcaagagaatggaagacccaggtcccctggtttcaggcctgcaacttttcccattgctctgtgctgccctccaaacagcccctcatgaatgggcagatggggtccagctcattggctgtgcctaaggagacccttccatgacctgaatcctgcagctgctcacctttgcaccaataccagccaaatccgatggtgcaggacaaaggggacctgaggagacaggtgggtcatgcactaatacgcctcaagtcctgcctccagagccctatcaccacgaccctgattatagcttccgtgggataatcctccagcaggtacctcccagcccaggcccagtttaggtctttgtttctagtctccatgagcaccagagtctctgggggaccctggctccaaccccactgccaggccttcaggctggaggcatatttcatgatgttgtaagaacaggccatggtcagattctgtccttctagcaggcacatttgctcctccatgtcacctacagcttggaatctgggaatgacaagtcaagcacttcactgagcaaacatgatttcttctctcacctctgcatccccaacctcagaccacaacacagacacagcgccacagacaaagagtattcctagctcctctgtcaagcatgtaggagtgattaagtatttctgtgattatttttaaatagttctgcaatcatatatgtgtctgtttgcacatatatatgatattatataatatatatatatcttagcaagattcctacccatatggagcaaataaggcaaatatccatcatggttgaagtttgaatctacgtgatgagttgactgtgactactctttctacatttcgtagactggaaaatgttcatcataaaaaggtacaaaagaacttcaccagatttaccacccattttctattccacatatggtggcccaggcatggcttttgctttctggtacacagttcttttgtttttgtctttgttttttgagacagagtcttgctctgtcacacaggctggagtgcagtggtgcaatcactgcagtcttgaccttctgggttcaagtgatcctcccatctcagcccccaccacatagctgggactacaggcgtgtgccaccatgtccagctaactttttgttctttctagaaacagggatctcactatgttgcccagactggtctcgaactcctgggctcaagccatcctctcacctcagcctcccaaagtgttgggattacaggtgcgagccatagcacttggcctcacacagctctttgtattagctcctggtgtccccaagacagatgctcttcccattcttctctgttttctcccaaatgggatggatattcccatttggtcccagagggcagtcaacctgaacagttgtagctggcactagtctctacctcctcttcaccctaaatatcacggatcaccctacacctggttccatcatcatcatctcccatcataacatttattaagcacttattaggccctaaatactgagccaagggctttccatacatccactgtttaattcttaagacaaccctctgatacctgtgagtcggttccatttacaatgaggaaactgagcctaatagaggttagaaaccttactcaaggtcacatacatagagtgtggctgagacaggatttgccccagccctgtctgattccagaactcttgtcttcttctccacattcccttctgtgccctgctagagtgacttccacagaagttttgttttcatgttactgcctgtctttttgctgttatttaccttttgctctactaacgcctcctctgcacagtgagtgaatgcttttttaaggggagactctgtctcgcttttctttacatctcccaggatatcagcacagtgctgggggattgctctgctgaatccacctaattctctcaacttcaagatgcagtagagggacctccagcttctgtttcatcgcccagtccctcctgggtcaggctggacaagcaccgtctgcatgcattgcctcctttccctttcccatttgtaccacattacctgatcccattccagtccatcccaaagatataagaggaaactcccattagtgggcacttctgctgggctgtctacatccctctccctggtcccctcttccccagcctgcttacccactctccttacctgcagcagcaggagcagcagcagcagcagccagggccaccctcagagccctgccccctccactctatctgccacccagatgtgctgtctgccggctggcccagggcctcttgtagttgctgcaggatgttgccccacatacgcggtcaccatctccccacgaggctgggtggctactttacaattgacaaaccttgggggaagtgtgactcggggaacagctcaggaagatgcagaaaaagaggggcaggctggccacccttgtgacagcttccttcctgccatcatgatgtcacagtcctgatgggaacactcagttgcttccctttctgcaccatggtgagtctagacccacccacctgatgtccccactgcgtcactcaccccttcaggccaccaacctcctcatcactgaccactgacccctacaacccgcaagcctgcaccccagtctccctgtgaaatggtgctgcgcaaacaaacattgttcatcccccaaggccgggttcaagcctttctgctacatcctccctctttaatatcaccccgcaccatggttcccaaggacaggcacgtggcttcactcaggaagtgtggcagacatacacacccaggctccaccaccagatattctgacttggcagatctgggaagggacccaggaatctgtattttagcaacagcttaggtggttctgaggcaaggagtccaagttgaccatgtctgcaagagctgcatataggtaagatggaccctgcagcatgtctcggtgactcaggggctttgcctgagtaccaggtatgggcttccctgagctaacctgtccaggcacaggcatggagaccccagttataacagtaatagcagtaaccaccatggattgaagtcctactgtgtgtcaggtgctttactcaggcgtctccttggatcctgtcaacattgggagatggtataatggaggtgtgtcatcttttgactctccagtaccaaacacctttttcttttggggggacaggccccaatgtgtgagtttcaccagatgcagagttctgcttccccttctattgaggatggaagcagctattcctcccacccttctcccggcagctgtgctgcaggcacgtgacttgacctaagcctggccacatgcatgattctgcccaggaccccagatctgcggatgaggctcaaatgcagggccagttgcagattacttactcagaggcaatttaaggattcagagtctaggaatagcatggtggcctccagtatccagggcagtggcattgatggcaacatgtccagactgtctcatgtggcctctgctgtccattctctcttggcttctgcccattttctaaacccaatcccccagcctctcatcaactctgagttactgatatccccctagaattcccttgctgttttagatagccagagttggattctgttgttagcatccaaaatcatcactggcatggttaggcactatcatgcccattaaggcaaggaggaatattgaagcccagaaggttaactgagtcacccaggatcagacaccctgcaaggatgcagagctagattcaaacccatacatggttttcctccaagacctgtgtcgttagccacacaacactattgtatcagtcaagataacagcaagacaccgctggctcattgaaactgggtaattgaggagcatttaataaacatgtgcatagaatttagggaatccagtaaggggtgcttcagtatgctgaggctggcaatagtggtgggtcattcccactgctgggcctacagaggagaggatggaacaggtggctggacttggagatgggagctgtttgctgagaggcttgaaggagccttcagaggggaatgcagccactcctgccaccacctgccagggagggagccctgaggacagaaaccctgatctgactgtctccccaccctcggctctcctctcatgcttcccattggctcaaccagccagaagctggcagccagggagcctgctggtttagccacattggtcaggttcccaggcaggatggggaggatggagcatggcgtggcctgtaagtgcaaatgggagagtatccagcacggccatttgtcttccgatttagtgcatataatatttcagtcacgtttaatatgttggacttaaataacacttgatctataataagttaagcacacaagcatgcactggaccatgcagtgggttatgtctggatgaatctgtatgaatgtgtcatgggctttggtaaggagtgtaatgactttttggaaacaagcttgagatccactaagagggagctgtatactagtatacagtaggtctgcaggggccctggactcataaagcatttgctttatgctccaggagaatctgatgcggtggcctaaagacctctgaaaaacattgccctcatgtgttctgcctctcctagagtgtatttaatgataatacccccttgccctggtcactttgtcaacttcataaacaggaacaatgctgggattgctgaagtgtggggttccagaccagcaagctcagcattattataaacactgcatcctgtacagtcactgcctctgagctgcttggttcttttaggtaggaaaataaatgcaccaagattaacagcttctggatctagtgcgtctgcaaagattctcaccagagcatcaggatgaaataaatgcccaccacacaccttctaatgggctcaaaattgcggttcagaaatcatctctctagggtcattaccattacctgggcaggttctgacagagcagcatttaggggaatggggaagtccttatgcgatggagcagtctggaagctggacctccccgtgcagggaactttttccacagaagtggtgctcattgtaaaaatacatttacctaacatgagacacacggtatgtgtggaaaagtatgattgctcttgggaactgaggataatatctgccctgggcatcactaaattgggctggaaggacccaccatcctttccccacccatgaggcccatttccctttaaagctcaaagtaggaaataacaaaatcctgattgaaatctgtgggagattgcaagacaatctcccacagagattgtctctgtggtggcctgaacacctacctgcttcaccggggagggcactggagagagcatggaaactgaggcaggtgttccaggagcagactgagagaagaggaggagggcagagtggggaactaggcaagcacatggggacagcctccagaagcctcccagggggagagcttttactccaccatccctgacccttgtgtgatacaggaaaagaggcatttagacacaggcggaactcctggttattctattctatatggttttggggtccttcaggtaaggagcgcttcagttttcactcctgccagtgggcagtggcttattcatgtggcctcgttctagtcacatacatttctgccttcacggggctattttcaggatccagcgataaatgcacacaggatgtctgacatggtctgttgttgctctcctatggatcccatctcggcctgccagtatttccccagaagaagatactcagtttaactcttttctctgagaaggatgcactttctcaccacgatgtcttatttctccaggttccacaatcttcaacacccttttctgggagtgttggaaagaaccacacataagcatgaaacccaagtgtctgatgctagaaagaggaagtcccagcatggggcgagcaggatgcttctgtagtgggagctctgtccaggtcaggccaaaattgtatggtccagggcaaaactgagcaggagaagtatcaggtgtgccttctgcatgtcacagcccccacaagagaattacggtgaaaagcattgagctgtctgtatttcatgccaaccccaagtggctggtggaatgaaggaccaagcatgtttggggctgtaacttcttttctgaggcacaaatgcccacccaagattattagaggaacgagggcagtgggcaggaaggtgagacgctgactttagaaatagccggtgattacagatttaattcatgttattaactccctgccttttacctcctccctcctcccttggcacaactgccagatggatgtggctggaagtcagaggacattctcgtgggttcgtgggcctagggtacaaatgacctcagcgtgacagcaaacaggacagagaagaccaggctcttactcaggaatccaccagccaggagaatgacaatgttgaacaccggaaccctgcgggagacaagaggctgaacgctactgctggcaaagtctctcccacacgcacatgttccctctagaaaatgccttcatgtcccactctcctctgcttagatccttgctccacctttcccgcactgcctgaccctgtgcttttcagtctgtctcattgccaaaaactactgattagaaacaattcagtggagagtataggtccctgtccaggagaggcactggagggagacagtcgggctgatcagcccatcctcctccctgtgatgtggtagggagagaggactctggccaggaaacccgctctctattctcagtaccgtaccctgcctactgggatggtcatctcacctctttagctcggtttcctcacctataaaccgagaagaatccacccgtagtgaaaatctcatcatgaattttatagattttggcgaaatgattctaaggtttctgggtaaacatcaataggtatcataataaaaagatgcaaaggagtgagggcacttggccagttccatcagcagacatgcaagcagatgagagcacaaggatgtggcatggtaagacacagggacagacagatggcaatggaacacaaaggccagatgcagagccagtgctatgcaggaacataatgtctaaggaaatcagaggtccagtggataagccggacgtggtagcatgcacccatggtcccagctacttggagaggcaggaggatcatttagtaaatagtcttgcagtatctggacagcaacatggtaacggtgtaggcttttctacagtttatagcatgtagcagaataaatcttcccccggactaaacatttaaataaaataaaaaaaaaacaatccaagaaaagtcaccaggaaatagaatcaaacacattaaggaataaagcaaagcaattgatttaaaatcaacacacccacctatacaaaacttaaaaccacatgcacaaactagcaaagagggaaacggcgtaaaggagctagaaagcagaaaactgcctatttgcctgaaatccacccccattcaagggccctgacttgtagcacaggggactacattcccaagcctgactggtcgagttcagcaactggtgggggacagggggcagagacgggggcagggatggggcagagagacaggcagcaaggggcagggagccagcatctctctcacccctcacatggtggtgcactcagcatcctcagcatctgccccgattccagtgctgcaacctgaatgtcctggcttccgggctctgctcactgcacctcctccccaagtctctcctgccagtgctctgcattatccactctgagtgctttaccattttcctatgctgaactcctggggcatgtccactcccaacaggccaccatctgcatttttttcgaggctgcacacaagctaccaaccccctgaagggccaggaattcatgtgcttggccttggttagagctgcccttgctcagttactgccccttatagggacaactccaaatgtgacccaggagtccccagagctccttaacaagactgagccagagttatcctgtgagataccccttggttatgacacgcttgcttggcttccttcccttcctggtcccacttcctcaatggctttgccagaaatcacttcctaaaacatttttctttttgtcttttttttttttttttttttttagagagaaagagagcaggatcttgctctgttgcccaggctggagtacagtggcttgatcacagctcactgaagccttgatctcccaggctcaagtgatcctcctgcctcagcctcccgagtagctgggaccatgggtgcatgccaccatgccctgctaatttttttattatttttttgtaaagacggagtcttgctatgttgcccaagctaatctcaaattcctgggctcaagtgattctcccacctcagcctgccaaagtgctgggattatatgtgtgagccacaacacctagtcctaaaacattttaacaagactttacagcttgcttctggggaaactacctagagatagggtgatagtggctacctctgcagtgcctctccatccccaggatagcgtctcagctcttccatcacctgggcaaacaattccctgcattaaattccttcgtttcatggctggatgtggtggctcacacttgtaatcccagcactttgggaggccgaggtgggaggatcacttgatcccaagaattcgagatcagcctgggcaacacagggagacccccatctctacaaaaataataaaaagtattagctgtcctggtggtatgcacctgtggtcccagctacttgggaggcaaaggtgggaggaggttgaggctacagtgagccatgatcgtgccactccactccagcctgattgacagagtgagaccgtgtctcaaaaaaaaaaagaaaagaaaaagaaaaaaagcttcttcttttcaaacagctagtgtggattccactttccagactggactttggctgaaaggatagttcatattagatgatagataaagttaacagataaaagagagatgcagtctctagcagcaaggcaggagaatagggtctggaggcaggaacgtaagaccaattcatgctgaatcatggagcaacaccaaggtctaggggcaagaaatctaggatggattcgtgctgacttcccatagctggatcaaaaggaaaactcctggggctggggtcagggaacctaaggccaattaacataaactttctaaagctaaaacaaaaggaaaaaccccatctccccatgccccagcagcaaagaatcaaaggctactctccctacagccctcccccttccaccacgtctcagctggaaagggagagtgtcttagattggccctgagccaagcagagacgaccatccctttacccacagagggcgccaattcaccttagcctttagttagccacaaaccaaatgcttcatccagataaggggtaactgggaggaacttcacgtggagtacttaaaacccagaaaactttgtaacttggcccttgagccacttgcgtggggccacttctaccctggggagcgctttctcgcttaaataaattcctgctttcactgcttcattcctttgttactttgtgcgtcttctccaatactttgattaaaaggcccagaacctggacagcttacacttaaggccctccttccggtaaaagtaagaatatgggcaaagattatgttctcttaacttatgtattgcaaaatgaaagtagaggaaaaaaaaaaattgactcttagtagatcattcgtttgatttattccacagaagtttaatgagcactttgttccccaaacaacataatggggaaaaaggcactgccactacccatatggaggtggagtctacactcatagagaaattagagcaggcaccagttcacatttgttttagcaggaatgtgatttaactcacactatttaatgatttaaaagactaaatccgtgtctgtaagcctgccatgacactgctttatttatgcttaatggatcacactgcaaattgtttccaatcttttggaagaccattggtagatgctatttgtatacaaaatgatatcagtgtttaaattatctcatggaaatttcgagttaattatttaaaagaagaaaaatatatctgcaagaatatgtttatctcagagttatcaacactatatcaatgtctaagaacaggccaatggttatgtaagttatggctttcccaattgatagaaaaatatgcactcattgaaattatatttatgaaatttaggtagcagcatcaaagaataatttcagcaaggaaaagaataaaaacatgtataattagacttactgccatattaaaatatgtataaacatgaataaagactagaagagaatatgagaaaaaagacatgttagactagtggtgatgtggaaaagtatttccatcctgataattcagtatttaatgataaacacattctaatataaatcaacatttaataactgtaaagaggtgtgaaattgctaagttagtggttcttaagtttgcctacacattagaaatctcctaaacatcttattaaaaatactgagagggacctcatctgcaaaaattctgattctatttatctataattgggcacatgcaacaatgttatttaaaaaacaataaggcaaaaaccaatactgcatttagccccagctccagctcctgctgagagttattaggtggacaatgtcttccagctttgggtttctaccatgcctactgaattgtcaaagaagctaaagccagagagggttcctgactcacccaaagtcacattcagttagtcaggccaacactagatccagggcccctcactcagagtgctttcccactgcccatcaggcccctggggttggatgagctccactggaacttggggaagatgccatttccctctctttaatactcaggttgcaaggaaacaaagaaggtgaactggggagaaggacagcctggctgagagcctcccctattctccatcaccacttccttcttcccctggacatttctacccagactaatgtgactcaagtcttctcctgccccaccctcccctttccctcactttcacatcctctcagcacacagactgggaaacaaagggctcagtgtccaaaccaggggcccagggacctggaaactatacctgatgatatctgtcacatttgtaaggttgatttcagagtcaggagtggagacatcggcagttgacttgggtggagcttgggtcacagttctggggctggtatagagtgggcacaaggccttagtggtggtaggaggaatcttatacacattctgggtagaattctcattggagccaggggtccctgaaaaacctgcaagaagacacattggatggatggatggacagatggatgatgaatgggtggatgggtgggtgaatggatgtatggatgtatggatgaaaatgtggatgagttgatggacgggtaggtggtacggtaaatgaagctgaggagggaaatgagcatggcccaaatgcaaagttttcctttgctaaagccaaagaaatactgtggagtcaacctgagtcagaaatcgaaaaaaggaaagaagaaaaaaagggcaggaagtgagggagagcagaaagagagaagaagaaaggaattttttgtcattcgtactgttggaaatgaacttgccttctgttcttcaccaattcttgtgccccaaccttctccaagaataattccaggcttacttgattcactctgcctttcgttcacctggcttatggcatattgctttaaaagttatcttttattaatatattgtgtgtgcaccttgtcttcctcaggcttagaattccccaggtgctgggaacttgagcctgcttccctttcctctgtcttccataattcattccttaatgcaacatctcctgagggcctactttgtgtcagaaactacattatttgctaggggtgcagagcccaggaaggcacaggtgcttccctcaagcagttctgaaatgaatagggtacagataagtaaacccccctctcctatccagtgagtagagttgtgtacaaggggacacaaaatgagctctggagacttgctcccccaaaatgggagccatggaccatcagcattggcatcacctgggagatcaatagagatgcagacccctgtacccattcagttggagtgtgcatttgaaataagatccccaggtggtctgtgcccacagaaagatgtgagaggggctgcttcagaagcacacaggcatgccaccaaacgcatccttgggagggggagtcaggacatgacttctaagtggagaacaaagaatgggactaaattatcccaaatctaccactcaccttaattgtaccccaattcctaccacagcacccaaaattaggctgtgctatccaaggagaatctcatgcatggaaggttctacttactactggaccttagatgagagataaagaggtcctgggaggaagacagactgctgggaatcctgaaccccagctctgctgatgctaccaccactgcccctttcctcacctggcccttctttccccccaagtcccaggccactcacccttggtcaccaccaagcggatgcgatcgaacagcatgtgaggctccttgggaggctggtagatcacacactgatacagtccagaatcttccacttgaaggttgaccattcggacgcgcagtaaaccatgatcatggtagtcttctagtatgatcctccccacttggactggatgggaattctttgaaggcctctctgtgcatgccagggtcttgggcatctctccgtcccttattatctgccaagctttctggctgctggcaaacttctctagcgtgtagtcacatttcacatccagggtctgcccctctttcagttcatacttttcctcagttaatttagttgcagctcggagttctataagcagggaaagagaatgggttctgtgaggaattatttttctctctctgagtggggaaaaaggagaggagccccctgtttttcttgtccaaccacccatatttcagatgaggttcttgaggcctccagagaaaatacaacttgccctgcaagccagcactagacctcagatctttccactgtgagtaggttttttactataagagactgcatatggtgcatgaggatcaaatttcataaatgatcagaagaggaagactgactttgagaggaagaaactgcctgcctggagacagaacatgggatattgtactaagaccacgagtggctgcagcatggtgggagggatcgattacaagggcgtatgacataaaaagtgaacgcaaagacacggtgctagcagagagtggctccaaggacaccttgaggaacttcatctaagtcagggcaaggagatcagctcaaaagacctttggacaaacagtgaggaagccgtctggagggcatgatgggcatggatatctgactgcctggcactcctttttcccttccttgggtagcagagcacccctttccaagggaacgatcctgtgtggctctactgttggggcagcccacattctcaaggatgggcacaggacacaggatttgccaatccaagtaccccatctcggggccaggcacagtggctcacgcatgtaatcccacactttgggaggatgaggaggtcagatcacctgaggtcgggagttcgagaccagcctggccaacatggtgaaaccttgcctctactaaaaatacaaaaaaattagccaggcatggtggtgcacacctgtagtcccagatacatgggaggctgaggtgggagaatcacttgaacccgggaggtggaggttacagtgagccaagatcacaacactgcactccagcctgggccacagggcaagactctgttaaaaaaaaacacacacacacacacacacacatacacaaagtaccccatctccctgccaggctgattggtttaggaaggagcacatggctgagctggaccaatcagagtcctccctgagactgctgtagccattaatggaaatgcttcttgctgggattcacaggtcaatgagatgtgaaactttattatgtgaaactttctaccacgtaggaataggctgcccgagaatggctaaacaggcagaaagtgagtgggaggaaggaagagggggatagtggaggggagagaaagaaagagagaaaaaaacccacgttatctgagtcatggactcagctgtgctccaaaggagcaccccttgtacttcccagttacctgagccaagaaatgccccctcctatttttgatgtcacggagtcacagcagtggttctccactggggagcaatttttgctccccgccacaactctccctgaaacactggacaatatctagacatttttggttgttataaccagggagaggggtggatgctactaacatctaatggataccaggctaagcaatctacagtgcacaggacagcccccacaacaaagaatcatcccaccccaaatgtcaatagtgccatgtttgagaacccctgggttacagtgacaatagtttccatcacattcttggagtccgaactgggttaaccatctagaattggggatgctcatctggccttgtccaagggagccttgctgatgggaggccaagcagagcggaagtgagaagaccaaggtccgtgttttcagctggacacacagggctctctaagtttgctgagagactgtagcttacccactcaggcctggggtaccttcccccatggagcaccaaataacaggctagacagtgctgctgggtctactgtgtgggtcacggtaacactagtactgctgttattaataccacacacttaggtccttgcaggcctggtgaaaaatgacaagtgcttaccctttcatggagccccctggcatgcccaccccaggataggccaacagatctgcctgaccttaggaagactcaactcagggactcacaaggagtttaaaggtgaaatcagtcttgaaagccagttcttctgggagcagactccagtttctagggaaacctcggaaacagacctcttgggcaactcccacacactccagtcaggaatgtgcctccaagagactgttgaccagaggctgagtgttgtctgaaaccaagcctggttccctcatttgttcactcactcatcagactggctgggagacttctctatcataggcactgtgctgggctctttggaagacacacagactccatcctcaagttgccaccactgaagccctaacctctgaagttaatgttacagataaatctcttttatttgccagctccccagggaaggtgggagttacaggtgactgagtttgcaaacttgcctgtctctcacagaaggaaggagacaataagaaatgaaggctgctgagctgtctgtgcacaattgcaagaagggaattcctttgaatatgttaattaaaagggtagcaaatactacctattaagtattatgtgctaagggtttttaaagactatcttatttaatctttataaagtaaaaagttgacaccattattctccccattttatagataaggaaactgaggcacagacagattaagtgatttgcccaaagtctcaccatagttaagtactagagccaggattcaaacccaaggactctggttccacctaaagcactgagctacatggtccaacacagtctgatagggattagagaagtcctggcccaagtgtgaataagtatccagttgcaaggagcattgaggttaacccctaacctatccccacagggcacaatgaaatatataccactggttttctctcacacaggtacataaccttcagccctctgccatctcccagttctccttcagaaaaacatgaatcaaacacaaggaaatgcacttgtccatgaggagctaactcccttctgcccatctagattatcaccccagctccaagaagacccagagcaatgtctgagcacaggctcttcaaggcagttgtccatgactttgctcaaagtagagagcccaggaggatacctctccctgatttttcatgccttcccaaggcaagcctcgcttttaactcatattgacactttcctcctgttattcataaggattaggaggaggagtgaataaagcccgcatgcttctggtttgggtgcagatgtgagctgtgcggatcgtaagaggagacacaagaaagagctggggcatgcgccggctctgctgagcctcagcaactgtgccctccaaccccagcgtgccatggagagctgggatgatcacctccaccaaaatgagcaccagcctcttctggtcacgtctgtgtcctcagcagtagtatatttgctgtcccatagtagacccctgggaaatatttgttaaatcaattctgtcttttgggtttaacagattgtcaacatcaaacacatcatgatggaatataagaaaaaaatttcaacatcaaataaacttattgtagatcatgccatgatgagatctactctatcattattcccatactaggctttgcatgtctctaacaacatcgacatgcacagacatcttttttccctgactctctccttcttttacttttgtgtgcagacactgcatgttctcccaattctgggtagagcagcacggtctgccataactactggttggctctatcttggatggccctgtgctctgaagcttcaacagaaaagggctccccgagatcctggaccaaacgcctcccctgctcagtcctcttccttgtcttacctgagacaaagagcatccacagcagcccccagagcctggtcttcctcatccttcctgtgcaccagctccaactgctgctgagggctcccgggacagctacaaggcaccacaatgacctagaggcttcggaaagttgcacaacaggatatgaggccattcctgggagtcactgagtttgggttctgtttcatcaccagttgctctgactcctgacatcaacacaataatacagagaccaagactcacttctcagttaagtttctttgaactccagttttcctttctgtggtaataatgacaattacctttcaaccttacaaaatctaagggagaatgatacttgaatgtaaatcaaagtaaggcattcatattaggaaggggaacagagggccctttgctctccagaggccccctctccattcacatccagtttagtgtagtgaagagagtcaggcccacatagggagaggctgcgacaatcgtatctcatcttcagggtttttgtgagaacatgttgcttcatcctgccctgctcagccccgtgggttctcttggcttctggtgacctggggtgcacctcctcttcatcaccaggagggccacaccctgcatttgtccttcagcattgccacagacatggcctgggagctcacgggggtgtagggaccccagaaacaatttgagaggacactgccaccacccaacaagaacagacttagatttaaaaaggaaacttggttcaagacgctgaagcaagaagaaaaaatccagcaggttttgtactagaagcaagaaaagacagatttgacagtgtgaaaatcaaatcaataatggagaggattcacttcagaaatattcccaaatgtgaaatgaataaagacatttagaagagctcagaaatttaagggaggacaaatcacagaattccaatctacaaatcagagatgtccttaaagcataaaatggaatggtggatcacaagcaagattaaaaattttatcttaaaaaatatgctttccaggtctgagaagaaatctaaaattggaggttgagagttcaacatgggcaaggaaaaaattcacaaagtgagacctagaataggaagtttccaggtgaaaatttttaaatttaaataaaaagattcctactgctaaataaacaaaaaagtaacttggtttcttcaaaggaattgaaataatcaggactcagatttcttctctgagtaacaaataccatgagagagtgggatgaggtataaagaacattatgaccctaatattttacacccaaattgattgctactcaagtataggaacagctaaaaggtactatcatgtctgtaaattaaaacaaacaacaaccaaaaaaattttcaaggctaactttaattttttttattaaagctgttcaatgcagcaatttataaaatatagaaaataatacataaacttaaatcatgttattacactttatagagatcatttgtagtggagattttactatgtttattttttgttctacaaataatgtcggaaaacaggcttcaaacatgcttgaactgaaatctgctggcccctccttttgctgtactcaagcagtccctaaagaggaaaaatagacagaaagctcttgacattttctgactcagagaggagcctacgtgacttctgtggcgatgagtcaaattaataaagtttatttcagtgaataaatcccctccttacaacaaaattaatattccacacttaaataatagctatttcacatactttctacatttttgtgtcttcatatactttgtgtggaggattaagctcctggaagattaagagggagctttgaactaaacagtccaagaagaatttttaattagacttgaatatcactggaggctgattgctccttcacattttcctaactacggacagcacctgcatttaaattagaatgaagtagaatgaggtctttctccacttgtctgatctatttgtgtacttgaggtcaacagtgcaaatagtcacgtgtcacttaatgacagatacattctgagaaatgtgttgctaggtgattttgtgttgcaggaacatcatggagtgcacttacacgaacttaacatggcacagcctactgtacacctaggctgtatggtatagcctattaatattaggaaggggaacagagggccctttgctctccggaggccccctctccattcacatccagtttagacaaatacctttcaacctcacaaaatctaagggagaatgatacttgaacataaatcaaagtaaagcatattcctaggctgcaagcctgcacagtatgttacagtcctcaatactgtaggcatttgtaacacaatagtaagtatttgtgtatctaaacatagaagaggcatagtaacaatacggtattatgacattataatcttatgggacctccaccatatatgcagtctgtcatggaccaaaacttccttgtgcagcacatggcagcattctctaatccttaccactttatttttctgaggagtttaatgacccgatcagtaacttcttcaggctgaataggcaggacgatattcctgcctaactattagggtctctttaaattctcaagctactgctcccaacaagatattatttcttaaggcttctcatagaagagcactgtcatttgtgacctatggttcctgttaattttactaaggctgggtcacatgtcccatttccatgcttgctcatagggtggcctctagcactaggaagatttagtctttgggtaccatgaacctttccatatttgccaaacttcatcttcagagctattatgaaatcaatacagtttcaacattgatacaattaatgaaataataccaatattattctgttttgttttgtcttcaataagtcactgccccaagtcagtaggtctcgatcttcactatggggtaaattagcagtttcttccttaataaagattggttaatctaacctagctagaatatatgtgtaacattttttaacaatgagattgcatataaaatatcttcttttctggctcagaggaggggcccacatggaactggaacacagatctctgaggatagtgtgaccctggtgctgatatctctgaggaggcccaatgagactacttctgagagtggggaaaactgcaaactggaaccagtcactgttgcccgtgaaaagcatcactgaggctactcacaatgaaagagaatgaaataggaatcagtgagcatgtcctgtcttcctcctccagcctcccaatctccctctaatgcccctatcgagagtccagcagggaaccagccagcaaagacaaagcgagtttcagaatctccactcaaaccaaggtaaagaagtgttaatcagagagacgatgactgaataaccagctcactcacacagtcaaacaagagcactccacgtgtctgaggcctcacctagcagtaaagcagacaagttgaatagttaagaatcacagtggcattttatgaagaactttcttagcatagctagggggcatggctaatttcacatgtccccaggccttatctagaatcaatgctccaaaataaattgaacaacttttaaaagtcaaagaagcagtttatgaccttaaagcatttaggaaacttaatatctgacctgcataatttagaccaaatatttacatttttgaaaatatttttattttaccaataatctttaaaactgtttttatttcccaaagattacttaagtcatatgaaccaaaagacattacactttttaacttttttgacaaaatatttgatttaagcacttatttttaaaccaattaatctagctattttatattacacacacataattcatataaatacatagacagaagatagaggacttatacccaagccaggaatcaaaccctgaacccagcctgccattgtgaaaagagaacatggccacatggttacaaggtcaagctcccaaggacatacaagacaggaaggaaatctcatccagttttttcaggaacctgcagcaaagtttgtaactgactggtttactgggctgtcttgaaaagcaggcttacaggtaggtgtcttaggcttgtgttctatcctaaagtactcctctgcattatagaacacagaaagacacacaaaacataccaaattcactacagcttaagactagcttcatgaattaattcttccattaatcaaaactttacagaggagataaacagtgatttttaccattcattcaaccagtttgcacagagagagagaggagaaaggattgcctaaggcagggtgaggaaggcactcagggaggccagagaaagacacacccattgcagcgacactgaaaagttcgggcagccgcttgctgatcatgaaggaattttttccagcagtgccatcagctctcaagtttcccctttttaggaaggaaaatgctccccatgccccctgatcctgtacatgcttaaccctgtcacccacagccatcagcaaagagtgcaaagcagattatttccaagagaacagcaattaattcccatagtgctaaattcgttcttagccaaaagggactttaccaagagggactttaccgacaggggcctctaaccccctaaatcttagaagggactctaaccctcataagttgggcctctaacccagttggtcaggcgttcttgccttttattaagagggggctgtaacccactatgtcttaggagagactctaactcctttaaattgggcctctaacccaatcccattctttacccggtatatgcaccccacttacccaaagtccgccagtcagtgctgcagtctatttcctttgcattggagggtctgctcagtatcgtcccttccgtggttcacaagaaagatgttaaaaaaacatcctcagatgttttttaatgattttttcctaaatgaagttcttttaattttcagaccaaccaaacatttttaatataaaaacattttaataatatacaaacagcaatcaaaacggcatccacttggaagcgaaaggactggggcacagatgggggagtggactaaagagggacggttttcagggtcccagttgcttcccttgcctgaaatcactctggtcttagcagagggaagattaaggcatccagaggcagaggggccctgaccctgacccagagacagactaagcacagcaggcccctctaacatcaccttcccaccatgacagcctccagggaaagccagatccagttacaagagaacaggaaggtggctgtgattaacaggaaaggcaaccatcgttcctcagcaacctgttgatcacacctctgggaatagagttttccagtgactgctggattgaagaggatctaagaatcttcctgggagaaggatggaaatgggatctgagtctacatactaaccaagatgccttgcctgtaacaccagaaagctggagtggatctgctcagatgtttgggaagagaaaagaatgacagagcctttggcccagcaaagctggagtgttaacaagcattgactgagaaatcctctaggcaggccagggaggtctgtggcccaccacttacccaaaggtagccattgggttgggggtttccacactatagtcacttccatgatcagcagaaagatgttacaggaccccaccacttacccaaagttagcctttgagtcaggggtttctgtgctatagtcccttctgtggttgccagaaagatgttacaggaaatgggtctggatccagaccccaagagagggttcttgggtcttgtgcaagaaagaattcaaggcaagtccatatagtaaattgaaagcaagtttattaagaaagtaaaagaataaaagaatggctactccatagacagagcagccccaaaggctgctggttggccatttttatggttatttcttgattatatgttaaacaaggagtggattattcctgcctctcctttttagaccatatagggtaacttcctgatgttgccatggctgtaaactgtcatggtgctggtgggagagtagcagtgaggacgaccagaggtcactctcgtcgccatcttggttttggtaggttttagcgggcttctttactgcaacctgtttcatcagcaagatctttataacctgtgtcttgtgctgatctcctatctcatcctgtgacttagaatgccttaaccatctgagaatgcagcccagtaggtctcagcctcattttacccagctcctattcaagatggagttgctctggttcacacgcctctgacaactgcaccagcctttcacctactctgaaggcatacataacaattaaatgtgaacaacattattatcctgataacaaaccaaagacatcacaagaaaaaaacctacggaccaaatcccttatgaaaatagacacaaaaatcttcagcaaaaacactaacaaactgaatacagcaatatataaaaaggattacacaccatgaccaagtaggatttgtcctacctggcattcattcaacatatgaaaatatttcagtttaatactccatattacattgtaaaggaggaaaatgtcacagtcatatcaacagatgcagaaaaagcatttgacaaaattcaactctcttttatgataaaatactcaataaactaggataagaagggaatttcctctatgcaataaagggcatctattaaaaaagaccctacaactaacatatttaatgacgagagactgcaagctttctctctaagatcaggaataagacaagaatgtcttctcagccaactctgttcaacattgtactggaggttctagccagggcaattaggcaagaaaataaaaggcatccaggttagaaacaaagaagttaaatttgtacgtaggaaattctatggaatttttaagaaaactattagagctaattaacaagttcagcaaagttacaggatataagatcaatatataaaaatcagttgtatttctacttactagcaataaacaatctgaaaatgaaatgaaattaagaaagcaatttcctttataatggcatccaaagcaatgaatatttaagaacaaattgaacaaaagaatgcaagatttgcacactaaaaactacaaaacattgttatctggcagagtctttgcctttttgtacccactcacccagcttgggtcctatctccactactttatgttttctgctccaggaggccctaggtgactctgctgcagcctctatcatcctgtgacctgcaggatctcagtaagacggctaactagatgcagccaggaggaacatctgccacctaaggatggtgacatagagaagactggtgcactgagggaaggcactgagagtggatggagggaggacacagatgctgggctgaaggggagagaaagctgggaatcttgcacgggccatcataccttgggactcattcctggcccccaacaactctggggaacaggtgagttgagcaggcaaggcgtgacccacttttgccacagacctctagaatcctggcagcaggagaccccacaaccccaaagacacttgagctggcagggggagctgcttagagaggtagtaagggcaggactccagcctgtgtagagcccagagggtttagtgtgggaatgtctgtggtggagcacagctggggatgcccataccacaaggctcaccatgatctcctaggagattttagccttaggggaactgtccaatttcaacagagcaggatggtcttgccagtgagacaagccagtctgatctgagtgccctcctgtctgctggcctctcctggggccccagcctgcccatgcctgctttcagtgcagccttggataccaaactggcatgcctcctggggacctgcatcatagttccttcaccagcagactgcacctgaccatcagagcactcaagcagagtggcccctgctgatgaatatcagcccaccacaccctccctctgtggcagccttccccatgccactttaccagcacacatttgctcacagccaaccccccaccgctttcccagcacatgtgtgtgtgggcggatctcacctcccctcccccgctgctgcatgtgtgcatgtgaacctcactgtgctactactgcaggcatgagcctacccctgccccagccatgctgccattgccagtgtgaacacaggcacacaggccccacctcccaccccacactgccaccaccactagcacaaacacacacacgtagtggccctcagcctcacagccaccaggaccctaccccagccaacaagcgtgcaccctgctatgctgctgctgctgctgctgctgctgctgctgacacacacaaacacacatggatcctgctgccatcaccctgacaaagtgctttggctggtaccacccatcagagtgtcatgaccagaggccccagaatacctctgtccctctagcatggctggttcctaacctcaaggggccagagaacaaagctgggggcctcattccagcgcccccagagttagagcctgcagcttaggagtgctgagttgagccttggccccctaacatcttccagaaacaaagccagtcaacaggacccatcttataccacaatcaaacccccaaggccatcaatgaagataaaagcaaataaacccgtccaaaggacagcagcttcaaagattgaagaaacatcagcccacacatatgagaaggaatcagcacaagaactctggccactcaaaaagtcagaggtctttttacctccaaatgacaacactagttacccagcaatggttcttaaccaagtgaaatggttgaatgacaaaaacagaatttagaatgtgtataggaacaaagatcattgagattcaggagaaagccaaaacccaatccaaggattctagggaatacaataaaacaatataggagctgaaagacaaaatggccgttttcagaaagaaccatactgatttgatagagccaaaaaactcacttcaagaattttataatacaatcagaagtattaacagcagaattgatgaagctgaagaaagaatctcagagctcaaagactggttatccaaaataactcagacaaaaataaagaaaaaaactaaagaagaatgaacaaaacccctaagaaatatgagattatgtaaagagacaaaatctatgactcactagaatccctgaaagagaaggagagaaagcaagcaacttggaaacatatttcaagctatcatccatgaaaatttccccaacctcactagagaggaccacattcaggaaattcagagacccctgcaagatactagataagatggccatcaccaagaaacatagtcatcagattctctaaggttgaaatgaaagaaaaaagtattaaaggcagctagagagaaggggcaggtcacctacaaagagaaccagctagcagcagactttcagcagaaatcctacaagccagaagagactgggggcctatatttagctttcttttttgttttgttttgttttgtttgtttttaatctcaatagcttaggggtacaagtggtttttggctacatgatgaatgaatgaattgtacagtggatgaattgtatagcggtgaagcctgggcttttagtgtattcatcacctaaatagtgtgtattgtaccagtaggtaattgttcatcctgaaccccttttccactcttttccattctgagtccacaacgttcattataccattctgtatgcctttgtgtacccatagcttagctcccacttacaaatgagaacattctgtatttggttttctgttcaagtttttacttcacttaggataatagactctagttccttcaaagttactgcaaaagacagtatttcattctttttcatgaatgcatagtattctgtggtgtgtggatggatagatagatagatagatagatagatagatagatagatagataccatatatttgtatccacttatcagttagttggcagttaggatgattccatataattgcaattgtgaattatgctgcatacatttagcattcttaaagaaaagagatgccaaccaagagtttcatatccagccgaactaagcttcataagtgaaggagaaataagatccatgtcagacaaacaattgctaaggcaattcattactactagacttgtcttacaagaggtcctgaaggaagtattaaatttgttaaagaaagaccattaccagctgatataatctggatatttgtccccacccaaatgtcatgttgaaatgtaatctccaatcttggtggtagggcctggagggaggtgtttggatcaagtgggtggatcccaaatgaatggcttgggccatgacttggtgacaagtgagctctcactctgagttcacacaagatctggtcatttaaaagtgtgtagcacctcccccagtatcaggggaaccagcccccaatatttcaacgtagattcatttctattttccctaagtgttggccagtctgagaaataaagagaaagagtgcaaagagagaaattttagagctgggcctccaggggtgtcatcacatattgttaggaccatgatgatgaccccaagccacaaaaccagcaagtttttattagggattttaaaaggggagggggtatatgaacagggagtaggtcacaaggatcacatggttcaaagggctataaagatcacaaggcgaaggcaaaattagaattactgatgcgggtctatgtcccgctgtgcacgcattgtcttgataaacatcttaacaggaaacagggtttgagagcagagaaccagtctgactagaatttaccaggctggaatttcccaatcctagtaagcctgagggtactgcaggagaccagggtgtatttcagtccttatcttaaccacataagacagacactctcacagcggccatctatagacctccccccaagaatgcattccttcctcagggtatcaattattaatattccttgctgggaaaagaattcagcgatatttcccctactcgcatgtctgtttataggctcccttcaagaagaaaaatatggctctattctgcccaaccccacaggcagtcagaccttatggttatcttcccttgttccctgaaaatcaccattattctgttctttttcagggtgcactgatttcatattgttcaaacacacatgttctacaatcaatttgtacaatagtggtcctgaggtgacgtacattctcagcttacaaagataacaggattaagagattaaagtaaagacaggcataagaaattataagagtattattagggaagtgataaatgtccatgaaatcttcacaatttatgttcagagattgcagtaaagacaggcataagaaattataaaagtattaattttgggaactgataaatgtccattaaatcttcacattttatgttcttctgcctcggctctagctggtccctctgttcagggtccccgacttcccataacaccccaccattctctcttgcttctgctttcaccatgtgacatccctgtaccccctttaccttctgccatgattgtaagcttcctgagacctccccagaatcagatgttagccccatgcttcctgtgtagcctgcagaaacattagccaattaaacctcttttctttataaattatccagtctcaggtatttctttatagcaatgcaagaatgacctaatacattggccactacaaaaatgcacttaagtacatagaccattgacactattgagcagccacacaaacaaatctgcataataaccagctaacaatgtgataacaagatcaaatccacacatatcaatattaactttgaatgtaaaagggctaaatatcccaattaaaagtcacagagtggcaaattggataaagaagcaacactcaatggtatgctatcttcaagagacttatctcacacgcaatgagacctatcagctcaaagtaaaaagatggagaaaaggtaccaagcaaacagaaaacagaaaaagcagaggttgctatctaatttcagacaaaacagaacttaagccaacaaagatcaaaaaagacaaagaacattacataatggtaaaaagttcaattcaacaagaagacctaactatcctaaatatatatgcatccagcacaggagcactcagattcaaaaagcaaattcttagagacttacaaagaaactgaactcgacacttgaccaaatgaacctaatagacattgacagaactctccaccccaaaacaacagtgtgtacattcttcctacctgtacatggcacatatttgaagtcaaccacacaatcgaccaaaaaacaatcctcaacaaattcaaagaaaccaaaatcacaccaaccacactcttggaccacagcacaaaaaaaatagaaatcaatactaagaaaattgctcaaaaccatacatttgcatggaaattaaataacctgtccccagataacttttggataagcaacaaaattaaggtagaaatcaagaagttctttgaatcaatgagaacaatgatacaacataccagaatctctgagacatagctaaagcaatgttaagagggaagctaatagtactaaacacccacatcaaaaagttagaaagatctcaaattagcaacctgacatcacacttagaggaaatagagaaacacgagtaaaccaaccccaaagctagcagaagacaggaagtaaccaaaatcagagctgaactgaaggaaagtgagtcacaaaaaagatataaaagcccaatgaatccagaagttggttatttgaaagaataaatcatatatatatatatatatatatatataaaaacacattcttagctagattaataaagaaaaaagagaagatccaaaaaacacaatcagaaatgaaaaaggggacattaccagcaaccccacagaaatacaaaaaaccctcagggactactataaacacctctatgcacacaagctagaagacgtagaagaaattaatacattcctggaaacatacaacctcccaacattgaacctggaagaaatcgaatccttgaacagaacaatatgttcctaaattgaatcagtagcaaaaggcctaccaaccagcaaaaagcccagaaccagatggattcacagacaaattctaagagatgtattaatataaagaagacttggtaccattcctactgaaactattccaaaatgttgagtagggacttctccctaactcatactatgaggccagcatcatcctgataccaaaagctggcaaaggcacaacaataaagggaaacttcaggccaacatccttgacaaacatagatgcaaaaatcctcaacaacatactggtaaaccaaatccagcagcacatcaaaaagctaatccaccatgatcaagtaggcttcatacctgggatgtaatgttggttcaatatatgcaaatcaataaatgtgatttatcacataaatagaactaaaaacaaaaaccgcatgatcctctcagtagacgcagaattttgataaaattcagcatcactttatgttaaaaaccctcaacaaactcagcattgaaggaatacctcaaaataatagggaccatctatgacaaacccacagttaacatcatactgaatgggcaaaagcttgaagcattcccctggagaaccagaacaagataaggatgccctctctcaccacttctattcaacatagtactggaagtcctagccaaaacaatcaggcaagagaaagaaataaaagtcatccaaacaggaataaaggaagtcaaactgtttctcttcacagattatatgattctatgcctagaaaaacccatagtctctgccccaaagcactttgatctgataaacaactttagcaaagtttcaggacaaaaaatcaatgtgcaaaaatcagtatcatttctatacaccaacaatttccaagctgagagccaaatcaaggacataatcccattgacaatagccacaaaaagaatgaaatacctatgaatacagctatcctgggaggtgaaagatctctacaaaagaattacaaaacactgctcaaagaaatcagagatgacacaaataaatggaaaaacattccatgcttattaataggaagaatcaatattgttaaaatggccacactacccaaaacaacttacagattcaatgttattcccaacaaactaccaataacatttttcacagaattagaaaaaactattttaaaatccacatagaaccaaaagcttgaatagccaagacaatcctaagcaaaaagattaaagctggaggcatcacattacgccccaactttgaactatactacaaggctacagtaaccaaaacagcatggtgttggtacaaaaacagacacatagacaaatggaaaatacagagtccagaaataaggccacatacctacaaccaacagatctttgacaaagtcgacaaaaacaagcaatgggaaaaatccatttggctagccaattaccctagcatcatttattgcaccatttatttattcaataagttataccggcttaattggctagccatatgcagaagactgaaactgagctgcctcccttacaccctatacaaaaaatcaactcaagatggattaaagacttaaatgcaaaacctaaaactacaaaaaccctgaagataaccttggaaatatcattctcaatataggacccagcaaagacccagcattttcatgacaaaaatgccagaagcaattgcaacaaaaacaaaagttgacaaatgggatctcattaaactaaagagcttctgcccagcaaaagaaactatcagcagaataaagagacaacctacagaatgtgagaaaatatgtgcaaaccacgtacctgacaaagattcaatatccagaatctataaggaatttaaacaaatttacaagcaaaaaacaaagagccccataaaaaagtgggcaaaagatatgaaagtgattacttttcaaaagaagacatacacatgaccaacaggcatatgaaaaaacactcaacattactaatcattagagcaatgcaaatcaaaaccacagtgagacaccatctcacactagtcagaatggctattattaaaaactcaaaaaataaaagatgctggagaggttgcagagaaaagagaatgcttatgcactgctggtgggaatgtaaattagttcagccatcgtggaaatggtttggggatttctcaaagaacttaaaatagaattaccattcaactcagcaatcccattattcggtatatgcccctaaaaatataaatcactctaccacaaagatgcatgcacacatatgttcactggagcactattcacaatagcaaagacatggaatcaatgcaaatgtccatcaatgataggctagataaagaaaatgtcatgtatatacatcatggaatactatgcagccataaaaagaacaagttgatgtcctttgtagcaacatggatggagatggagcccatcatcctaaacaaactaatggaaaaacagaaaaccaaatacctcatgctctcacttttaagtgggaactaaacattgagtacatatggacacaaagaagggaataacagatacctgggtactgtgcttattacctgggtgatgaaataatctgtacaccaaattcctgtggcatgcaatttacctatgtaacaaacctgaacatgtatttctgaacctaaataaaagttactttttaaaaaagaaatatggtaataaaattaaatccttacagtttaaaaatacatatataaaatgcttcatgaatttgcatgtcatctttgcaaaggggcaatgctaatcctctctgtatcattccaattttagtatatgtgctgccaaagtatgaacaggactattaagttgaggttattaggtcatggggatcttcccttatgaatggattaatgctggtattggggaactggattagttattgcaggagtgtgttcctgacaaaaggatggtgatatggtttggctctgtgtccccactcaaatctcatgttgaattgtaatacccaatgttgtgggagagacctggtgggaggtggttggatcatggcagaggatttcccctttgctgttctcatgttggtgagtgagttctcatgaaatacgatggtttaaaagtgtgtggcacttcccctttcactcactctgtctcctgttgccatgcgaagacgtgcttgtttcttcttcacccttctgctacgattttaagtttccggagggctccccagccatgcctcctgttcagcctgcagaaccagagccaattacacctcttttttccataaattacccagtctccagtatgtctttatagcaatgtgacaatgaactaatacagatggatttggttatctcttcctctggataggttggttcctctcaatccttcctctttctgccatgggatgattcagaaagaaggccatgatcagatgtgcccccttagtcttggacttttcacccccaaaactatcagccaaataaatttcttacctttataaattttaaaaagattgttaaaagaaattttttaaataactgaataaatggaaaaacactccttgttcatggattataagacttaatattgcttaaatggcaatattccctaacttgatctacagagtaaatgcatttcctatcaaaattcacttagtgtagagattgacaacatgcactggcattaatataaaaatataaatcaatggaatagaatttatggtctagaaataaacctatacatttatggtcaactaatttttgataggggtaacaagttaattcaatggggaaaggatagtctttcaacagttggtttaggacaactacatgtgaacatgcaaaagagtaaacttagacacctacttcacaacatatataaaattaactcaaagtagatcaaagatctaaatgtaaaagctaaaactataaaactctaggacaaaaaatacaggagtaaatctttgtaaccttgcattaagcaacagtttcttagatatgacacctaaagcaaccaaagaaagaaaaagataaattggacttaatcaaaattaaaaacttttgtgctgcaaaattttaccatcatgagagtaaaaggacaacgcagagaataaaagaaaatatttataagtcgtatatctgataaaggtctggtatccaaaatatgaaaaaactctaacaaaccaacaataaaaagacaaataacctcatttgaaaatgggtttcccaaagaagtatacaagtgaccaataaccatcgttcttgagtcattcctattcaatgaatgtttaaggtaaatgtttaataaccagctctttaaaagatttcctgatttgtagtgactgccaatttctgtggtgtaaatactctcacatggttgatttcaagctagcaacatggcatcactggatgtggagttggaaagagaggcttgcaaacaatttttgtgagccagtgcaagctggctccagcacttcacttcttataataattttaaatttcattttggttatataaactcttcctgatgcccatgtttgttgatttttaattcaggagcattcatgctctattagctaactaatcttacttgttttttgtgactagtccttacttcatagtagcattttgccactgaaagatagtgaagttggctctgcaagtccagattatgaactgagtggggaagagtgagcagtgtactttgtaagcctttcatgtcacttcaggtctttcatgtcacttcaggtccacctgaagtgatgacttaatgcatgttaataagcaggaatcgccactgaacaaactcattttgcattcactattcacagcaatagaaattctcgtaatgtaagtggaatataacataaatttataagtggactttcaaaattgttggttattaactttgacacaactgcaaattggtattcaagttaatggcaaagaccaaaccaaacaaaacaaaaaatagcatatacaatcttcaagtgcactttcagttgtatccaattcaactttaactttactctgtcattttctattgtatcttgatatgaaagcatattagttagatttctccctttcatgagcttttttcttgcttgtcaaaagcattttaaaaaattttcaaacagtatatcatatattaccttgccatcctatattttgattatacttctgttgaaaatatggtaactttagggctgttcacaaatcttcagccacttctcattcctgcccatttctttgcactgccttgcaccctttgcaggtaggtatggccttgggatttgctttggccagtgaattctgagcagaaatacatatcgcttagtgcgaggctttaagaaacatcacagaatgccctgtgtttcctttctctctatggtggttttcgaagtttctatcagtgggatcccaaagtgtctttgatgcgcagagctttagtggcccatttgcatcagaattgaggtataagtgagaagtaaattttcgttggcctagccattgagatagggtgaagagtgagggggaaggttattcttgcagcacaatctagccccgtctaacaagtacaataattaaatcttgttcaaatgtttgataagataatgcccacaatagatttgtttcataggtatgaataaattcataggtatgaaactcacaggaatgatatgagaactatgcatattctttttcattcttagcccaaatatcttggcatttattttacattgtatttatccagagtattctccctgttagtattacctaacaacataccagtaaactgaaaaaaaaaaattctgttctagcctcagggagagattagggagggtacctaataactttagagagaattccatgtgataaatgaaagggagagtatagacaagattacagccagtatagctgggattacagccatgtaccaccacgcccagctaatttttgtatttttagtagagacggggtttcgccatgttggccaggatgttctccaactcctgacctcatgtgatccgcccacctcggcctcccaaagtgctgattacaggcctgagccaccacacccagccaacaagacccaattatacagacatcagctacttacacaataatcagttcaatcatggtacttttaaattatgaaagaattctatcataaacccttagccatttaagttttgtagggggaaaatgccattcattcaacagtaagtgcactattacaaaaaaaaaaaaaaagaaagcaaagttgcttttttttttcgagacagagtctcactccgtcacccaggctggagtgaggtggcaaggtctcggctcgctgcaacctccgcctttttggctcaagcgattctcgtgcctcagcctcctgtgagtagctgggattacaggcgctccccaccacacccgggtaattttttgtgtgtttttagtagagacggggtttcaccacgttggccaggctgggcttgaactcctgacctcaagcattccgcccacctcggcattccaaagtgctgggattacaggtgtgagtcaccacgcccggcctacacaaggttactttttaaagacaaaggtaaacaaaaaattagttttaaaatttccaaagtcagatttttttttttttttttttttgtcctaaaacaaaaccaaccagcaaaacgctcaggtcgcaaccgtttataaatccaaagtcaccaccagagggagcaactcacctggtttatctctgatttcgctcctgtaatttcctaaggcctgattacctgggaggagatctgcggggacagtagtttttagacaccttatgctcagatctcaatattcaaaaattttatccttggaataccttccacactaaaataatttgtgcctaaaataatttcctttttttctttcttaaatagcagctggagtttgcaaagagctcttcccacagaaacccaaggttgccttcctgcctacccgaatcttggtggacatacagggtttatgatctagggaagccccaaggatgtgagattcctctgtaaatgggtcataggacttgttctgattccgttagaattagcaggctggtataacagaaaactgcagtaaaagtggtttaagcaaaagagtagtttgttacctctcacttaaaagttcagtgataggctcctcagggctggcattgaagcatcagggactttggctccttctgtctgtcccaccgtctcagttcatgacttccaaaatgactgctggagctccagtcatcacatttgctttccagcagcaagaaagttttctcctcaccacatccttagcttcaatgggtcttcacctcctctctgggggtgacagggcttgttatccctaccttagtggtttgatgcttttgtttaatagaggataagagtctatttttccactctctttctccatgttttcaccactgagggaccatctctcattgctcaatccaccttcagtctttctcataagcacctggtggaggtccccgggaaagagattaaaagtgactgtgatcattccttttgtgtcctgggatcccagaagtactatacggtcatgctggcctgcacctgacctttaacaatttgttaaagtcttagctgaattgttcttgacacttgtttggtattccatagctcttcctcctttctgtgagacaggtgagctggtgctcatatcccaactctctttggagtggccttggattctagatgatttgggtgccttgcaactgcagctctctaatagggtcaggaaaagttatggctttgcagtttacctggctttgtcttcttgtgcgaatgggagctgcactcatttgagcttcctacatctggtacataaactgaacttcagaggccgtatgtgatgatgtagtggctgagaattttccggaggtttgaaaagtcattaaaccacaaatacagatcatcataaaccaagcaatataagcaaaaaacaaaaatcctcatcgtggcatattgtagagaaattgtagaatacaaagcaaagaggaagcagccaatcatttatgaagaaatttaaatagcagacttgtcaactgaaacaacacaagccagaaggtggtgaaatcatatcaccaaaatgcttaggaaaaatcactgttaaactaaaattgtgtacctgacaaaactctgaatagtgagagttgtattagggttaggttcatctataaagaacagaaaaactccaaataacagggcttaaaactgcttcaagtaaaaatccagaggtgtgttgtctaagaacgaatggggtccgtgctccatgaagttctcagggcctcaggtttcctccagctcaagatgtggttctttttttttttttttccagcttttccagttttatttaaacacaaaacatgaactgtgtactcattgtcttcgctgcacagcttggcattggggttggtgactctgatggccagctgagcagctctttccacaatggctttgtggtccttggaggaaacattgtgagcgatctcagcacagtaagatttgctgcgcatcagcagtacttccagctccttgacgttgtggaccaggaaattccagaagccacttggcagcatgtgctttgtttttttgttgccccataaccaacgttgggcatcaagatctggcccttgaaccttctacgaaccctgttgtcagtacctccgggtttccgccagttaggcttaatttgacgtatgggtcagactggtgccatatgaacttcttggttcgctttttgatgatcttgggcttcacaaggggcctgagggcagccgtgatgccgaggaagagatggctgccacctccataggcagcaccgaggaagagagaggggcaagatgtggttcttctaccaccaaggcaatgttcacaatttaaatacgtcttttcttttaggaaaaacagtggtcctagaagatgaaagtaatttttttctggtaaaataaaaatttggcctatgtcagcaatgtgacatgtttcatgaaatgctattcatctgaagaatccacgtgtctggaagccatgcctcaaagtctagaatgaccaaggcttaaatttacatccagtggtggtgggagtgggaccagggcctcttctctctttttcctttagactgtaggacatctgaaagaatatcaaagcagttgtctactagtcttcccaggcttggagacactgcttcagtcaccatcagttacttctatcattccaaagtgtgcactaagaattcccctctatatgctcctaattgttttgctccatatttcacagctgcccaagcaagtcatgctcagagaccatttgatttcaggagcttctactgctcccgggactgaggactgactgcccagggctttccagagcccccaccaccaagtccattctgagttaagggttaggaatactctgagccattgttgtgattggtcttctcagagagatctctggactgtcaccaggcaccctgaggacacaggagagagtgaccagagtattgatcactggtcataggaagacggatttcctcttattgtccttgttcatggacccctgggctgaaagaaaggaacagagacagagcaggaaagaggaagatcaggaagcaggaacagagtcagaggaaaattgcaggcttgatgggaaggggcaggcttggggggctctagagttattgatttttcagcttgatcaacttttacttgttaggatggagtgacaattttcaagctccttacttgccagactgggagctggaaatcctattgttttttacatgcatttaactttaatcaagttaccataacacctcactgactccaaaataagtttctatctcagcatggcattctttctccacggactgacccacccaccactcaaccttatcacttcttatgcttttctaagaaaatagcatgggacctacaaaagagtaaaaaactgtcaagattttgaagaatgctctatccattccagccttgcagcctcaaacatgcaaaagtcagccacacgtgtttgttctgttgtgtgatttaaccctacatgtagaaatggaaatggaagagaatatgacatgagaaaaccaaaggacatagcagtattatatgttcctaaatgaagctgagtttatgtgtgtgtgtgcaggaatgtgccttcacgtatagctcacaggtatgcatgtgcatttgtgtacctatgtgtgtgcgtgtatgtgggttagcatgcatgtgtatatgtgagtgtgtctgagtattcttacccccaatgctccaaacataacattgattaaagtccacagtgagtgagctgagtttgtggggtcctctgtaaaacagaaggaaaaatccattttcaacgagagagggatgtttgtgagctccccaagaacacgctggtggtcctagggcagcaggatggtaacctccagggttcttgacaacaacggaccagggaagccaataaaggatctgtcagtggtctccagggcctgcaggcagtgcctctggcaggccatgctctctggtcactgggaagatggacccttgagaaggtcacagccatcctctaggctcagctccaccttggtgagtgtcccataaggtcaagccaccctcacgggatagaatatgagctctccaagccaatttccaagacccttgggctctccttttctcaggtacctccagtcccaggagtggtggggggaagcagcagaccccagtattctggcctgggagtcacatagcctctagagagctcaccagagcagagtagtttagcaaaagtcaacttcccattcccttcaggatcagtttgcctattgagaaatgtttctgggaaacctatttaccaagtggaatggtttcatacaaaatactacgggtatagctcttctaaagattttttcaatcccttaggtatctttttctattggatataattttaaggagtgcccacaaatacattttgaactagtttttacttatttttctacttacactaagtacttatccaacttttagtataacatatgcaagttatcagacttcattaacccttgttgagtggtctagccttttttggggttaaaaaaattattttctgggccaggtacagtgagtcatacctgtatcccagcactttgggaggccgaggcaggaggatcacttgagctcaggaatttgaggccagcctgggcaacatagggagactccatctttacaaaaaaaaaattaaaaattagtcaagcaaggtgacacatgcctgtagtcccagctactcaggaggctgaggtgggaggatcagctgaacccagaaagtcaaggctgcagtgaactgtgattgtgccactgcactccagcctgggcaacaaagcaagaccctgtctcaaaaaatatatattattttctgtatgacatggctgtattaaaaataaatgaataaaatgaggaaagaaatatatagattcatttacacttctaccgtagttttcatgacacctaaatcacagtgccattgctgtggagtcccttgcttgcatttataatccaactcggcctcttatgagctgcctgagttgagtgatttacaaagcttctctaagtctccatttctcagttctaagtgtttagtggctccctcattgggtgttttgaagattaaatgaactaaccctttcaaagcacttacagcagagcctggtacacactaaataaatactcaactaattccaatttaggaaatacttattacctactgctatacatcaagcactgttctaggactggggatatgggaatacaaggtaaacgaagaccctgtcctcatagagcttccattctcatggaaggatggagacaaaaaagtgagccatacgtcacatggggacaactgctacagagggaaagggtggtggagagagagaaggtgcacagggtttgtgctacagcaactcagataagctggaactgcatttctgaggatccacttacctctatggctctgtgttgggtttgcaagagaaactttcatgagatttggaaggcagaggtgaagtggcaggtgcgatgttctgaaggttagtgtaggtgctagggtctctcaggtgcattgttgctcaactcaccttgttgacatgggcagcacctgcctgtagctcctcctactcagcctccctgagtcctgcccagcacatgtgcagctttgcagccaagcagcagaaaagacagaaatgaaggcagagaggcagagctacaaggtgctcacaaatacctattttcttctcttcctagacgctcaggtagacccatcttagcccatgcagtgagggcagaagtgatgggcactgttccagacctgttccagacctggcctataaacacacccatgtgccatactttctcttttctcatccactcctggaggcaaagaactctgaagacctggaggtcagcagagccacaggacagaaagcctgggcccctgaatggtcctgcggagtccccatccattagacgagtaagaaatcaacttttactctctgagatttggaactatactgttaaaggagctaagattattttagttaagataggcagaaatcaaataaatagagaaatatatgtgtgaaagagagaagagggagtgaagaagaaacaaaataaaatactgcccttgaaaaaaaaaaaaaagaacaagatatacaaatctgtagaaagactaatcaagagacaagtttaaaagtgcaaagagaaaataaagagaacaggccaggcacattggctcacgcctgtaatcccagcactttgggaggccgaggtgggtggatcacttgaggtcaggaatttgagaccagcctggccaacatggtgaaaccctgtcgctactaaaaacacaaaaaatcagccaggcctggtgatgcatgcctgcaatcccagctactcaggaggctgaggtgggagaattgcttgaacccaagagacaggggaggttacagtgagccaagattgcgccactgcactccagcctaggcaacagagcgagactctgtctcaaaagaaaaaaagaaaagaaaagagaacaaatgagaaatacctgaacacccaaaagagactttcacaataacaatactatgaataatcatacactaataaattgaataacttaaataaaatggatacatttctggaagatataaaatattaaaattggtgttgagattaaaagcttgactagagcaacaacaattcaaaaatcaacatccagtcatataaccatctcagctgctagagaggtgaggggagggcaacttcaggcacagaagaattttcaaggtatagatatttcttaattcatacaatttattccaggaaatagaaaagaggggagaagctgctcatataatttctgtggctagaacaatattaataccaaaaccacacaaggaccaaataagaataatgggttatcagcccatttttatttatgatcatagattctgtaatctaagatcatcgttcagattctcagggaaagatggcagatggaacatacacctttatttctgttcgctcctaaaacccacaaaaatgaacataaagaaatgcaggaaacataggaacgagggaaactagaaggtaaaatagcaagaaaatttggggagctgaaaaaaatatataagtaagtgggaaatgacttagaagtgagaaaacagaacctttcatcagagttgaggaaggcagaagtcaagtcttatttacacaacagtattgccaagatggctgagaaagtggaggtggtttaggggagtccgattaagaagaaatggtagaaagttgtttaagaagcaatgaggaacccagatccccttgccactttctgtagatgagcgaccttgacccaccttggcagacaactgggaatgaatgccttagagaggttgcaaagaaggctgggtttctgtgtgtggtagggaaggggtgggcaataggtataggtgaggatggtgacaatgtcctgaaaaccatgggattatgtgaagaacatgtaccagaagctgagaaacactccagccctcttctcctatttggattccagaaagttggcagccagatcttcttcctccagacaagagatggggtgagtcttccctggggatcctgagcagcccaagagagaaggctgaatgatattgacaaggcacttcctcaagcaaatggccaaggagtcaccctcctgtgaaactcccagggcaccagccccactgtgggctcacagcatccaattatctttagaattttgttacccaggcctgagaaaaagctctcaagtgaaagagaagaaagaaactaaacagagaatagtgaaggcaactgggaagaaacagagaccacctaaggaaccataaataaaaacagaaaactttttctccaagggctgtttccaaaacagagggaggcagagagagaatgagaacaacagagaaatgggagagaaaaaaaaagaaaaagacaactgatccaggaggtgaatgcttgaataaaaggagttctagaaagacagaacatagaaaacagagaggggaaaatcatgcatgaactaattcaagaaattttcctgtgaatttctagatcgaaaaggccactcactgtgcggagcaaagggatggaaatagacacactccaaggctcatccctgtgacattccaggacaccgagaacaaaaagaaaacgctgataaagtgaagacaacagatcacatattgccatagttatcataattgctcctgacttttcaacaacaataggagcaagaaggtaacatagcaatgccttcaaaatcctgaggacaaattgtttccaactcagaattttttatatcagtcaaactgtcatggtaaaacaggcatttttaaatataaaagttgtcaaaatgtattttccattccccctttctcccgtagttactcaaggatgggttccaccagtacaaaggagtaaacaaagatccaagaatcaagaaaacgttgtagaggagacaaagagaagccccagaaacatgaggaagagacagctgtgtaccaactggtggaggcagtgcatccatacagggcaaaaaaaggctgcaggcatgactttttaggaagatgctcaacaaaatacttgctgagaaaaaaaaaaacaaaacttagaaatgctggttccaaaacatgtgcttttgtttgtttgttttttcttgttctgacttttaattcattacaccactgctctccaagaaaaggctatcaattattcccttccaacaatgcataagaatgactttttccctacttctccaggacagaatataattatcatttattttaatcttttttgaactgttaaaaagataaactgaggcacagtaaaattttaaagagttttggtgagttttttttagcatgaacaatttatgaactgagcagctccgaaccagaaatagtttgggagctccactgaggaacacaaagaggagacttttataagacagacacagaagtaaagcaaagtatttaattggttactgttatacaattgctttttttggtctctcaacttggaaagcccctcgttatctaagtttgtataaatagtaacttctgattggttgagcttaagttctgcttttaaaaatatatatatagatatagatatatataggcattcacaagaaatagctcaagttaagtttggttatgtttgcaaatcaagcaaggtttaggtcacttacaaatcataacttcttttgtcccctctgggattcttcaggtctggtctccattttaatttactttaacaatcccaccgctttgggtcaccctctcagcaagctaagaagaaggtggtagcattcctctcagttaccactagtgaaatagtcactggaacaaagagtcatgtaatcttatcctcaacagttgtattgggatataagattacatggcatcattacctgcatcatgggcttcagtggtagggttgttgagttcttcaagtcaattaatgatgatggcaatcatttgatgtgtgagtgccttctggaaagctttgaaatccttgagaggataagatatagtaggatggtaaacaaaatgactacagagagaataatagccaaggatttttaaattccctggagcagagattcccaggagccaatatttcaccaataaaataaatcagtggaggaggcaacacctgtctgataaaagatatatttgttccttaagatcctttaaattgggctcaacaatttctaatttattaatatagaaacaatatttttttttttacaaataagagcctccttgttaagttgctaaggtatcaaggacttctattttggagtactattgaggttaaattgtttatttcagatagtattgcttgaagggaattcaaggtagcattctataaaaacaaaagaaaaaaaaaaggttaacattaggaacaaattatgatcttagtctttaagtccagagagcagcctgtcaagatttctaaatttgagtttgaagcatttttagatgatggaatgaggatggcaattgcaacctgatggattttcctggcttgcagtttgaatgtctctggaaatatcatcaggtgttccagtgaattctccaagtgacccacacagcagcagcatgaaaattttccatacatggtctgttgtagtaatttttctgaatttaaagtcatccaatttcagctggcagggcttcggaaaaaagcagttttagtttctagtgaaactagaaaatgttaggattcaatccaatttacaaggacataacaaagaccagaatttgatgatgggtgctatagttttctattgaaatacaatcttttttatggtcattccaaatttttccaaaaataatcatggttaactcttctttttgtgcaaaatcagtagtctcattaaacttgatctgattatttacataagtgcaacaagaaaagtgattctatgtatgcatatttttaaaatacatcattttgtcaaagttttgataatatccaaggggctttattgactttgtataagtcaatcttagttatttgttcattttattgtttgttttactatttgttaacaaggaatctcagattagacctttaaaaacctctctaggctaggaggccaagttaaggacttacccaattatgtcttgttataagaacagattcttattgaacctatgcaaatacctatattgccatgaaaataagaatattcaataagtgcttccaaattatggggtgatcaggtagggaggaaaaaaacgttttctttttgtttacaaaagtatattttatcaaattgttttaagttatagaaaaaagttttcctaaatctagaaagcaagacattaaagaaccagcaatgtttcaaacgaaaagttataaaaattataattattctcatcagttaatttagtctcacataattaatttttgttttgcttgatcttgggttagcagatttataaatacattacttttccattagaggtctggaaattcttacctagccttatagtatgagcttaaaattatcagaaacctgtactcatcagcctttatcatgaatctcttacaattctgtgtcatgcaactgacaagggagtttggttgctttggtaacatacgacattttaacataataattaaaattatggatgataacattatactagtacatatcagatttctaggaatttgacataatttctggaacactcatcaataacaaacataacttaaagaaggtttagcatcacccattatttgacattgcttctcatgcaatttaacatatcaaataagcctcactagtttaacatgtctgtttttacaagaagagaagataaattcttttgagatattccagggacccttttggacactcccaaagttggtttgaggtcaaaaagacctatatggcatggccagttctaggggtaaggttgtgtccatgccagtgtgtggcatatggcgatgttcagctagcatgagtctgaattaattaccacacataggagccagagtaaagtgttcccaggccatctacccccaaccaatgtccccacttattactgcaacctcttacatcttctataacatgctccaaaaagtacgcacaacagtaatcccccaaatgccaaataccacattatttcacgttgaacagtcttgttagtgcatgagttcgtgtgcagcacacgtggtattgtacacaaattatatttcccttctacactgtaatgaacatggagtgtgatgtaaataaccatggaatactgagttaaagctagaattttatctaaattagacctgagtttgtcgtgcccccaggtgcctgacagaactaaacagtgagaaccccagaaccctttccaatggggaacgtcagaggcaccacagccacggaccctccactctctcctgcactcattgcaccttgactgtcttccttggtgcttgcagacgtttgtcatagtggatttttttaatcagatcgtgaattttgggcaaactttctacagttcgtgggagtaaatgtttgaatggtttgagttcagaccgtgagacagatctgcattttccattctgaagaggttacacatgagctagcagatgggatcgaatttcaattatacggaaacaaggtagaaaagaagggacctcaggcaaaagagtaaaagcaagtttgcaacttagagtttacagtggctggtcacaggagtatctgaccctggaattcccaaacttctccgcaccttagaattacctgaggaatatttttaaaatgccaaagcccaggccacacccggaccaattaaattaggcgcactggggtggaatccggcatctgcatttctgaagctccctagatgatcccagcatgcagaggagtctgagaatgactagtctaatttcatttccacaatatgcttgtgaagcggtcgccactatcccctgtgattcccttaaggttccccccagtgaatttgtggcatcaggagcccagcccagcactccttccgctgcacgtgccgctgtcctggaggacaggaagcagagccagggtgctgcgtacgtggctcttcagagggctcttcagtgtgcctccaagggcgcacagccgagttgagccgtctgattacgctccggggtgatggacaggctgcccctgccccctgctggccagaggctgctattgcagccagcgtgcacacgcgtgcgcgcatcttcagccacctgcagtttctctgattcttccctggtctcctctctgcagtgtcgccagaacaccttcccacactctattctttgtggcccttctgactttctctttgccgtgtgacaggggagtcctccctaaccagcagacagtgaaggtggagtccacgtttctcggcctccacgcatagcgagtctcagaccccgcaaggctgcagacagtgctgtgtaagtgggccttcagtcctgtggggagcccaggttgaatccccaggaatagaagctccagaggaaggtccccaatcagtccgtggtccccaatcctgagaagggttgccttttctgggaggagcctgggtctcatcgctatgcgggaacagggctctgggaggtgtccaggaaatgtgagaccggaagtcgccgtcagggaacggagtagtctgtggccctgttagaggaaacagccctggggggtccccaattgcttctagaatctattctgtttactcttctagggaatacctgtaacttctttccttggaaccaagatttagcacatgagaagaatctggaagaagctgagcccacaagggtcccaggagggcattctacctgcccactgaccgtctcagcatgctacaccctcgagggaactcaggttccctgtctgtaaaatgcagattctctcctatgaaatctctgaggtgaatagctctggataaacttcagtggccttcttttagatgttttttgtttttgttttttgtgggttttttttccccttgggtcttcctgcctggggccctctgccctgggtctcctgcagaggttcccaccagctcaggaaaacactcaagggtgagtgtctcagagctcaataggcctgagttcctttcccaatacctcctaccactccctggacatacacactagcacatacatgcacacatgtgtgtgcaatcaagctaatcagagtggggccttgattgagtcagagctctttgcactcctccacatgtcctctacagtgtagcactaattctgtgtcctccggggtcagggccaggtgcagcaggtgcaacccacattgcaggtgaaacctgtgagtgaaggagcctggtgggggctcttgctgtcatctaggtggaaggagatgaagatcaggcagaggaggccgaaaaagatctggagggtttggtgacaaaggaaaagatctggagggtctgtgacaatggatttgaaagttctttgtcactttcaagttctacacaaatttgggacagacatcatatgattctagcaccattgtctcagatttcatagctgtcaaaattttacaatattctacaagaagcaaataaaattaccttgcatctttaagtttagaatttttctttatattttttttccattttgatcattgttaggtttgagccccagccgaggtccaagggagcaggtggacaggagggcagggagctggaagaatactcaagagacagcaggtagatgagacatggctttattcagcagctcactcacactgtcggtgctgcatttatgcacctcacaaacaatagtggctccaagccaggcgatgagcctctccatgttatggctacatagctgtgtttacattatacaccagactgtgtgcctgtgctacagtcccgctgagtcatgcgggatgtttacctcggcctatgcctatgtggctgcagctcagccatgttccttacaatcatcataagggtttaaagcattgtttggggaaacccaggcaatctttttttttttttttagacaaaatctcactctgtcacccaggctagagtgcagtggtacaatctcagctcactgcaacctctgccttgtgggttcaagtgattctcccgcctcagcctcccaagtagctgggattacaggcatgcaccaccatgcccagctaatttttgtatttttagtagagacggggtttcaccatgttgatcaggctggtctcgaacctctgacctctggtgatccacccgcctcggcctcccaaagtgctgggattacaggtgtgagccactgcgcccagccccaggtaatcattttttgagctgaacttgccctttactttgactctgcaagtgtgctacacttgtagctccttggcaatgaggttgtgaaaacaagtccaacacacacaggataaggatccatcattcttgcatatttagcttaataccaggtgaggctctccactcctctctcatgctcatttccctctccaggctgccatctgctaaggtatgcggtcccctctaggcccaggtcacggagcccgtgcttcacctgctggtgtctcccctcacccagcctccagaccccaccaggccagccgtgactgtcaccacctgatcatcttcactcttagacacaagaaaaaacttccaggttttgcatttcaggagttatgactttgggatctctatcccttgcttaagaaacccatgaatttattttttataatttttaccatgccagtgtgggtgggagagtaaaattccccacctcccaaggacatgtttcaggaaataaggaaacgataccagctattatcagatcctgacatttcactggggccctggcctgatcttggggacaggagacaggtgcacaccagcccaggccttaagtccactcttcttacttcattcaactcctctctttcttctcctccagctcagagaatctttatttggtctagggtgttgagggtaagactagaagagctgtttcggttcgcacacatatgggaaaatttctactcaatgtgttgagctacaatttacttaaatacatatatccatatatcaatcatcattatcaagatacagaatgtttgcattacaccaggaagttctttcacatgcctttacaattaatacacttctcccaaatgtctttcaacacgtgaacagataaacagatagcagcacatcacacgatggtatattactcagcagtaaaaaggaatggtctatgatacaccaacaacatgaattaatctccaaaaccttagaccaagcaaaagatgacacatataaaataatctgcactgtatgattccatgtatatgaaaatttgttacaggcaaagatcttctccagtgttttcgtttgtttgttttgttttgttttgtgtttgtgtgtttgtttgttttgagacgctgtctcgcacagtcgcccaggctggagtgcaatggcgcagctcactgcaacctctgcctcccgggctcatatgatactcttgcctcagcctcctgagtagctgggattacaggcgcacaccaccacaccgggctaattttttgtatttttagtagagatggggtttcactatgttggccaggctggtcttgaacttctgacctcatgatccgcccgcctcagcctctcaaagtgctgggattacaggcttgagccaccatgctcggccatccagtgtttttatctaaaagttttctagtttgaactttcacatttatgactataattcatttagaattaagttttctgtatggataactagttgtcctagcaccacttgttgaaaacactttgcttttgtccgttgaattgctttggtggctttgttaaaaatcagttgcccgtatatgtgtgggtctatttctggactatctaatctgttctatttatttaactgtctgtccttactacagtagcacactgtcttcattactgtaattttatagtaagtcctgaaatcagaggtgagttatccagctttgtacttctttttcccattgttttggctactctgtgccctgtgcatgtaagtttcagagtcctcttgtcaatttcaacaaaaatgcctactaggtttgtgtctgtgacgtaacctagtattgagtttatacatcagtttgacaagaattaacatcttaacaatattgagtctcccagttcaggaacatggtatttctctccatttatttagattttctttaatttatcttatcttcctggtgtaatgcaaacattctatatcttgataatgatgattgatacgtggatatatgtatttaagtaaattgtagctcaaaattaagtagaaattttcttatatgtgtgtgaaccgacagaaacagctcttctagtcttacccttaacaccctagactaaataaagattttaatttaatttatctcatcaatattttatagttttgaatgtataggtcttgcacatattttgttaaattcatccctaagcatttaatggtttaggatgttgttttaggtgtcattttaaaagttttcatttgtctatggtacactgcaattatatagatagtccatttgagttttctatattgaccttgtaccctgaaacactgctaaatttcagtattggctgttatagctttttgtgtagatcgcttaggatttaatgtgtatacaatcatgttgtctatgaataaagacaatgttccttcttctttacaatatgtatgccctttgtttccctttattgccttatcaagtaattaaatctccagaacaatattaaagaaaagtgctgagagagatagccctgccttttctcctaacttagatggaaatgatggggtctttcatcataaaaggtaactctgactataggtattttgcagataccctttattaggaaaaggaagttcctttattttcctagtttgcttatagttctaatttttctaatgttttcctacattttttgatatgaccttatattttgttttctttttaatatcatgaattacactgattgatttttcaaatgttaatccaacctggagttcctgggataaaccccatctggccatgtgtattaccttttttatatactgctaaattcagtacacgaatactgtgttcaggatgttcatgagggacattggtctatcattttcctttcttctaattccttttcctgccttttgtatcaggctgatttgagccttataaaatgaattgagatatgtttctagttttcttaaagagtttaagttcaatattagctttttcttaaatatttatggcattttgtcttgctaaagactatatttctcttgaagttggaggccaagatgacttcactggtaaattctatcaaatatttctatgtctgaaatggttatttttgttataatggattatcgtttattcgaaatgtttaacttaaaattgactatcacattactctatttctgcatagggtttacttttattataagtttattaggttttctttacctgcttattaattttctgtctcctgtctgccttctccatcctaccaaacacccttctctgaatatgaatataagctccaagagtgaaggaaacgtgcccgagctctccatctattccctgtgtctggaatggcagactcaataagcatttgttgaatgaattgtaggaatgaatgaagaaactccttttgttctcttggttttcagctaatatgcttgagttttcggaagctggaagaaacaaggcatggattctcctctagaaccatggggactgtgcagccctgccaacaccttgatcacagacttctggcctccaggctatgataggataaacttctgctaaggcacccagtttgtgatcatttgtcacagtagacttggaaaacgaatacaccaactaattaatatttcgattattatgtaattatagaaatatattaattcataggttttctcatatactttatttttataatttccactagtttttcattcctaaaaatatatagatgcattccttttacaaatatttttctagcagcatatttattaattacatttgatttacattttttcacctttctggatggacattcttactcttcagtatttgttcatgttatatattttatacgtgcacatactaaaatataaatatgttcttgtaaaatatttaacattttatgcatgttttaatttatgctaattacattgatataaatttattaatttatattacaactaaatacatacatatcataaatgaaaattattagaaataataggagagattgttaatttagatatatataagattcatacacaaaaattagttgcatacatatgaacaaacaacaagcaattacaaaatattatttgataaagacaccacttttggtcaccttttaaaccagaatgcaataattatttaaactttggacttgtcccagtacttactaccaccatttgtcggccctttaaaaaaatgtaactaccagtggattgaagtaaatattcaaattatttctttccaagaaggacattagtttctatcatgtgtaacaccatctggttgtcttcacagaggaaggataatagtgagacttaagagccttggatgatgctgctccttgttctctgtagaaattgatttgttgtcttctgatgtttggtgttgcagcagaaagctctgaagccaatgagacttaaaggaaataactttcttttctctcctgtcctgcacatggtaggatttgtcctagataaatgtggcgggtattgctatcgcagaacatctgtttcccctttatctctggacaaacagaagacttgtgcttttcagctccttgatgatctgcttggctaataaaatatgagtggaagtgacagtcgcacttccaggggaacaatttaaggaccagtgctcaaatttccagcactctcttccccttccgtgacaatcaggcaagcaggcattgatgtgcaagtccataaaagcaatgcacctcaaatcctgagccaacccacagaggacaggacctctaccctagagagtcatccagtcatgtggtgggcttcccaggactcagggaaaaactttatgtgaactcactgaatggggattgtttattattcagatggcctgtgctggaagacacaatttgcatctcaaattagtaagagcttcacatatgtcatccttcatttcagaaaatcttccttccattaagcctatatttgttgcttgtgtttacattcttccggccactccttcagaaacacccttacatataggctgcctctccattctttatcatcttacctctctagggtcagcaaactttttctgtaaagggcaaaacagtgaatacgtcatcgcctctgccactgtggcatggcgcctttcacagagtacacggaatgaagaagcatgtctacaataaaactttatttacaaaatcagatgtcaggctggatttggctccagggctatagtttaccgaaccctgctgtaaaaggaggaaatcaacaaagagagcgttagatatgggatcaggagagagcactttcaacacgggataaaagctatgggagttatcaaggagatggcgaaggggtatctcagaaagggatatttcagctgtgctgaaagcatagaggaaaattagtccagattgcggcgggaagacattagaccacatggggctgtgctggaggaataaaaccagtcaagaactgatatgtatgaatatgttgacacaaaatttacattgttgatgtagagtttggaaaggaatgaatgatggcacataaaatataaagcaaattttataaataaggcaattaataatttcacagaaataaaaagtagtatcaaaaagaaaatgtaatcataataaaccacatgactagggctaagaaaaatatttacattgtcatgaaatataaaatctaagtattaattgtactggtaaatgtatctgactgcattgggaggctaaaggtagggggaaaggcacaggtgtgagtggcatgaaagaggaacaagcctcacctcccgtattatgtgtctaatggagaatagctaaagctgtaaaacaaacaagtatcaacataaggatacaaatgaaaaatactttaaattgcctccaagaaaagggaattgggatgtagtgttgaagcatagaactgctgcatttttgttagtatgcacttacagcatacaatttttgaagatgtgtatctgcattattttgatgagatgttaatacttgaaagaatactgcaacgatggccaatatacacttttttaattcctagattagaatttcttagtcagagttgatttcttttctaaaatgggttttgattcatctcgccacactgtctttcagaaaggtggtgtcaattgcttttacccagcagaataagcaatcaccttttccctaaaatctcccaactctggttatcatcatttatttcaacttttgtcaatctgatgagaagagtggttttgcacttattttaataatatccgttttgaatacaatttaacattttcattaatatttcttctacagaaaagtgcctgttcctagactcatcccctttttcaattgaaatgttcattttctcttattgtttaaaggacttgcttgtctttatatgaaatttaataaccctttatatgtcaaatagggagaaaacattcacagttgtgatttgtttttaaatttcacttattgtattattctataacatccaagttttagtttgcatgtagtatgatctattatttttccctgtatagtttgtggcattgggatcataaagagaaagctctattccaccaaaaaattagataaattttacttttcttttctttcagatcttctgtgtactgctattttatgtatacatatgtataatcaaaagtcaagcaaacttgattttgtgggtgttgattattaatgacagacattaattggggagatagcatataaaaggtacttctataaatgttgtgaagtgtttactcatttattcccagaacaattatattaggggttcactaatacccattcaagaaagaaggaaactgagacttttagaggtttagcagtttgcttaaaaatgtcagagccccaaagaggcagagcaggaacccaaacagggtgtgtatctcaagagtccaaggtctttacaacactagtttgtgagttagatgccttgaaatctacaactcagggtgtgcacgtgtggggctgatattccactaaagaacagaccgtcctcttctgctgtgaggacaatttcaggaaccagaagaaatacgagtctgacatgtcccacttgctgcctagatcttatttttcaattgtcgagacccctttaaggataaatcacattaaagatattgtagttctcttaatagatctatacagtgctgaaacaaatatttttacaataaaaataagctagaattcttttacttttagcaatagtaactcatgtctattacgcaccaagcttttacatacaatatctcgtgtgatgctcacaaggattctgtgggacagatgctgtgtctccatattgcaaatgatgggattgagattcacttcagcctgcgtcctaggtgcactcctaatggctctgggtagatgggctggatgaattggcctaagatgaatgtaccttgccacacaggcactggtctgccctggagtccccatgacaaatgcttggaggcagcccctaccttggatcccacaaacagcaatgacaagggccgctggaaagcacaggatgcgtctgaaggcagctggacaagcccagactcaggtcagtggccctagagggtcttggggaaatgtccccaggggctgaacagagcctggcaatgacccttctgctccactgtgggaccctttctgcagacttgcctgcagccccaggaccttggctgtgccagaacccaacagactgttgatcactcctttactagctcccctagcagtcttcagcagctcttctcctgcccacattgcctagtggcaagtttgtttaattaccctctctgcaggctcatctcctgtatattgtgttctcacttattcccttacactttcatttccaagtgtattgcctcagagtctttcggagaagccccttaccttaggcacaggaaagccatggttcatgacctgtcctggggccaccacccacatgccccaccaatgttggccccaggatccaaagtcactgggtcctctgctttgcccatttttttcattccacctccctttttggccaggcacagtggctcacgcctgtaatctcagcactttgggaggccaagcgggcagaacacttgaagtcaggagttcaagaccagtctggccaacatggtaaaaccccgtctctaccaaaaatacaaaaattagccaggtgtggtggcaggcgcctgtaatcccagcttctcaggaggctgaagcaggagaatcatttgaacccaggaggcggaggttgcggtgaaccgagattgtgtcactgaactcccacctgggcgacagagcaagattccatctcaaaaaataaaaataaaacgctttttaatacaatatttcaaatattatattcattacacaatcaacatatatatgtatatatatataaagactttttattaaaaacaaacattgcagatgttggtcgaagtgtacaaagtttcagttagacaggatgaataagttctggagatctattatacagcgtgatgactacagttaataataatatattgtgtacttgtaaagtactaagagagggccaggcacggtggctcacacctgtaatcccagcactttgggaggctgaggcgggcagatcatgaggtcaggagatcgagaccctcccggctaacacagtgaaaccccgtttctactaaaaatacaaaaacaaaactgctaaaaatacaaaaacaaaattagccaggcatggtggcaggccctgtagtccgagctactcaggaggctgaggcgggagaatggtgtgaacccgggaggcagagcttgcagtgagctgagatcacgccactgcactccagcctgagcgatagagcgagactccgtctcaaacaaaaaaaaaaaaggactaagagagtagatcttaaatgtttacaccacaaaaaaagataagtatgtgaggtgatggatatgttaaatcagcgtgatttaatcattccaccatgtatacatatatccaagcatcttgtaatacactaaaaatatacaatttttattggtcagttataccttactaaagctgggtaaagaaacaaatattgcaacagactacagataaagttcccttcaccacttcttccccaacattcatcatagttattgccgcaaaagactgctattattagtttgatgtatagcttttcacaaacagaaaatttctgtttgtacagataagaggtttatgtgcacagacaaaccattttgagttcagtttactgtatataagtgggattataccatacatgtcattctgcagcaattattaaatttaacaagatgtttggagatctagctacgtttgcacacaagctgtattcttttttaacctttacatggtgctgtatagaagacgtggaccagaagttatgttattaattcccctgtggagatcattattataaacaatcagtgatgagcgtctttgtaaatctccttttgtgcctgtgtgtgtgtatttctcaaggatgggtgaatccttgaaatggaattgacaagtcaaggaatgcacatattaaacatcttagatccttattatttgcattcagaaatgctgaacagtttctattcccactttgaacataacacccacttctccacacccttgccaagagagtaggacaagcttttaaaatatttgtcaaattaatgaataaatattgcaatttgttttaatctgtaaatatctgatgaataaggagataagacattcttgcaaatatctctgagaatgtttatttcaattattgaaagttgctcatccatttcatgaattattgacattaattctaaattcaggtgttctgtgtgcttgtattgatggtttaccttcatgctattaatttttctcaaatgtttgagatacttgattgtcaaatagtattaatgcatagatgaattgagggaatattctcatgttggtattttgagctgttgaggcttctacttctgacattctaatttttcttattttgtttttaaccctcagaaatcaaacgtatcggtggccacttttcttgtttaacttggatttatcttttttttatttatttattttcttccatttacaaagatagggggctggaagagagaatgccagggggtccagtgggccacaccgaccctttcttccctccatgttccccgttagaatctaagcacagaaggaagaaggcctacttttccagacagtagggccttctcttggcttgcagaagtgcatttgaaatggaggtggcagagatgggataccacaccgggccaggccttgtggaacctgcaatgcattccctgcagagtgatctccagtaggcttcggagagagtaagggctggggccctgtcaagatgctgcacagggagaattcccccaggagctgtccacaggagcccctgagaaggtggaggctgaagggaggagtcagctaagggcagatgtgcagatacgtgtttgagctgggcagcctgaacttggcagaacagagcggggacagaggggagccggagctggccgtggtggtgactgagtgatttagggaaattaaagcaagaggggagatcatggaggaggaagattctcaggttgggcaaagaggctgaactgggtttggtctcccctgtttggggcgttggatcagatgcacagggagtgttccagaggggctggggacagcaatgtgggagggtcccaccacagcagggatttaggtactggtaggtgtcttctgcaggcactggatggccccttccttactcattatctcagctgtcccagagtggcaagagctgagcatcgcccctcggcctgtgctgagctgaagccttcagagacctccatagctgctgcccccagggtgttcgtgaagtgtgtgcaccgcctggccctgctcctctccaggactgcccttctccagctctgtcaccccctaacttggggctggtttctatggagcagagtggtctgctgaaggagggagtgctgaaggagggagtaagtgtctgtgtgagtgtgggtgcacttgggtgagggcctgagagtttaaaggcaaggatcttgattggcctgtaataagcaaatgagcaaacagagatgacggccaaaggatattgaaatcgatgttaaacataattttctaaccctacccctgatttttgtctcatcttctgaggctgaccacctttaccagcacagctgtccccactgtgctccatttcgctcctcctctctggccccaggccaaacccagccatactccccctgctccagcctgcagctcgggagcacatgaagggctgacagcaccaggcagcacagagaccggggccctgggggcggctgaacggggtgagggggttggaggatggggttggttccatggagtaaggaaggagaagaagcagggagaacccagctggggagatggctgcttcctgcactccctgagcccaggcctcccgcagggtgcttagggtggaagcctggttctgtgcctgacccaccctgaacttcctgtgagggagctgtgcgcccagactgcagccttgtgtgggcagtagctcaggtccctctgacctctctggcagggaaaaagctgctctgagaccagatgctttgaacctggcatcctgggaccaggaagggccattgttatgggaccattgtcatgggagcaggaataaccctgtcagggcaattgatgactgaaggatcctgctggagctggggcagagagccattggggtcagaggtataagcagacttgttggggttcagggagaagactccttggatctgcaaaaggcaagcctggatgaagagtaaggaagtgcccatggagaatctctgagcccaggaggagcaccaggtcaggagagaggaggcctgggtgctagtcctggtttggccctgaaatagctgagtgactgtggaaaggctacttgccttctctggacctcatctccctcagttgtgaaatcagcactgagagaaattcccttttgtccctgctacttctggttctatcatgggggaaatttacagctaccccttcacccctgcccagcctagcttagccctgtgctgcgttttggggatcacctccagacctctacggctccctgctttccccatttctgcatcagaggccagccctcccttcccatggacctacccaggctcggagccactgttgcaggctagactgggccttgctagaaaagcaagtacatgaagtctccagctctcccagctccttctctgggttcctgtgagtgtgtgtgacaatgagtttgggagaggaggttgctgaggttcccaagttctctgagggaccttctcagagggtgggcagggaacccagaatcccccagaaccccaggctctttgacaggactttgctgtgccctgctctgatcgtgccaagggggaggcactatccctagctcttcaagagacttctgaaagggccccagatcccaccacagctacctgccccagtccctcctgcagaaattcaacttgtgacaagggctgttgtgggtccccagggagcagggccagtcccagcctggatgaggggctgcctaagcccaggcttccctgcccccaggtcccagatgccagaggaagctgagcgtgcagatggttccagcaggggcctccccctagggtgctcaaggccccaagtctatgtggagggtgcccaccccactcacacaggtggggaagccacaacacagagagaggggcagattccccgctttgagagctcctgtcccctggggagagacgacacactctgacacagcagagaacgatacagagctggctgcaggctgaagagacacacagctagtggcacatagcaaggggtgctcttgtaagctacaagaaggagctgtcacttagagtcagcaggggtcagagaaggggaaagtcagcatgggaacacagttgctgacacacacacacacacacacacacacacacacacacggtgacgtgcctcggtgccatctgaggacagggccgccttcctccccctcgggaggatgcccccaccctgatttggtatgtaattatgttcagggagaagctgggccccactgtcggcgaggaaaccccctaaaagctcacctccgcctgtgtgtgcaattcagtgggagcctctttctcacccctggtttcctgtcatgtctgtgggtcgcatttcaaccagaccagccggaaggctccagaccgaagtcaggaggcctgttctggtcctgtgtgactctgagcaggtggctgaccatatctgggcctcagttctcacatctgtgaaaaagagaagtaatgtctccctcgcgaacctgctgagggtcttgagaaagtgtgcatgagaatgctttgtaaataatgcttgtgtgagtgagtggcgggcatcgctccctgagctgtcttctagctctggagctccagcctgctttcccaccttgggcccttgggcgccaacatctgatagccctactgtgtcctccttttgcatacccctctgcctttcccattctcagtctctgcatactcctactgtaaggagaagggcagtgtactgagatggagtggagagcaggagtccaggggcaggcaaagcagtggacttggaatcgagtccacttgacaagttccaattcccgtctcagttattacctctgttcacagagctcccggcagcagatcgccagtccagcagagcccccagtggtgcaactgcaattacacacagtgtctctaccagtcctaagatatattagctcgttctctttgtaaattgcatcgtattttaaaactgaatcttcaaagtgctgacattaactaaagaaaaatatgctagagtctttcatctgtttatgttttaattaaacaatatttctccagggtccttaagtggcagaggtccaggatgcagagatgaggccaggtcctggttcctgggctccctctaccccaccccactgatgcatcccatgctccgtgtgctcttcccaccctcccctccccgacctttgccagggaccctccctagcctcccttgctggttttgaatctccacctcctctcccctctcctttcccgcacccacgaaactcccagagtggaagcacatcactgacccaccatggaggcctgggcatgacgtccctggccatcctgtgaccagtgaggcttggggcttgtgatcagggttccaagtgcccctgagtttgtcatccaccctcagcctgcctttccctggaaagggcggcaaagctagggccctgcaaagaagagaggcagcacacagagggagcaagggggaagcagtccataactcgcccacagtttcctcctggccttttcagctcctccctcaggggtaggtcatggtggggaggggcagctgggcacaggggagagcaggcatcttctacagaggcctgggaagctgtgtgccagacagcgccgagcccaccagacccagactcacctacagctggagatccccacttccctgtgcccacagaatctgccctttgcagtctcccatctccccaacccaggcctcagcctgtctcatttttctatcagacgtgctggaagagcagcagaatcaggcccagctcccaattccctctccccagtcttctccaggtgtcccctcccatgagcgcacaggaaaaggaccacatggcctggcgagccctacacccactgctactgctgctgctgctgttcccaggtgagggggaggaggagcccagggagcagaggagatgggtgtggtggggactgtcaggacagcagggtcagggagcaggtggctctgtggccagaggcctgctgtgaggcaggttgtgcgcgtggccttgacctatgcgttacttcatcattctccaggctctcaggcacaatccaaggctcaggtacttcaaagtgtggcagggcagacgctaaccgtgagatgccagtacccgcccacgggcagtctctacgagaagaaaggctggtgtaaggaggcttcagcacttgtgtgcatcaggttagtcaccagctccaagcccaggacgatggcttggacctctcgattcacaatctgggacgaccctgatgctggcttcttcactgtcaccatgactgatctgagagaggaagactcaggacattactggtgtagaatctaccgcccttctgacaactctgtctctaagtccgtcagattctatctggtggtatctccaggtgagctctttccctagggtcctcagaggggtgcccctcacccccttttggtgcctccatcacccctggtttcccaatcgtggaagccacccatgcccacgccccagtctcctgggaaggctgttgggaacaggtgcagggggaactcatatgtgcacaagagcagccatctcacagtctgcatgactcccaagcctgcagcctgggcctcctgagagatgctgaaacagacccggtgagcatgctgaccagtcagcctatatgaccctgctacaggagggcaggaccacccggcatctttggtacatagtaggtgcccaggaaaggtgcatccactggctgcccccaccatgtagagccagtggtatctgggtagtctagataccaagatactatgggtatccctcatagtccagatcggggactaagaatgagtgaaaaaaactaagaatgagtgaaaaaaaatcaaaagaaaaacaatattttgtgacatacaggaaattcaaatttcagtgcctataagtggagttattttttggaacacagccatgcccactcaattacctattgtctgtggcccttttcatgctgtgacagcaaaattgagcagctgtgacagagaccacatggctcatccctgaccctttacagaaagtgtgccaaactcctgctcagagcagagctacccacagttcctgtggaagaggaccttctaaaaaaaaatctgcaattcacatgagtaattttttttgtaaaatacagtaaaaaaaaattactagaaaaataagaaaaagatatataaagtacaagcccaacatttattaaatttgacaaacataaaattacattttaatgaatacaatcagaacaaatatcacatagggaaaaatttataaaaactgtatacattgttcatttgaaagtgtgcctaaaggtgattgatgtagtggcttaacggtatacccataacgttttgtcattcctcagttaaaactaagtacaaagctagaagggaaattgcagttctccatattaaatgccaatatgcacccttcaaacaaacaccctgtctttccgtttttaaggattataatgtgacaaatgagcacttttcttacttggtaactttcctaatctgagaactatttatgacaccacatcacttaggagataatgtataaagaaattgtgttgattttttttaaaataatactcacagtagaagcccagaaaactggtctcacggaggtataatgtcagaaatagaagaaattttaaagcaattccgacaagctcaacagttttatatttaacttttacaaaaggaagcaagcgatgctgtaatttcaaaatgcatcttcaatcctttatcagtagccagttccaaaactttatcctaaaacttatagtttaaattatctttcgatgggaaaatatggattctagatctatgaatttcctctgcatatatcttcttctgacaaaaaaacgaaattcaaaacatgctatcaaattattaatgttttcccatgagcacttgtgaagatatgcaatatcaatattatcacttattttgttgataaatgttattaaattaagaacatgtcataacaattcatagaaatggttcttctgacttttatgtttgcacttagactttacttgccattgaaaaacatgtcgctttacttccttgcatggaaatattaacttcagaactacagtataaacaagtctgatggtacaattcacatttgtactaaactggcttcttgtcttaattaggaattcttcctatagatgaaacatgctcaacaaaactttaaatttggcatgcaacagtagctgtttatgatctgtttccatattaccacataataaagagaatgatttcaaatttaatatattcaccttataaaattcacaattctgtccatgttggtcagcacaacgttcagttaagctgcttttttttcatagtaaaactctctcaatgaaggaagcagtgcattaatttaaaatctagcccaagacttcttaacctggatgacattttcctgtcattgcaactgcagccatcagaacatactcttacataaaacttaaccccaaaccacattttgataatataaccttcatagttttatacattcagagctagttgtgtttgtgacaattaagctaaaagatacagaattccttcatatcattgtgttcaaattgcatatactaaaagaatagctatgttagcaatatttgtacattttttcaaattgccatgaaaaatactttgctagctttatttgttctaggagatggtcatccatcttgttatccaattcctgaatatgttgacctaaggcgtcaagggaaaatgatatcaagctcccttctttgctataaattacccaatgtcgtaaagcaaacgttgttcagtaatgttttggcaattgtagatggattgttggtctttgcagtacaaaatgttactttacaagaagccacaaagtctagagcttatatgtgaagtatggattcctttcaagagcttttcaatccaatactcttttttctcctaaaaacagtttgttgtgaacttgtgtttttccgttttatatgtatatgccacttgtttttttgttttgttttatttcgttttgaggcggagtctcgctctgtctggagtgcagtggtgcaatctcggctcactgcaacctccacctccagggttcaagcgattctcctgcctcagcctccggtgtagctgggactacaggcgcctgccaccacacccggctaatttttgtatttttagtagagatggggtttcaccatattggtcagcctggtcttgaactcgtgacctcaggtgatccgcctgactcggcctcccaaagtgctgggattacaggcttgagccaccatgcccagactatgccacttgtttttgttgttgttgttattgttgttgttttgagacagagtctcactcagtcacccaggctgcagtgcagtggtgtgatctcggctcactgcaagctccgcctcctgggttcacaccttctcctgcctcagcctcccaagtagctgggactacaggtgcccgccaccatgcccggctaatttttttatatttttactagagatggggtttcaccatgttagccaggatggtctcgatctcctgacctcatgatccgccctcctcggcctcccaaagtgctgggattacaggcgtgagccactgcacctgacccaactcaaggtcttcaaccttaatcacatctgcaaatttccctttgccatggaaggcaatgtcctcacaggtacctgggattagggagtagacattttggggtacccgtattctgcctaccacaatgagagattctactttcaaacaaaaccagcacaaactctttggaataactgcagaaggaaaaaatttatttagaatcagttctaccatcttcatctggcttactgtcactgccacattcaggaaagatgttttttttcagtgatttttgttttgctatctgttcattagaatgctaattaggtaatcactattctactctaacttagctaatcatgttacactctaaattttgtttaaaaaaagtttgattaaaaattaaaatgattgtaaaaataataaatcataaaattatacatctttcgagatgtttatacacttttgggctatagctaacaactttatttatttatttatttatttatttattgtgagacagagtctcactctgtcacccaggctggagtgcggtggcgcgatctcggctcactgcaacctccacctcccaggttcaacccattcccatgcctcagcctcccaagtagctgggattacaggcgcctgctaccacgcctggctaattttttgtattttagtagagacatggtctcaccatgttggccaggctggtctcaaactcctgacctcaagtgatccacctgcctcggcctccaaaactgccgggattacaggcgtgagccaccacgcctggccgctaacaagtaattttaaagtatcacacattgtaacatggctctggcataggttactagcacacagctcactccatattcgaccctccatgctaatttgacaacacccaagctggtctatatcctgttcaatgagatgagacgagttaactaatcacgggcttggatcttgaggcagtatcaaattgatataaacgttttgaaacccctactcccaatttttatacttcccttgttgtggaagggttacagacaatttgtagaccagcaccaggccatagatgacacattcaatagcacatgtctaggattttaccagagtgtcccaaacacctctcccaggctgagcacagggttatcctggccagcatcctagacagcctcagagagtgttctatgggacaggatcgtgcccacaggtccataggcctgtgactctctccagggaggaccttccagggcagtctctgggacgaggaatgactcagcctcaggcaccctctcctccaggcccctcccagccctttccccttctttccccttctccccacctcctggactccagttaggtatgtagacctagtctgctaggtcgagacactgataatccccacttcctctcccagccttggttccaaccctactttcttttccttcgccaccccaccacccgccaacagccaatgccttttcgacctcaacagtccccatcacttttccagagacagccattccccacctccaccaagggctctaagcacaggtgggtctggatcttcctgggaaggtgaacagcaggagtggtgcgcagccggttcacagagtcccagagtcaagaggggctgtgaaaggcattccctaggctgctgagacttggggtccagggctgtgcagcagaactgggaggggcagggatctgaaaactacccttcaaattccccacaagaggctcccttcccaagtcccagaggcatgagaaagagaatggagggcagagagccgaaggggcccgaagcatcatggccatgtccacccttaggaggctcggatgggtgcccatccaaagactcgagtgcctcctgagtcctcttccagtgctcctcctagactcaaggatacaactgcaggggcccagtagagcccaggccacaggtgtgtctaattctgagccagaggacttcacagttcagtccccacccctcaaattagttttcttctctgggcgcatgggctctgttcccagtctggtccaactcccccatccagctctcctgccggcaggcacaagtgaggtctcccactcactaaccacgctctttctcctccctggcagcctctgcctccacacagaccccctggactccccgcgacctggtctcttcacagacccagacccagagctgtgtgcctcccactgcaggagccagacaagcccctgagtctccatctaccatccctgtcccttcacagtgagtttcggggtgcccgtagccacacagccctgggcgggggctggcagatggagacttgcctccccagcccgtcctctccccttcctgtccctctgccttccaggccacagaactccacgctccgccctggccctgcagcccccattgccctggtgcctgtgttctgtggactcctcgtagccaagagcctggtgctgtcagccctgctcgtctggtggtgagtgtggtgtgggttgaactcggggaaaatggaacagggaacagcttctgcccaggatagagggtcagaggggaatcggccagagaacagaggtggaaattataatcggcagagctctccaaattaaagccctcatggagtccatccatctgacatgtcacacaggctcacctttgtccttcagctgcaaacttgcaggaatctcatccatgtttctctgtctctgtgttttctcctctctctctccctctctctctctttcttccccctgctcccttttcctccctttctctctccattcctccccctccctctttcccattccacccccttcctctctccctgtctctctacccctccctcctctcctcttcttccctctacctttctccttctctccttccctctcccctgtccttccactcccccatccctccatcagaaacacagacctacacagctggaaagtccctcccactacctgcccttccaggcaagcccaagtccagggactccctaaagccaccatcccaggactctgcctcattctagtcctgagggagagagggtagacacaggagggaaacagcccccagggagaaggggacacatgggaaaaaaccataggtggggctgagtgaaaggtgcagggacaactcagtcaggccaggagccggcttgctggaggaggggcaggcttggggaaagggacagggtgtgagaacggattcaagtcacttcatgtatttctcccctcatctcaagggttttaaggaatcggcacatgcagcatcaagggaggtctctgctgcacccagctcagcccaggccccaggcccatagacacttcccactgagccacagggcaccaggtgggcggccagtctccaacaaggctgggctcccagcagctcctccctgacttctgacctctgctgttatccgcaaagaaaaggccaggacttgatccaaggcctttagccacgctctccctgcagagctgcagaacccaggccctctacttgctcaccctcagtttgcactgcggccagcaccccgttgtgggagcaaagcccagcgcctgcagcatctttctaccaaacctgagtcactgatgacattccctcttccctgcctcctcctcctatctatagcccctgataaaagaaaaacgtgaggcctggaacgctggtggctgacacctgtaataccaccactgtgggaggccaaggctaaaggatggcttgaagccaagagttcccagttgcagtgagccatgatcacgccactgcactccagcctgagccacggagtgagaccttgtctctaaaacagaaaagaagaaaagaaacactttagacaaaataaatttaacagagtttatctgagcaaagaacgatttgcaaattgggcagccctcagaaccagaagaggtttagagaactctgctctgcaacctgggcagttgtagagagaaaaaaagactgaagaaagcggaaacaaggaacaaaaagaaattggtcatttcaaagttaccttcttggtaaaaggttaaagcagaggggatttccctaccataccggctaaaactgacctgttcagggatttggctgttacctctctctcctaatttctcggaaggtgagataaacaacttggttttggcttggtggtgtggaaccttagcaccagtgaccccattttggtttgggctgttgggcctagtgcaggagctcagtctaaatcaatggcctcttattactctgatttaacaccccaaatccagacgcctgggtcaccccaacgtttccctctccctctgcccttgctcagccacactctgccaaggcctctcctattgtgcctcctccccctttccaagccccttcacctcacactggcactcggaccactgtgtcagccacctaacagggggtcctgtcttcagtccccgcctcctagattgttcccctgatatgtcccttcccaacaatacctctgtgcatttctgccacccaggaattgaagtccagtgtcgttactggggtcccaataatgctttgcctagatcagccacccctgtagcacagcaccccactgtgctgtccttaccaccaccaacatggctgcagcctccacaaggaagtgaacctttcttttttcctgcacaagctggtcaagaggcgcctcaactcgccacattcaagatcactccgtgccttgccccaggcctgtcacccccacagtgctgttgtctctttctgacgcttacaatcccgatgttggacctaccagactgagactgacgtgattatcttttctctcctgtttgtcatctatttttctttattcctactttctgagaaagttccccaaggttacattctattcaaatgttttcaatgtacacgatcacatttttcatttctaaacggtccatttgttctccgaatgttcctttttatagcacagcatgttttattttggcaagccacattttctctggaaatattaaagttttaacttttgaacttttccgaagctttccatattttctatgtcctccaagtgcccatcatatcttttattttctcctttcattgacctctgtctttcttcagagctttctggaaacctttgccgcttctcggccacccacttgcttagaagccccatgcgggccgcggggtgctgtgggctccaggcggattgggcgggagtatggctccattttttctctttcacagctctgtttctctagaaaggactcttagctgtccttcctgggagtgtaagtctagacccagggttctaggcaccaactggaacagagcaaaggggtctcgctgcccaatgtctgttcccacccaggcccccactgcacactctctctctgtggcgccctgtgccctgagcagagcatctctgtgtcaccctcatcagagacttacctcaagctctctgcagctgttgagagagaggaaagacagaggatgtgggcagctaacctactctcagtctcacggaagccagagaatctaggagtctaagtgattcttaaagttccaacctgttctctggtttccagcacccacttcaaccctgccttaagagatacctgcacctcccatttctccaactttctggggttccaaggtaaaaatgacttccctcttattcccccactcccaccagctctctctgatctgtgaagtcatctgattttacccaccttcaaaacatgtatggagctctctgtttatctttgaggatgggtttatgccatttttatccagttattgctgctttcaccttcttggcaagagtgaggagggaccccagattttccatcaaaacacccctccccagcacccgccaccaagggcaggagcaagtgagatcccaggtctccacttgctcctgtaaagactcctggccccctccccttcccccaaggtcagcactcagactccagtacagcctcttggtgccttattatatccctgttcactctagttgccataagatgcccaggatgccctggtcctccctcatcacccagaatcccaactcagtaagaccttgaaaatccatgacattagccccaattcccactcgtcccaaatcccataacctttccaccctgcacctgaagtgcgcagtcatcagcacaagctcctgtatgctcagcttctctgaacgtcaccgcggtactctccctgacatctgcctgttctccgaggacaatgctttctccgcagttctcttgcggggggagggaggcggtttgttctcctttgcctcatgctcctgagcccgagggtggggtcagtgtcctctgtgcccctcacagccccttcctatcttctgatcctccctaaagcactccacaagtagctttctgccattaggctgtatcactgtgggtgaccacccatcatcactgcagattctgtacaatctggggcacggctctttattcctcatgggtctcaaccccaggctcaacgtcactctgactgctcccgccataattctttgtgatcttgggcccacgtagacaagatctacatgaatgattcttccaaatctctggcatcacagttccttggcctcctatccccagtggtctcgtcctcttccctatttcagccaccattgcagatggtcagtaagcgccaatagcccccctcttaatctcattcccaccaccccctacctcaatcctgctaacctgatcccagtattgcttcaacaccacagggacccatgatccattgatcctgccacccgcccctttccgccatctcacccatgctttcctttcccttagattccatgatccaacctcaaatcagtctttggcacacagcctccccttctgtgctcctctccccttttattgaactcctctgggaaaactgtaaccctggttgaacctagcttcctgcttactctgtgcctgtgtccagccaagatgaatgtggctgtggctgacaaaatacaatctatcatcccgaaatgtctcactgtcagcacgtgaccttgagagtggagtggctctgctccattctagacccacatcattctctgtcctccctctccacatgctcagctggtgtgcccacatcctaactcactgaaaagagagagaaagagggggaaagagagaaagagagggagggagggagggagggagggacagaatgagaggaagagaaaaagaggagggaagaaggaaagaaggaaaagggagggagggaaggaaggagaaaaaagaaagtccacttgatcccaccacacctaccaatcatctgcctctcttcttcctctcactctccctactcttatctcaagccaatcactttccttcagctccaaataccatcttctcttgtctacacaagaatattccagccgagcatggaggtgcgtacttgtggtcccagctacttgggaggctgaggcaggaggattgcttgagcctgagaggtggaggctgcagtgaactatgatcgtgccactgcactccagcctaggtgacagagcaagaccctgtctaaaatagaaaaaggaatattcatccaggagccacccctctctcctgcatcatcttcccgggttgtatgtcatgaccatcagaatctaaatgggctctaatatattaaaccctccccacctacagccctccagctactgctccattatcttattgtcctctgcagcaagggcccatgaaaggactggctgcaccatcagcctccaaaattctcttttcttctctcttgaagccactccagtcaggcctttgactatgccactccttgaaacacctccagtgagttctgcactgtgaaatccagcagccaatgctgaaatctcctcaccctgggaagaggagcaccctaggcatggcctcccacttctgccttcttgagatgctttcttccagggcttccaggaaaaaagaactcttgtgactttctcctgactcatttgatgttgcataataaattagccccaaaacgtagtagcttaaaacaacaaatgatacatattcattaggtcacaggttttttggggggatgggggtgtgatcagaaatttgggaacaacttagttgggtgttcctggctcagaacctctctggtgtcgcagtcaggatgtcagcaagaagtgcggtggtagggaggcttgatggagggccgtgcccaagacggtgcatcctcatgtggttgctcgcacaggcctcagtgctttgccatgtgagcctttcttcacggcaagggaactaacttcccaagtgtgactgatccaagagagggtgcggaaggaggaagtcatagtgccattaataacctagtctctgaaatcacaaaccattgcttctgccatattctactcatcggaagccagtcattgggtccagcccaatgggattcgcctccaacccttgaaggaaggtatattaaagaattcgtgcctgtattttaaaaccaccacagtacttgctctggccacaaattatttacattcctcccacatgcaaaaatacactcagtcccaccaaaggtctcccaaagtctcatcccattatggcgtcaggatgaggtccaggaactcatcatttaaaccaggtccaggtgtggaggaaattcctcaggtgtaattcctcaaatacaattctcagtatgaagacctgtgagctagagacaagttatctgccacacacacaaccccaatgtccaatgcagtacagtcataggaaaaccactacagatatttttgttcaaaagaggtggaagggggagacaaaaaaaaaaagtcactggtccttagaaaatcagaactttagctgggaaaatgttggaaattccttgattcagacactgctcaactcctacctagaaataattctcagtggtcgtggctccttcctctgtgctcgagtatgtcttctgagccacccttctctttccatgaaaggcagcccatatttacagcttcgtaacttcctcaggctgcttcctgccagtttaatttgggggatacaaagtgagatcccagattttatgctatttctgttcctttcagtccaatctggcagtgttttgtgactgtcattctcttaaaaaaaatgtggatctcctgtaaaacttattgtgactcactccattagacaaagaccatacccacaaatttctccaagagaagatctcttccacaccatgtgcttctgacaagaaagtgaggataatgtctttatacttcttagaagatctaatgttcgactgaaaaatctatgaagcacgcacccttaaattcatgaaagggccttttgcctgagacactatgtgaaataataattattatacattattgaaatcattataattttatataaattattatagtttattatatttttaatatattttataaattttttatatttttattttttatattttatttatatattttatattaatttttattaataattttaaataaattataattttatatattatgcatatattatcatgtatataattttcatatatatatatatttctttgaccctagttcctgacacagagctcctgagacccttataaatgggagtgctaagataatcttttgttctcatatttggtctttgacctctgctcctgacacagagctcctaagacctttctaatctcctgagtgataggagtgtctaacacagaggtcctacctcccttggaatttcctggcatcttttcctctaaagaggtgactcttagtgtgctcttggatgggggctggtcaccagaaggatcaatccatgattgaaagcttggaactttcaccccacctcccataccccagggaggggagggggctgaagactgcattaatcatcaatcaagctgacatgatgaagtctctgtaaaaatcacaaaagtaaggttcaggagcttctgagttggtgaacacattcatgtgctgggaggtatggtgcaccccagctccacagagaccagaagctcctgccctccagcccttccatacctgaaaacaatttggtttttcctactaaacacacaactttctgaggtcttaacaaaggattttacagcatagccttggtttcatctttagaccacatattcctgaacgtgccctggatttgattttagcatcatttactgtctggaggctgagaattttttaagtcatcaagtcccagctccctcatgttgaataatcctgcctagagtttacctctcacctctctcatttcacaatgagccacaagaagaaaccaggtagcactttcaagagtttgcctggaaatcctagctgtacaacccagctcatgagggacattttctactttccacattactgcagatgacagtgttgctaaactttctgccattgtgtaacaaagaacccccttcctttttaccaactaaatgatgctggaaaagtttcttaaggtctctaccccgagtcttcttattggtaaaaacagaactgataacacacatattaccaagctatttggatttctaagtagggtgatgtattcaaaaagcaccagacaaaaggagaacacccaacaaaggctgagttttagagggagtgaggtgtagaagaaagcagactcaactgtgacacagcagagaccatctgcctttccagagcttactgcagctgaaaagacagataatagtgtgtgggcagagggtgaacctggagacttgaaggaaacaggcccctcttcttggtggacagtagaggaaaataaaggaaaaaatcagggtgaggaaactgaccaaactgggctcaaaatccatgcatgctcactgacacctttctggcagcagtggccaggagcagacttcatccttgtgaggtgggtatggcaaccaaccctgcgagtagtgggatggggaaggggttgcctctgcacctatgtgcaattatgtggcagtctctgaccaccttcctggtttcctgctctgattgcaggggggacatatggtggaaaaccgtgatggagctcaggagcctggatacccaaaaagccacctgccaccttcaacaggtcacggaccttccctggacctcagtttcctcacctgtagagagagaaatattatatcacactgttgcaaggactaagataagcgatgatgatgatgaacacactttgtgaataataaaattatctgaatgttttattcctgttgtttcctaagtttccttcaaactctgtctgcatccgcacatttgatctctaggggaccagcttctctagtttgccctctttcctccatcataaccctttcttatcttcagttcacctgatgtcccctgtacgtctgggagctgccttagatgctgttataatcagggaagggcactgtacacaagcccagtgagtagaaaggctgtgggcgagcaaggcttggaaacaagacctgggtttgttttctcagctcagccctgtatgaactcggacagataggtcactgcccctctctgaacgtccgtttctttctctagaaaatgaagggggtggagatgagttctgaaaccccttccccatgaggataagtcaataagcatgaactcaacacctgcctgtgcccagctcagggaccaagcaccacaggacacaaacaaaaggagccagcctgggaacacagttgtgagtccataggtggcggggcccctgtgcaagattccagcacaggctgagggaaggggacagtggagggggagcaaagctgaaaatatgtggctggagagggatagaaaagcaggacactagtgggtaccagacagtgggggaaggagcccaacaaggatgaggaactttgctgtgaagtcatgttagtcaggatgccatgaccttccatgagcccgaaagagggcacacagtcccaggaaggaggcgaaaccctgccccatctctactcacccctaaggttctgggagcttcctggtatccagggaaaatttaggctcccagggtctgcggtctttttcttggaaaccccagtctccggcttcctgtttccagtttcgccttccttcctgggctcctctgggtaccaggctccataccctgccaaaggctagaaagtctgcggacagccggccgggcgtggtggctcatgcctgtaatcccagcactttgggaggccgaggcaggcagatcacctgaggttgggcgttcgagaccagcctgaccaacatggagaaaccctgtctctactaaaaatgcaaaattagccgggcgtggtggcacatgcctgtaatcccagctactagggaggctgaggcagcagaattgcttgaacctgggaggtggaggttgcagtgagccgagatcgcgccattgcactccagcctgggaaacaagagagaaactctgtctcaaaaaaagaaaaaagaaagtctggcgacagccaaggtttcagacagaccagagtttctgcttatggttgaagtgctgaacttgttgggtctaaatgtgaatatgcactgagtagtagagtctattaagaaactatttttaattgcattggctgtgatcatattaatttgctaagcagcaagagctcttgttttagaaatgtatgataaattatttaagggtggaatgtcaggatatctgcaatttatttaaaaatacttccacataaaaaaaaataccgtgagttaaaaatacagaagtggagtggagcacctggcccctgagctctgatgatgacagggcctgctataggcccatcctgttcctccatggaaattagacaaatgacccatcttgcagagagatcacaaaaaggcacacacacccccacccccagccccgggcctactgattacaaaaatgcaccctagccaatacctggtagaattccaaccctgctggcccaaacacccagggacttcctgtggttatgggataacagccaacacagccaccatcgaagcagagtccacagtctcagcgaggtgctcaaatcttggtgcagccctgaacttgacattggtcagcagatctccacaacagctgcacctagagttgcacacaccacaccagctttcctggtgtttttctcttttctttgtacattatatgtaaacatcatttttccaattctaagaatcccgacattcaataaagggaaatatgttagattcttgtatctactattttttccccaaccaacctttctcaagcattagtaggtaagagagcaggagcaagtggtccagccatgcttccagggctgaggctttcctctctcctcctcctgactcccctcctcctgaacaaatcctattccctcccagcaccctctctgaggattcctcggtcaccaccccaagagctcaaggagaagcggcttggttgggaggaccctctcctctgcctcttgctgctaatggcacctgcacctagtttgcaggtgccctcagcttcagatgggggactggggaggaggacaagaaagaaggctggagagggaagtggggcaggaagaagtgaccttgcagccagaggaccagcaggaggctgatcccaggggtgggtatacatgtggccgcttccccttccccagccctccagggctcccagatctgatgctcctgaggagaaaaatctgagcctgaggaactgagggaagggaacaggaagggcctctgtggggaagggagagcatctcagccaatcaccgtgacctgccagttacctgaccaggcacaaagcttaactatgtccttcccatatttgacctgggacaacaccctttcgtctggctttgctgccctccccaaactgggctgcaagaaaggagctcaggcacagtggtgggaaacagtgttccctgcagctgtcagtatttccaaagttgtcaccaagtgtccccaggtgagctcctcccctgaggaaatggcctccccaagcttctgggagaaatgccatcacctgccccctagagaaggacgggccctccatataaacagctcccccatacagagccaggaaggaggactgactgatttttctgcctaaaacacaatcctgtgtatgacgaaagatactacaaacaatgttttttaaaatgtaaacggaggccaggcgcagtggctcacgcctgtaatcccagcactttgggaggccaagaggggcggatcatgaggtcaggagttcaagaccagcctggccaacatagtgaaaccctgtctctactaaaaatacaaaaattagctgggcgtggtggtgcatgcctgtaatcccagctacttgggaggctgaggcaagagacttgcttgaacctgggaggcggaggttgcaatgagctgagatcatgccactgctctccagcctggtgatagagtgggactccatctcaaaaaaaaagacaaaaaagtaaagcgagattttaaaaataatatatatgttatacaaagattaatatccaaactataaaaggaacttgtgaaatcaataagcaaagggcaacaactcaatagaagaaacagaaaaggatagaattgcaatccaaagaaacgccccatggaaaattaatacatggaaggcaagatcaattttatcagtaagtgggaaaatgcaaattaaaacaacaatggagggatcatttttcacctattaaattaatacaaatttaaaagattggttattcccagcagtgacgatgttgtgagaaaattggcatctcaaaggatgtcggtgggaatataaattagtctatccttttaggaaatcaattagtccagatttatcaaaatattagatgtatatccactttccacagacaattccatttttagtgtctgcatgagagaataaatcatgtgtgcacaaagaggcatatgtaaaaggttatttgctgcaacattttatataatagtgaaacttagaaacaaatcaaatggctacaaataggaaaggaaggaaataaatgaggctacatctctagcctagggcactaaacagcaggttagaaaggaggcagatatgtgtgttctaaatgcacagagcagattgactaaacaatttagctcaaaaaaatcaagctgctgagtgacacacatcacagtacctcatttatatcagcaaaattgaagataaagctatatccccagtgatacggtttggatctgtgtcctcaccaaatctcatgtctaattgtagtccccagtgttggcggtggggcttggtggtacgtgagtggatcatgggggtgaatttctcgtgaacagtttagcaccgtcctcttggtactgtcctcgagatagtgagtgagttctcatgagatctggttgtttaaaaccatttgttctcactcataggtgggaattgaacaataagaacacctggacacagggtggggaacatcacacaccggggcctgtcatggggtcaggggacgggggagggatagcattaggagatatacctaatgtaaatgatgagttaatgggtgcagcacaccaacatgacacatgtgtacatgtgtaacaaacctgcacattgtgcacatgtaccctagaacttaaagtataattaaaaagaaaagaattcagtccccctttgtcttctgccctgattggaaatttcctgaggcctccccagaagtagaagctgctatgcttcctgtacagcctgcagaatcatgagccaattaaacctctttttaaattacccagtctctggtatttatagcaacgcaagaatggactaatatacctagacacaatgtatgtgtgcatgtatgcatgtgtgtgtatgcatgcatgtgtgtgaatgtgtgtgtgtaataacaggaaagaatgtgtgcaagaattgcctcaagatgctaccatgggtaatgtctgggtaggggcaggtgactgggatggaacagggagtgtgaaggggggctttcgcattttaccctgtattctaccatattgtttgaatgtttttacaataaaatgtacttgggtgttttaaaaagtagacatgttttaatgactgttgaagtgagtgaagaatatggaagtcagaggtcacagcagccctgcccctgggacagccattgaagggtgtgtgcgtgtcatcctgatcaagtcccctggggataggctactttcagtgtcctcactggagactcagcttctgtgtggtgtgtgctgtctggcttcattacactttactcccttgttctgtcctctcaatagtctagcaaacctaacactaccaatgaagccctactccatgtcctgcccctggcttcccacttaccataccagcccagcaaatacgtttatgtcccccacaaaagcccatacacaaatgtttacagtgcccttactcataatcaccaccaaccagaaacaacccacaggtccttcaactggtgaaaggatcaacagactgtggtacatccatgcaacagaacgtgactcagcaatgcaaaagaacaaagtacccacacacacgacacacctgataaatctcaaatgcattaggaaagaagcgagactcagaaggctgcacactgcatgattacatatgtatgacattctggaataggcaaaactgtcagcacagaaaccactgatcagtggttttcagggactggggggatctggggtggtgataagatggttctgtgtctggattgtgttgatggttatgcaactgtaaccatctctgtccactccacctgtgggatctgatctggacccagaggttgttcaagccagtgccttccttacttctgttcttcccatctttattccttctttcctcttctgcttcctctttgctcttcagcagtggaaagctccttcaaatggaatcctatacatgccttgtagatgtgcctgttcaagtgacactgttcttgatgaagaagggtaagggtcctctttcaacagaagtttgtccccatgctttcattcaacagatgaagaaattgaggcctgagaggaaaggggctccctgtccacatccatgttctgtgctcctaatcatcctccatgctgctttcagagaccattccagggtaggctaagaggggccatcacggtgaacagcttattctgagcactctagagtcgtctaaatctgcagtctggtcatggggtaacaacatagcaacagacttgggagataacatgtcctttccaacacctgcccctgtatccttttttataccttcttgtccagaacaggttcatgaggccatgtgtccagtagaggggactagtttttccagattaactgtcagctttgccatgctatagccaccgccttaataaggttcacctttcagcctcttgtgcaactttctcagagcacgaatgtgtcttcagtgtttgggaatcgcacttctaggaatttatcttacagatacaaacacacatgtgcaataacatctgtagattgatatttgttacagcattgtttgtaatttcaaaagactgaaaacaacctaaatgaccaagctattgaacatccattcaatagaatactttgcattttcacaggatgaagaagctccctatgtactgatatgtgccgatcagcaagacatcttgtattttgtaaggtacggatttctgtctataatatgctaacttttgtgctttaagaaatatgaaaattgattaatattgatatgcattttttaaattctggagaaaacaataaactaataacaatggttgctgggataagcaaaaggtagatggggaaaagtgggatagacattttcactttctggatgtgtttttattttgaaaataataaagttattcaaaattaaattaaaaagaaataattgtaggagagcttctacttctgggaagatggagtagatgtcctttttcctattcttcttactatgtactatatatatatataatatatatattatatatatatattatatatatataatatatatattatatataatatatatattatatatataatatatatattatatatataatatatatattatatatatatatatatatatataatatatatatattatatatatatattaaacatgagacaactctgaaaggtggagagaagaaagaggaccaacaaggaacaacactgcagtgagttccctggattttctttttaccttgtatatcctagactggatactagaaaaactacaacccggaaacaccaaccgacacagtaaaaaaaaaaaaaaaagccctaagaaatgcccgctttctctaaccaaaggaccaggaaagaagcaggcagggcaagacagaaaacttttagatacaattgctctactctagccaacacaacagaaaaaaactgcagcctcacctcacctacaccagcaaaggctgagtagggagcccagacttctaccccaggctgtagtaaggcactcccactcccacgctggagtggagccacagaaggccaagtgggaggccaggactttcaatcacccagggtcagcagagaccacacaggaagcctggactccacccctaccagcagtcagagggtgcccctcaccatccccactggggtggtgtcaaaggaggactggcagagcatcaaaactttcatcactgttcagttttttgtttttttttttttgagatggagtctcgctctgtcgcccaggctggagtgcagtagcacaatctctgctcactgcaagctctgcctcccgggttcacgccattctcctgcctcagtctcccgaatagctgggactacaggtgcccgccaccatgcccagctaattttttgtatttttaatagagacggggtttcactgtgttagccaggatggtctcaatctcctgacctcatgatccacccgcctcagcctcccaaagtgctgggattacaggtgtgagccatggcgcccggccatcactgttcagtttttaacaaggccaccccacccagcagttgcagtagaagcaccccttccccttccagccagggtggaatcagtgaaggcctgaccgccacttccattcagcagttacaaggagcaccttctcggcaatccccccaccccccgcccgcccccataggcatcaacagagaccaggaggacaacctggacccctgcctggcagtaacaaggtgtcatcccacttttacccacaagatctgtgccagagaaggcttgctaccacacatgatttaaataagatccacagttataacacaatactgaaatgtccaggtatcaaataagaaaattactcatcataccaaaacccagaaagatctcaaaatgaatgaggaaagatactcaacagacaccaatgctgggatgcatacatattataatgcttcaacaaataattagaaacacattagaaacaaattttaaaaaatagaaagtctcagccaaaaaaaaaagaaggtctcagaaaagaaataaaagatacaaaaaagaacaaaatggaaactctaaagtgtacaatagttgagatgaattcaatggatgggctcatcagcagaatggagaaaacagagaaaagaatcagtaaacttaaatatggtgcaatagaagttacctaaactgaaccatggagagaaaataaatggaaaaaaaaaacatgaacagaaccatgtgggactataacaaaaaatccaatatttatgtcactagagacacaggagagggggaagaggttggggctgaaaaagtattcagagaaacattgggtgaaagacacaaaccttcagattctagaaggtgtataaatcccaaacaggataaaacaaacaaacaaacaaaaatccatcttaagctatatcaaaaacacaacacttttcaagtgctaaaagaaaagaactatcaacccaaaatttagttttagaaattcctccaggtatgaggggaaaataaagacatcttcagatgaagagaaaaactaatttgttatcagcagacccactttttaaaaaaacttattgggcactggagcaaaggtcacttttcttatgcatcaccaaagaggttggaggcactatgcccctgccatagggatctgtggaacattgaacttgagagtgacaatttagggtattgggcaagagaaatttctaagcagcaaagtgttcaagaaatggcctggctgcttctaacaacctatgctcatatacgtgagcaaagaaatgacataaaactggaacttatatttaaagggaaagcggagtgtaaaagtttgaaaaatctgcagcccagccatgtggtagaaaagaaatgctcattttcaggggagaaattcaaacagggtgcagaaatttgcataagtaaagaaaagccaattgctaatagccaagacagtggggaaaagaccttgaaggcatttcagagaccttcaccacaatccctcccatcacaggcccagaagcctagaaagacagaatggtttcatgggccagacccaggaccctgctgccctgcacagcctcaggacactactccctgcaacctggccactccagctccagccttggctcaaaggagcgcttgtaaagcttgggctgctgcttcagagggtgcaagccataagccttggtggcttccacttggtgttaatcgtgtgggtgcacagagtgcaagagtttaggcttgggagcctctacctagatttcagaggatgtatggaaaagcctggatgtgtaggcacaaagcctgatgcaggagtggagccctcatggagacctcttccaggtcagtgtggagggcaaatatggggttggaacctctacacagagtccccactgggacactgctttatggagctgtgagaagaaggccactgttctccagaccccagaatggtagattcaccgacagcttacaccttgcacctggaaaagccacaggcactcaatgtcggcccttgggagcagccaagggggctgaaccctgctgagccacaggggcagagttgcccaaggccttgggatcccacccttttcatcagtgtggcctggatgtgagacatggagtcaaatgagattattttggagctttaagatttaatgactatcctgctgggtttcagacttgtatggaacccatagcccctttcttttggccaatttctttccttttctggggggaggatggcaatgattacccaatgcctatattccattatatcttgggaataactaacttattttttattttacaggctcacagatgaaagggacttgccttgtctcaaatgaaacttcggacttcacacttttgagttaatgctggaatgagttaagactttgggggactgttgagagggatgattgcattttgtaatgtgagaaggacatgaaatttggaagggtcaggggtggaatgatatagtttgaatctgtgtccacacctaatcttaaatcaaatcacaatctctagtgttgaagatggggcctggtgggaggtgactggatcatggggaaggagttctcatgaatggtttagcaccattatcttggtgttgttctcatgatagagttctcacaagacctgtttgtttaaaagtgtgtagcacctcccaccttgctctcttttggtcctgctcctgctttgccttctgtaatgagtaaaagctccccgaggcctccccagaagcagacgctgccatgcttcctgtacaacctgcagaactgtgagccaattaaatctcctttctttataaattacccagtctcaggtatttctttatagcaatgcaagaatggactaatacatttatataatcataaaagggtcaatctaccaagaagacatagcaatccataatgtgtatgcaccaaaaacacagaactgaaaaatacatgaagcaaaaattgatggaactgacaacagaaaacaatgaatcactaattatagttggaaacttcaatactctctgtcaaaaactgatagaacaactagacagaaaaccatcaaggctatagaagaattcaagaacaacatcaaccaatttttatagaacactccacccaattatagcagaatacacaacttttcaagcatttgcagaacatataccaagattggccataccctgggccataaagtaaaactgtaacaaatttttaaaaaattgcaaccgtataatgtatgttttctgaccacagtggaattaaattaaaaaccaataacagaaatgtgaccataaaatcttcaaatacttggaaactaaataatacactttaaataagccatgggtgaaaaagaaagttccaagggaaatttaaaaatactttgaagcaaatgaaaattaaaacataacatgtcaaaatgtgtgggaagcagttaaagccgtactgagagggaaatttatagcaccaaaatgctttcattttctaaaaataaaactttcaagtcaataatataggcttgtaccccagtctaagtcaaacatagaggaaagaaaagcaaaataaacccagagcaagcagaaagaagaaaataataaagataaaagcagaaatcaatgaaactgaaaataggaaaaacaatatagaaaataaatgaaatgaaaagctggttcttttaaaagacgataaaattgacaagcctctgacgtagaaaaaaagagaaaatacacaacttcctaatatcaggaacaaaggcagggatatcatgacagtccctgcagacatcaaaaggataataagggaatactatgaacaacctaaccctaaatttgaaaatttagagaaaatacaatctaatccctcaaaaagcatagcccactacaactcacccaatatgaagtagataatttgaatactcctataactacttggaaaattaaatatgtaattaaaaagaaatctccaggcccaggtggttttacttgagaattgtaccaaacttttaaaaaggaattaacaacaggccaggtgcagtggctcatgcctgtaataccaactccttgggaggccaaggcaggaggatcccttgagaccaggagtttgagaccagcctgggcaacatggtgaacccctgtctctacaaaaaatacaaaaattagccaagcatggtggcacatgcctgtaatcccagtactcagaaggctgaggtgggaagatcgcttgagcctggaagtcaaggctgcagttagctatgattgctccactgcactccagcctgggcgacagagtgagaccctgtctcaaagcaaaaaattaaataaataaataaaaataacaccaattctacacagtctcttccagaaaatagaagaaaaaagtcagtagtgcgttgataccaagaccaaagacagtataacaaaagaaaactacagactcatattcctcataaatatggatacaagcactcttaattgaatattaacaaatataattcgacaatatgtagaaatagttatatactatgaccaagtagagttaattctggattcaaagctggttcaatatttgaaaagctatcagtgtaatccactatattaacagggtaaagaagaaaaatcacatgatcatatcaattggtacagaaaaaagcatttggcaaattcaatactcatttatgatactctcagaaaactagaaataaaggggaatttcctcaaattgacatagaacatctgtaaaaaatctacaactaacatacttagggaaaaactgaatgtttctcactaagatcaggaacaagtcaaggttgtccattcttcttcctttttagatggagtctcactctgttgtccaggctggagtgcagtggtgccatctcagctcaccgcaacctctgagtcttgggttcaagcgattctcctgcctcagcctcccaagtagctgggattatgagcacctgccaccacatccagctaatttttgtatttttagtagagatggggtttcaccatgttggccaggcttgtcttgaactcctggcctcaaagtgatctgctcgcctcagcctcccaaagtgctgggattacaggcgtgacccaccacacctggccaacgttgttcattcttatcactactattcaaccataacactggaagttctagccagtgcaattaagcaagaaaaggaaataaaaggcatacacattagaaaagaagaaattaaatgtccctatttgcaggtgacatgatgttcaatgtaaaaaatctcaaggaatctacaaaaaaagaccttctaaaactaataagtgcgttcagcaaggccatagactataagatgaacatataaaaatcaattatatttctacatactagcaataagcacatgaaaccaaaacttaaaatacaatcctatttacaatcagtcacaaaagatgagccacttaggtataaatctaacaacaaatatatagcatgtgaaaattacagaatgctaatgaaagaaattaaagaagatttaaataaatggagcactcatggattggaagacttaacatagtaaagatgtcagttctccccgaattgatatacaggtttgatgcaattccctttttttttttgagatggagtctcactctgtggcccaggctggagtgcagtggcatgatctcgactcactgcaacctccgcctcctggattcaagtgattctcctgcctcagcctcctgagtatctgggactacaggcatgcaccatcatgcccgactaatttttttgtatttttagtagagaagggtttcacctcattggtcaggctggtcttgaactcctgacctcaagtgatccacccgcctcggctcccaaagtgctgggattacaggcatgagccactgtgcccggccaggtttgatgacattcctatcaaatccctgcaagatttgtttgcagacatagacaagattattctttaacttacatggaaaggcaaaggaaaaagataaaagaaaagataaaacaattctgaaaaaggagaattagagtgagaggtatcaatctacccagtttcaagacctatatcacataccagcaggaatcaaagctgtgtagtattgatggagggaaatggaacagaatagagaacccaaaaatagacccatacaagtgtggccaactcatttttggcaaacatgcaaaagcaattcagtggaggaaggatagccttttcaacaatgctggagcaattgaatatccataagaaaaaaaaaaaacctatgatttaaatctcacaccttatataaaaattaactcaaaatggaatatagatttaaatgtaaaacataaaactataaaagtttagaaggtaacataggagaaaatatttaggacctggtgtttcgtgataagctcttagacacaacaccaaaggcagatccatcaaaggaaaaaaatcaataaattggacttaatcaaagtttaaaacttttactttgcaaaaatccctattaagaggatgaaaggagaagctatagactgggagaaaatatttgcacaatgcagatctcacaaaggactcaaattcccaatataaaaatgactctcaaaacccaacagtaaaaaaaaacaaataatccaattagaaaataggcaaatgacatgaaaagacttttcaccaatggcaaataagtacatggaaagatatccatactactagccattagggaaatgcaaagtaggaccatgatgagatattagcacatatctgtcagaatggctaaaataaaaaatagtgatgagactaaatgctggtgacaatgaagagcaactggatcactcacacactactggtgggagtgtacatggtaagccactctggaaaatagtttaagaatttattttttaataaaaattgtgtatatttaaggtgtataacatgatggcttgatatacatagtaaaactgattactacaatcaagctaatgaatattttcattaccttacatagttatcgttttcacatgtgtgtgatgagaatgcttaaaagctactctcttggcaaatttcagatataaaatacagtatttttaaatatagttccccttctgtacattagatttctggaatttattcatcctacctaacaaactttgtaccctttgaccaacatcttcccatttctccccactccccatgcctgataaccaccattctcctcttgcttctatgaatttggctttttcacattcgacatataagtgagatcatgcagtagtggtctttctgtgcctggcttatttcatttggcataatgtcctccaagtttattcatgtttttgcaaataacaggatttccttctttttaaagggtaactatgattccattgtgtatatgtacattttctttatccattcatctgttggtggatatttaggttgattccatatcttggctatgataaatagtgttgtaataaacatggagacgtacatatctcttcaacatactgatttcatttcctgtgggtatatagcatgaagagatattgctggatcacatggtaattctatctttaactttttgaggcacctccatactgttttccataacggctataccaatttacattactaccaacagtgtataagagtttcgtattttttacatccgtaagtttggcagttactttaaaaaaacaaactaaacttacgcttaccataagaaacaccaattgctctcctgggcatttatcccagagaaataaaaacttatgtacacgtaaaaacctgtaaatgaacgttcatagcagctttatttataacagccaaaatctggaaacaacccagatgtctctcaacagataaacagttaaactgcagtacatccatagactacatggcaataaaagagaatgaacaattgatacatgcaataacctgaatggatcttaaggaatttgtgctgcatgaaaaagtcttaaaagatgacatacaaggccgggtgcggcagcttacacctgtaatcccagcactttgggagaccaaggggggcggatcacgaggtcaagagattgagaccagcctggccaacatggtgaaccccatctctactaaaaatacaaaaattagccaggtgtggtggcgtgtgcctgtaaccccagctacttggggggctgagacaggagaatcgcttgaacccgggagatggaggttgcactgagccaagatcacaccattgcaccccagcctgggtgacaagagcaaaactccatctcaaaaaaaaaaaaaaacaaaaacaaaaaaagccatactctgtgatttcttctatatcacattctcaaaatgacaaaatcacagaaatgggaaacacattaacggtggcctggggctaagaatgttgagagagggaggactgggcatgaccaccaagggatggcagggaagaggtctttggggtgatgaaatggttctgtgtcttgattactgcgggggctacaagagtccacacgtgggtgaaagttacctgggacctctctgtactacccttgaacttcctatatgctatagtttcaatgtttgtttcctcctaatctcatgttgaaatttaatccccagtgtgatggtgttgggagttggaacctattggggggtgtttgggtcatgggggtcctttgattcatggattcttcattaatacatgcatgcccttggaggagtgagtacttaactctattagtccccgaaagcgccgattgttaaaagagtccagcacctccctccttgtcttgcttcccctctcaccatgtgatctctggaaacactggctcccctttgccttctgccatgaatggaagcagcctaaggctttcaccagatgcccaatcttccagccagcagaattgtgagccaaataaatcttttttctttataaagtacccagtcccacgtattcctttacagcaacaccaaatggattgggacactatgaatctataattatttaaaagttaacagctttaaaaattgattgtcaaagtcattttgtgtctgtcttttttacttttaaaatatgaatccatcacgctaaatgggggctcctctggctcctcacagggcattcagcgtttggtgggggcaatgaccctgggtttatgcggacacaattccaggatgttctgcagccagatctttcccgaagtttcacatctctcttccaggacacctgctgtctctagaaggagcatccctctggagaaggaaggagagaaggcagaaagtggccgcagcctagtgggaaggagaccagtgacagctgcatcccagcccactagggagcagcagaggatggagaatggttctcagctctgcactggagtgggtggaatctcaggcaggagaaggggaggggctctgcccagagacctttccccagcctgaccactgcaggtgcaaaagcagcttgagcatttccaatgcctgataaagagggagcccagctgggctcagtggctcaagccactaatcctggcactttgggaggctgagactggagaattgcttaaggccaggaattaggattcaagaccagcccaagcaacatagcgagattccatctctacagagattttgaaaattagctgggtatggtggtgcacacctgtagtcctacttagaaggatgaggtgggaccatcacttgaacccaggagtttgaggcttcaatgagccatgattgtgtcactgcactcctctaaattaattaatgaaaatgaaacacgaaggaaagagccctatgccaagcagaggtctcctgaccttgggattaaagatggagaagaactgaggtcgactcagtgtggtcacccattccatgctcttcgtttgttctgtctgagtatctgaggtcgcaggagtgccccactcagaacaaagcaccttgttcttcaccttcagggataagattgctcaaggagcctgaatcccagagaaaggacagagacctctaactccccatccatgcaacatgcatgatagagtttcccagctgtccctgaaccggtctcaacctgcaggcccatgaacccatctgaaatgggctcaaatggagaatgagaaaggaccttggaacattcccagagactaatttgggagctcagtacatcagctaaaggtattttctagatgattcttcagagccaaggagagggagagctcctggcctaggatggaagccaatattttactcttctcacactctgtgcaccaagagatggtgtgaatgtgagagaatcactctgcaattttactagctctatgttcttaatcgaagtgcattgcctctcttagccccaatttccttatctggatagtatgggaaatgacagttctctcttctggagttactctattgattaaataaagtaagtgagacgccgtgcaaaacacctggcacctgccaggcaatccgtaagccttttcctgcgccccctgtcggcgctggaaaagttctgtatcttgtatcaaccccggctgcagtatccttcataaccaccaggaggcggtgtgggaccacggagcctgctttgcccacaactagactcactgggggaaaggagagaattcctccgcctaaggagcagcggaattggagcgccagaattggagcgccagagagacaccggatcttaccttcttgcgctggagttgcccacgctgtctccatagcacgaaaaagaaccagggtaggcatagcaaaggcaacaggtgggacggggagccagggagtggaaacgccggaggtcctcaggctggggatcccggagtcctcgctcagattccgattccggagaaggccaattccgggaccctatccatgtcccattccgggcaccttcctcaaaagtaggggtgggaggggcataagccggtcaagtatttcccgggccttccggagcaatcttgcctaagcgttcatatttaacgcattggactgggaaacatttggagatcattgattaagaaatactcaaacctgggccgggcgcggtggctcacgcctgtaaatcccagcactttgggaggcccaggcgggcggatcacctgaggtcaggagtacaagaccagcttggacaacatggtgaaaccctgtctctactaaaaatacaaaaatcagcccaccgtggtggtgggtgcctgtagtcccagctactcgggaggctgaggcaggagaatcgcttgaacccggaaggcggaggttgcagggagccgagattgtgccactgcactccagcctgggcgacagagcaagactccgtctcaaaaataaaaaaatatatatactcaaacctgaaacccatggataaattaaattctctagtctttgtttatcgtttttgaaaacaaaaattgcattttttgacagggttttaccattgcccaggctgaatgcagtggcacaatcacaggtcactgcagccttgacctcctgggctcaagcgatcctcccacctgagcctcctcagtatagctaggactacagatgcgcaccaccatgactgctaaccttttagtttttgtaaagatgggatttccttagattgcccaggctggtgatcctcccacctcggccacccaaagtgctgggtttacaggcatgaaccaccacacttgacccacatcgttctctttttaaaaaaatattccagcccggcacggtggctcatgcctctaatcccagcactttggtaggctgagatgggaggatcccttgaggtcagcagtttgagaccagcttggccaagatggtgaaatccgtctctactgaaaaaaatttttgttaaaaaaatgccgggcctggtggcgggtgcctgtaatcccaactacttgggaaggctgaggcaggataatcacttgaacccaggaggtggaggctgcagcaagccgagactgccccactgcactccagcctgggagacagtgagactccatctaaaaaaaaaaaaaaaaatccactggcttcccatcacacctagtatataattcaagacactctctccctcatcatggcctacaaaacgctacagaatctgaccctcctgactttccattgaccctccctttcacctccaccctctctcctcctttttgagctccattccaggcactttccacatcttaggccactgcatttgcagttccctccgcggggaccctgccctttcagaagtctgcatggctcattctcttctgggtctctgtctcctccccaagttcctctctggcccacttcatctttccttcacagcacaaagggctgtcctgcctgataccatgttgtgtgactgtgtttatctgtttcctgtctttctgacccaggaatgtataagcgccctgagggatgggatcttgtcttcctgttgctcagtcatttaataggtacttgctaagtatttgtggaatgagtgaatgacttaattaatctacaagctgtggagactcaggaaggatcgtgatagtgacagctgttggtaaatttaattcaatatgtattgtgcgcttattttgtgcctactgtgtggcattcagcatcatcttgttgctgctattcattgtggtgaagagaatacggcagcaggtaagtctgatctgggcccagagcacagaccgtaggcgcagctcatctcttcattgctttctccccattcttggagtggcagtaggaacccccacccccccccccccccacacacacacacatacacacacagagagagagagagagagagagagaaagagagagagagacgggacagcctcctctatgcactgcttcctcttccccagccctgctccctgcatccttccctctggtcctagtgtcctggtgtcttgaagatgctgggtagttagaccgacatccctctccctctctcaccctgggctctgggacgctggccctgcttccccagagagcgatcgccccggacttgtgcctgtgttccggcctagggcagccggaacctcccgatatccccagaggagtctcaggacagcgcacagggaagtactggcttggagctgcgtgttccttgggcggccggcggagggcgaagagcaggaagagcccgggggacgacggtagcagagtgttggggaggccacagacgcggactgcgtggagaaagcacgcacccgggccgcagtagccgggcagggggacggcggaaagcagccctctctggaacattttattctgatccccgcaggactcccccgcgagccccggcttgagcagtcgtgtaacaagtgtgcgattgcgcgtgcgactggtgtgtgcgcgtgggcacttacacgttcccggggaggctgggggcaggagcttcactgttcacacaaagagcgcttagaggaggaacatttaagtttgggggcaaagaaagaaaaaagagttaaaggtttaggagatgggggaggaggatggggcttaaggacgcggtgttgccgcggctcagccatcggggcgggaagctcggggagggagagcgcctgggcccgcttctcgcctattctacgcagaacttttctctcctccttcttccctcgctctgcctctctcggggcggtctccggggactgtctctcacatccattctcctctcctccttgatttatgctgcagagtggaacgaccttccctgacctcattttcatgtcggcgcgagcacacccggagccggctacgcacattccggaggaggcgcgcgctgacacgcacacacacacacacacacactcgagacactgcagggccctgcccatcctcgagttcacaccagccccgccactattatgggcactgccggggctgtggacgctcaaagaatagatcctcattagcatcttgctttgaatatcatttgcattttattcatttcatgtcaaaacgctcagaactctccccagcccgcaccttccccagagcttgggagtcatgggtttccagctcaagccccttctctgtgggccccacgcttgctggctacccccaccccacctaccctgcgccacagcccccacaaaatgaattgacgtctcctaagcacttggcaagttccatctcctgcgctagggtgcattgtctcatctaatcctgacagcaactcaaggagcaaagcactatactatacccatttgagagtcgaggaaactgagtcacaaaggtgacttgaccaaggtcgtggagctaaaaaccgaggaggagaaactgaaacccaaggcgaccaaacaccaaacccaaagagcttaaccgcttcgctgccccggctcaggcaaggtcaaagctaaggtatgataactctggcaggagaaagtctgttttcctacgtggtagaaagtccttgggcccgccacgacccttcccccatcccggccgctggggcaccggggcacattcccagtgcgggcgctcgcagcaccacctcgcctggccgcccccagtcctgacccctttctagcgctggatcggccgggtccggcctccgtgctcgcggggtcgtccgtcggcgctggctagttaagaaaaataaacaacgttccaaatgaaggcgattcctttcaacccaagctccgccgcctgccagagaaatgcaaacagcggggtacggccggagtccgccccagcccccgcgccggagctgcgggtggcagggtcgggccgcggtaacccgagccgccgcgccggctccccgcgcgctgccctccgcctgccccttcgcccctgaccccgcagtcggcgcgctgggcctgcgcccgccatccccagcgccccccaccgggccgggacctccgccagcggtcctcggcgcccttcctgccccctccccccagcggtctcggccccatcccgaaccgccaccctgggatccccagccctcctgcgccctcgaggccaccgggctcctgcgagcaacgcttccctgcggcgaccgcgcgctgggatcactcaacaccaagaaaaaaaaaatgcactgggaacgacagaaacctgccttagcgaactatcctctagtggatcgggcgtggggggctgcttccagataggacccctgctcaccctgcagggtgcggccgggacaactacgggcgccactgcggaaggcctgacctgatccggcacggtgtggccaccgtgggcccacagagggtgaaggggtagcttatgctgagtgggggtgtccacctggacagaccaggcgagcctcgctcctggtgcgggagctagttttccctggatcttccgcggcagagaagcctgcgtccgggaccagcagagtgagccgaccggcggatgcagttgaccccattcgcgtccaaacttcacttcgagaaaacgcagccctgcgcgcagtccacgcaggacgcgacagcgccaccctcgtttgtacggctgcgcgaatgactcgagagagtcgcggtggctgcacgtgcgtgcgcaaagcgggaaggagtcagaaacagtcccgggcgcagagcgaagaaatcctgggacctcggcaagagggcctcaccactggagatggggtagctacgccgtgtggctgggggaggggtggtagggggcgcctagccagttgcaggggcctcgggactttccatggcctcacccctcttctaggacacgtggccagcgtcctccaggccaccactggggatgagggtgctcgagcctcggtgcccagagtgttgggaggagcggcggcgcacccgcttcctccgaattcctgcatcgcaacgctgggccgcaccgaaggcggtaggatgtgccaggcgtaaagctccgattggcttcgagagagtcgggggcaggcgaagacgcggaccacgcgggcttcctgtcctctttattcccagctctttttcgcgggataagcgtgtctgacggcttaagtgcagtctccctgcgtccctgcctgagctttccagctcccaattacttcgcgggattgggagccgagcgctctccctggagcgatgctcacacccgtgcgcactcgcctagacttcccagcccgctctccgggtccctctgcgcggcggcactgcgcagctcttctgctgccggggctccaacacctctggagctccaggccctgactttcccgcagtctgtccacccgagctgcaatcaataccagctcagtacggggccgctcgctggcctccactcctcccgctgcacacacgtatacaccgcattagagattcccttctcgcactttcgtgaaggggcaagatgtaagctcgggagaattccactttcctcaaagattccctacccgggcgtcatatggggattttttcccccattgtagttttctttttaaagaagttttctttaaaagtagaaaaaaagtagacatgaacaccaccgccaccatctcttcccagcttcctaaatcggttcctttttgccagctgaaacccagcaattatggcaggaaggaatcctttcctcttgggtccttcaaaaagcgccactttggagacggtgataaatctgcgctgcctgagtcgttcccctactcccaacccctcgctcctcatcactgcccctcctagaccctgctgtgtagacgggacctcaaggagttcccgagggaacagatttgaaagcccagctccgggttccatggacagtgtttgacaggtcagcccctcgctgtcctcctatccccctcctccaagtccggtccccctctttcaccccaacccccactctcgcgtgggactcagacactgatcccggagcgagaatgcggctgacagttaaattgcagtgtaggccgagggggggaaaagggaccatgtctctttaacgggccctgcagacaaagcgtctccccttggagcgagcggagccaggcgcagccgcgcgcagacctgtcagcgcgtctcacgcgcttgggagagagtttgcaaagtcataattatatctcttaacctgtcttgctctctgcagaagaaggtcccattatattgaaatgagattattagccatcaaatactttctttctcgggagttttttttttttttaattcaaataccttaacgacttggcaattgcattttgatcagatttagttggcgccccagcccggagcgggagccggggcgggaaggcagctggttggggagcgacgagggggaggtcgggggggaagccagaagagtttgcaaagaaatgcaacccctcttttatctcgctcctaggtctcatttacctggcgagggcctccaggcctggggagggggtgtgagatgagggaagttggggcagagtggtgagatgtcttttatccccttgggacctggtcggcttaaaccgcttctttgaaaatggaacgcgactttcagacaaggcgaacgtggacgccgaggcggaggccaggctgcggaaatctgagggctacagaatagggttgggtctggggtactaggtaaggaccgaggctggagctgggagtggctcgggattaacttcttccgctggaggttggcttaaggctcgcgccaggctcctggcggatggaatttcagaacgcaataaatggggtttttctctacgcccaaggcctgtctggttttaccaaagattgtgagccccttgagtggagagcccatcttgtttccagaccctggaacccctgtccctactgccaacagaccaccccctcctctccctggactggaggaaggatgtgaggtggaagattttccagactttaattttaaagcccctcactttgacttcccctagtgggaggcggagccaggcttgtgtttttcttggctttagcccagactcaaggaaaatatagggaacaagacagccaccagccccacctcccccaccccggaccctcatatttcacttacaatcctggtgggtccgaccagcctctagttccaccccatcgtctttgcaatgagtatctctcttcaggtactcaaaaaagcattatgaagatccggagtccagaagcttggcttctaggccaggtagaaccacaccaccttggaccagtcagctcttgtctctgagcctctgtttctccttgtgcataatgaaagccttggacttgagatatatgcgttccctttaatctcacatcattttttctgtaaagaaggttcttgccagatgtggtcatctggaagattccagagaggccataccactgctcttcaggaaagcagcctgaggaggggtagaaatcaatgttggctttaaaagcctccaaatataaaaactgagaaactttggtggtgtctactaaaactgaagcatgcataccctatgacccagcagttccactggcaggcattgtcccaacagaaatgctgtcctatgctcaccaaaggacatgtacaaaaaaatgtttacacagtactcttcacaatagccccaaactgcaaactaccaaatgtccattagctatgaaattagctgtgatatagttacacactggaatactatatagaaaagagaaagaatgagctatgctacatgtaaccacatagatgactctcatgctgagcaaaagaaactggacctggcctggctcaatggctcacaactataatcccagcactttgggaggcagaggcgggcagatcgcttgagcccaggaattcaagacctgtctctacaaaagtacaaaaattagagcatctgtagtcccagccactggggaggctgagatgggaggatcacttgagcccaggaggtcgaggctgcagtgaactgtcatggcacccactgcattccagcctgagcaacagagtgagaccttgtctttaagaaaaagaaagaaagaagagaaaagaagaaggaaaagaaaaagaaatcagacccgaaagtacattctctgtggttccatttatttaaagtacaaaaacaggcaaaataaatctatgtatgctattagaaagcagaatcatggttacttagagaaggcatggctaaaagggattatgaaggaggtttctgggccaatggtggtcttctgattcttgatgtagttacacaagtgtgttcagattatgcaaattcattgagatgggtacctatattaagtgcattttgtgaatttataattattaaagcctgaaattggaaatttcttctccctagtcctcaatctcattcatacgctcacatattctaatgctgcaaactctacagtagcaggaaatcaatcaatgaatcatgtttggccctcttcccctgtgttcaacactgtaaagtatctgtgaatatattttagcccctgccttcaaagatttgcaatcaagtttgggaggcagatagacacccaggaaatcacggaggagatatctaatggaatagaatgagtagtggtttatgcctctgtcaggtgaacctgacagctggggccaaatcccagctccaccacttactatctatgtaatcttggacaagtgacttcacatctctgagcctcagtatccttatctggagtatggagaggaaaatgctaatatttactcacggggatgttgtgaggattacaccagataaatatatttctctataacagcaacaaaaaatggaaaatgaaattgttccttttaaatgctgtattagttcatttgggttgctgtaacaaaataccatagactggatggcttgtaggcagcagaaatttatttcttacagttctagagcctggaaagtccagcatcaagacaccagaagatttggtgtctggtgaggacccactttctcacagacggaaccttctcatgagagtagtgcccataaatgttagccactatttccacctggtatggtggtaagtctggtttgggctgctcagagttcagacaagaggatggtgagtatgagttggggtgagtgtgtatcctataatgcacagagcagcttccacaacaaagaaattttccagcccaaaatgccagtgatgccaaggttaagaacccttgatgtggaggacagaagggattcggtggcaaagggagaacattccccaggaggggagaaagatgtgctctggaatttctgatgtgaactgagggtaggtagcattggaagtgaccagaggagtccctgttctagtcttcatccctcaggctgcaagctcctcattcacctccctgatttcagaatttgtggggggtggtttatttcctgttctcaagagatacttggaaaaagcaaggcagattctcaggagatttacaaggccacagcatcgcgtgtgccttggaaccacaattggaggaaacccctaagttggaggcatctgaccctctcccagaggctcagaaggggaagggacttgtctactgtcatgcagtgcagctgggagtgctgagactctacccttgagctctgttcttggtgtacagaaagttaggggagaagggattgcaaatctggattaaatgatctagaagcggaaaatatgacacatgttaatagtcaaaaaggaaagtcagcaccgaactttggaagtgttcaatagaacaatgtgattgtctaggggtaagtataattcttggttctaaaatcatgcctaatagacatagcattccagaaaaaaggaaatttacattggttaatcacatttttttccagaagcaaattctatttgtcaggcactgttctaaatactagggatacagtaatgaacaacagaggcaaagcgaaccctcatggggcatatatactgggggagaaggatgataaataaaacaatgtaatgccaggcatttaactgagcacctactatgggttgggtgtcccttataaatgtcctcagtttcacaagaacttttaagatagaaatctgcagtttaagatggagaaactgaagttcagagaaggcaagtgacttccctaaagtagaatgactaataagtgtcagattcaggatttgaacttagtaggccattcatgataaacatagtacacttagagggaacttcctcaatctgataaagactatctacaaactcctacagcaataattatgcttaatgatgaaatagtgaaagtttcctcctttctatcaggagaagatacaatatccagtatcaacacttctatttaacattgtattagatatcctagcccggacaataagacaagaaaatgaaataaaagatttaaggattggtagagggaaaggagaaatattattcatagatgatatgattatataaatagaaaattcaaaataatctgcaaactactggaattaatggtgaatttagccaagtcactaaataataagatttttgttgttgttattgttgtttttgtttgtttgcttttttttttgagacagagtcttgctctgttgcccaggctggagtgcaatggcgtgatctcagctcatttcaacctccgcctcctgggttcaagcaattctcccacctcagtctcctgagtagctgggattacatgcatccatcatcatgcctggctaatttttgtatttttgtagagatggggtttcaccttgttggccaggctggccttgaactcctgacctcagatgatctgcccacctcggcctcccaaagtgctgggattgcagacatgagccactgtgcccagcctaaatacaagtttttttaatacaagattgatgcattaagataaattatatttatctataacagcaacaaaaattagaaaatgaaattattctttttaaatgctgtcttagttcatttgggctgctgtaacaaaataccatagactgggtggcttataggcagcaggaatttatttctcatagttctggaggctgggaagtccagcatgaaggcagcagcagatttggtgtctggtgagggcccactttctccaggtggagacttctcactgtgtcctcacttgctagaagaggtaaagtaactctctgggccttttttataagggcactaatcccattcacaagaactctgctatcatgacctaatcgcctcctaaaaggccccacctcctaatgccatcaccttgagggttaggatttcaacatatgaatttagaggggagacgtattcagactgtaacagatgcaataggtgggtaatagctaaagggcatgaggttactttttaaggtgatgaaaatgttttaaaattgacagtggtgatggttacacatacctacaaatattctaaaaaccattgaagtgtatactttaaatgggtgaattgtatggaatatgaattatatctccataagcttggatttctttaaagatgaagggcaggtattgctggggttctccttcctacactaccaatcactagtgcttatgaaaatcccttctaaaaatacaatttacaatagcagcaaagcccatcaaatgcctaggaataaatcaaatgaaaaatgtgcaagacctctacactgaactacaaagcattattgagggaacttaaagacctaaataaatgtagggttataccatgttcacaaatgggaaggctcatattataatgatgtcagttctcaaaacgaatgcatagattcaatacaattccaatcaaaatcccagcaggtttgtttttggaaattgaattcaagtggatctggctctatggctcactggaacatggacattatagaaaaagatccaagggtcatagtgtcccctatgtacagggtttataggcagctatagttgaaagaccatcaagaccacgggaccctgaaaaactcatttgggagtagaatgaggagataaaaaatattctcagttaaaacagactcttaccatgctttcagtagacacaagagaaagaccataattgactaaatatattttcacttaaataagagtggtagaaaggacttgtcacctttcataagtgatatcattagggatatggctacccagctggggatatggctcccttcattgtggatataggtgtgcaggattcctctggcaaggacttggagaggggtcaataaatctcttaggccacatgctcatgggtaccagtttgtgcatgagattgcaggaggcccttgacctgtcccaaggcagcagctaggacttggcctcagccttggcttttgagaagctgtgggagagttgaggcttgaagtcagtcatcggaggagatggctgcttcctccctgacgacaagctgaggagcacccaagaggctgggcaggaggttgtagggggcaggggatcaggggatgcagcactgcctttgtcctcaggctgcacccacagaggcagggctccagcacatgaagaaacagagcttgtttcccagtgagggagagggcagagaccccaggattccctcagtctcccatctcaatcccttgaggtacggggcttccctaaaaagggagaaaattcagatcagatgacaagggactcagaagaagagaaacaagagatgcaggggaagcacttcccacctcaatatcacactcactcactctgcatctttccgaagaatggtcttttctcccacaatgtggactcagagacagatcctatgacgtagcatctcattattttatctaaaaagagaagaggccgggcgcagtggctcatgcctataatcccagcactttgagaggccaaggcaggcagatcacgaggtcaagagatcaagaccatcctggccaacatggtgaaaccccgcctctacaaaaaatacaaaaattagctgggcatggtggctcacgtaaattgtcccagctactcaagaggctgaggcaggagaatcacttgaacccagaaggcagaggttgcagtgagccgagatcctgccactgcactccagcctggtgacagagcaagactccgtttcaaaataaataaataaaataaaataaaaagaggccgggcgtggtggctcacacctataatcccagcactttgggaggcccaggtgggcagatcacctgaggtcagaagttcgagaccagcctgaccaacatggtgaaaccccatctctactaaaattacaaaaattagctgggtgtggtggcacatgcctgtcatcccaactactcaggaggttgaggcaggagaattgcttgaacccaggaggtggaggttgcagtgagccgagatcacaccattgcactccagcctgggcaacagagtgagactctgtctcaagaaataaataaataaaaattaaaaaaagaaaaagagaagagaagtggggaaactgagacatagagaagagcagatgatggctaggaatatcagggagccagaggagtccacagggaaggcaggggaggttgaagagcaaggagacgtctgatttcctcaggctggagaacagagctctccaacatcctttttttccagcacacacctcaagtaggagagctagttagactcactcttctacacagtctgtgctgggaactgacatgtaaggggagggaagagaggacagatgtagctggaaagagagaggacacttttcccacctcttgcagtatctcgttgagttcatgaaagtctacttaatacatattgcctagggctcctgtccctcctatgatgtcacagatgggtgggtgctaataagccccatgggcccctgtgttgagtcacagagttgaggactccaggttctcccaggagcctagaaggtcttgcttctttcttccctggtggtctaccaagagcatgagttccagaaatatgtcaacctgtttctttatactcattcctgtgtgcccagcatggtgagacctgaaataaagaatatggcaccctccctgtcctcacagggcttgcattctaggtggggagaagcacaagcccaacaccagtgtgaataccaccagggcgcctccccacatggtggctggagtgtgttgacaccaagtgctaacaagggccttccctgcagtctggaaagtccagaagcttcctgatggaggagaaagggtagatagaggtcagcttaggaagggagatttgggtggagagaccagacgaaggttattgggaaaaatgcaaagcaggaccagaaaccagggctaaggccattggttcatgtttgtgggaaccaggcagtgtgagggctggaaaggcagtgtggaccagaggagggagggtcatcagcatcagggatttggggcttacgggggagtaattgaaagccctgggagctgagagaagcttgaaaattatagcagtcagggtccccacaggaaacacatggcgtgtccacactcaagtttggagaactggaagaaagcttgataaagggcgtattcgtttcctggagctgctgtaacaaatcaccacaaaccatgtgtcttaaaacaacagcaatttattcctctctgacttcaggaagccagcaatccacaaccaaggtgtcagcagggtcggttccttctgaaaccatcctacacctctctccttgcacctggtggctgccaacaacccttgcccttccttggcttgtagctgcatcactccaacctctgcctccattgtcatatggccctgtgtcttcaggtagcctcttctaatgacacagtcattggatttagggcccaccctaagtcaatatgacctcatcttaactaattacatctgcaaagatgctctttctaaataaggtatcattctgaggttctgggtggacatgaatttttggggggaatgctattaaaagggactatttacaaaggtgtggacaggtgtggggaaactccaaaggatactgtggtgtccagggctataaaagcagagaactggagccaacccctttatcttcagggtgtggagaaggaaccagaaggaggtacagaagtccaccttgagagagctgtgatctttggtggcgcccgaatcaaccctgtggggaaggaatgagagcaccaagcccccttccctcactcactctcctccactcttacgtcttcagccagagtgcagagaggccactggtgcagcccacacagatcaccctcctgaggtagccaaaaaagggcttctggagaggcaagtagatgacagtgacacaatggcagtaggggctgatggcaagacgtgccaagaggagccaggtggagatcttgggtagggtggacatctggacagggctgtagggtgacagtgtctcctctgccctcgggcctgctcttttttagacctcagctatgtgggcaggctccaggggcccatctatgccaggtcagggcatcctgaaggtaacagaatgagccccatctccttggaaaggaggtctgatggggttgctcaaggcatctgagttcacacactggccaggaccaaatttaatcatggtcacgttcgttggcagacacacagatttttggggtttggggtatttttttaacggactttattttttcgagcagctttaggttcacagcaaaactgagcagaaagtacagtgagttcccatttacccccttccccacatacacacagcctccccactgtcaacatcctgcactggagtggcacatttgttgcaatcagctaacctacgtgacacgtcattatcacccagagcccatagtttacgttagggttcattcttggtggtgaatattttacgggtttggacaaatgtataatgccatgttacccaccattatagtatcatatagagtagcttcactgccctaaaaatcctctgtactctgtctattcatccctccaccccaatccctggcaaccactgatctttttattgtctccatgtctttgccttttccagaatgtcatatagttggaatcatacagtatctagcttttccagactggcttctttcacttggtaatatgccttcaagtttcctccgtggctcttcgtggctcaatagttcaattatttttagcactgaataatattccattgtctggatgcatcacagtttatccatttgcctactgaagaacatcttggttgcttccaagttttggcaattatgaataaagctgctataaacatctgagtgcaggtttttgtgtggacatcggttttcaactcatttatattaataccaagaagcatgattactggatggtatggtaagagcatgtttagtgctgtaagaaactaccaagctcttccaaagtggctataccattttgtattcctaccagcaatggatgtgagttcatgttgttccacacctttgccagcatttggtgtcacatccagtttttaaaacatgaatttgacacctttaggtggggacttgccttgttttcctttttttttttttttagacacagggtctcgctctatcacctaggctagggtacagtggtgcaatcatagctcactgcattttcaactcctggatttaaggaatcttcctgtcttagcctagctgggactacaggcacacaccaccacacctggctattttttttttttttaaatttttttgcagagacaggatctcactctgttgacaggaggctgcctcagcctcttaaggtgctgggattagagatgtgagccaccacacccagcctaggtgggaccttcatgcccagttcacccacagactcactcatttcccactgacccatcccaggcccattttattcatgtatattacctgcccagccccagtagacatttgaattttcaacccctacttgaggatatagaatggagaagaagaaggtgacttgctagccacttagcatgtggttccccatccctgtgcaccccctcactcccctcacctgggaggaggagggaggcacctttacccactgggcaaggtggggtgagtgactggcccaggggaagggctgaggaaatacttctttaaatggagttgtttcctaggaaggccctgatgctatctgagtgcaggcaagaacaagttttgtgccgaccctctccaaggtttattcatcagatcccaactgccatttggaaacatggaaaaagcatggacttttgtttctgaagatctaggtttctatagtccctgtctgccagtggccttggacagatcttttaatgcttctgagcctcagtttatctttctgtaaatagtaatggctgttttacaaagttgctataccagaaaagtcatttttgctctttgccaactataaaatcaaggacaatagtagttattgtctacttcctcttcgcacctcctcacctcccattctctaatgcatgtcaatcattccactgaaactgggctagttaaagtcaccagtgacctccacatggccaagtccaaggaccagttctcagtcctcattgtaaccaactcacctgaagtgccttaagctttttttcttctcgaaatactttgtccatgttggctccagagcatctgactctcttggttttctttctacctccttggctgtgccttttctgtctcttttgcaggacctgcctcttcttcctgacctctaaaggatggagtttacgagggctgcatccttggcactcatctgcccaccatctataccatgggcttggtgactatagcagtttcctaggactactgtaatgaagtaccacattgagtggcttaaaataacagaaatatattctctcacagttccagaggccagaagtctgaaatcaagtcaacatactccctccaaaggccctagggaagaatttcctgttagctcttctagctgctggtggttgctggtaatcgttcgcacttatgtctgtggtagcgtaactccaacctttgcctctatttttacatcttccttctgtgtgtgtctgtgtccaaattctttctcctttttcttcttcttctcctccttcttcttctcctcctcctactccttctcctccttctctttctccatctccttctcttttctgtaatccaggctggagtgcagtgacacagtcatagctcactgtaacctcaaaatcctgagctcaaatgatcctcccccatcagcctcttgagtagctgggactacagcgatatgcaagcaggtctgactaatttattttttaaaaattttgtagaggcagagtattgctatgttgtccaggctggtcttcaactcctgggctcaggcaatcctcccgccctggcctcccaaaatgctgggattacaggtgtgaatcaccatgcccagcctaaatttctttcctcttataagaacaacagtcattggattggggcacattccaatccagcatgacctcaacttgactacacctgcaaaaaccctatttccaaataagacataaattttggaggagacactattcaacccagtacagtgatgttatctggtctcctggttttaaaaaccatccctatattattgactttcaaatgcataccttcaacccaaacatggcttctgtcttcctgtctgttgtctcatgccttctccacacctccattcacatgtcccacatctaccatgttaagaatgaactcttgttctgaaaccttggtccttccctttctccttaaatggcagcactttgcaaccagttgctcagaccaaaaattctggaggtatccttgatttccctttttttctacatcccaaatacaatttatcagcacatcactttggctctactttccaactatattcaaaatctagctacttctaaccacctccatccccacctttctaatccaagccatcatccactgtcaccaactacagagcctctgacctcatcttctaccattctcctcattgcactgtcctctgccaacttaacaatctgaatttaaaattgcaaaggcctggactgcttctgctgacacatttagggacttgctaagggttatgccattcagccccagccttaagataattctaaataaccaaataacttctctcagaggtttcttttcttgatactgctcatgtttttggaattgctttcttctattcattcattatcaattcacatgtattgagggcttcctgtgtgccaaacaccctcctgggctctaggaaaataaggttagataagaagtagtctgtactctgcaggctttcctaatctaatagaaaaacggtcaggtaaacagtgtgtgctctatgcacagggggctttcttcttgagccccagataaggggacacctaaaccagccccataagatattcagaagataactctaaccctgcacaggaggcttaggggtctggttgaggtgtccccttcactggggctcaagaagaaagttcttacagattttgcccccttctcctcttgaatatcacccaatgtaccaaagaaagaaaaaaacagaaatacgactccatcttcagtggggctagaagatgcctaaacccctgaagcacaataagacacagaaaacagatgacacatggtatatgagctagcaaggaggagtaaagtcaaatccctgtggctgcaggtggtatcaaggaaaggaaaacctattggctacagaaaacctgggaaaaaatcactaatgggagacaccagatattgcagaaagcaaaagcaaggcagagggtcttgcgctgggattattgctgtgtgaggagtagtgagaccactctagggacccaccttctccttcctcaataaggccatcatacctccccagtcttgcaggggcccaggagtttgttctggagttacagaattatgaaataagtgaaccagggaagctccaaaatgggaccatcaaatggcacaggaaaatcaaacccttccccactcagccccagacaccagcagctgggctccccacaggagatgggagaagccgtctcaggagagaccaaatgaccccagagaaaagaccaacaaatactggcatttggtaatctcaatagaagtagctggctggccactttttcaagataccccagcccacaagcccacccatgcacttccaatgagaaatacccaagaataatcaagtattcaagaaaaacctcaaagataatagggaaaaaaatgaacaaggagagagaaaaagaactcatggagaaaagtagcaattgtagaaagcaaaacaattcaaagaaattacaatgaatagcttcagaaagataacagaagatattacattcatgaaataaaaaaagaatgcaatactttaaaaaataaagaggaacaaagaacaaattttatatgatagtcaaaatgtaaaagtcggtagtagaattggtgctgaagtcaatgaaatctcctagaaagtaaaacaaaaggataaagtgagggataataacagagaatagataagaaaattagaggattagtccagaggatcaaaactgactattaggagaaatataaagaaagaactgaaaggaagaggaaattgtagcaaattgtattttccaaagatggctgtcacaatatcccctatcccacatacttttctagaatcttgccatgcccccatcaagaggtggttgtaatggatagtaggacaatacttttaaaacataggtgagttgcagggttcagtggctcacgcccgtaatcccagcactttgggaggccgaggcgggcagatcacctgaggtcaggagtttgagaccagcctgaccaacatggagaaactccatctctactaaaaatacaaacttagcagggcgtggtggagcatgtctataatcccagctactcaggaggctgaggcaggagaattgcttgaagccaggaggcagaggttgcagtgagtcgagatcacaccattgctctctagcctgggcaataagagcaaaactctgtctcaaaaaaaaaaaaaaaaaaaataggtgagttaaagctacattactttttaaagtcatatcagtatgaagactgactacatttgtggcctgcacacctcttaatattaaggagaattaagaattcttatctgaatcatccagttttgcaattcctttgcccttgaatcctcagaggcttttgtgactgtatattcaccagcacggtagaagggagactgtatgataggaaggtagccatcaaaggcaacattttttctgccgtgcttgcaggaagaattgccctagagtcctgagtcactacggaagctggctgtcactatggaaaaaggccgccatactgtgaggaagcccaaaagaggccttgtggagagatcacataggatgccctgagaagagagagatgtccaataagaccccagctgctccagtccccacggttccagatccagatgtcatctcactatgatctcatgacagagaaccacctagcaaagattttccaacatccatgagaggttataaagtgacggttatagttttaagtcacttaagttgggggtgatttgctacaatgttagcaatagctaaccagaatattgcctaagagataacagaacttcccagattgaaagatatgagtccccagactaaaaagacccactgagagagcctggcataattcgtggagaaaagacctactctagagcacatgtgaaatttcagaacaaagggagaaagtaaaaatccaaaagaaagaaaaagaaagagagagagagagagggagagagggagggagggagggaaggaaggaaggaagggagggagggagggagggagggaaataaaggaaggaaaagaaaagaaaagacattggtgagagggtgagagttacagaaagcagggaaatgatacagaagattaataattagtatggcactggacttctcaaaactaacagtaggggctgggcacagtggctcatgcctgcaatcccagcgctttgggaagctgataactggcggccaggagttcaaaatcagcatgggcaacatagtgagtcaccatcaccacaaaaaaaaaaaaagaaaaaaaattcaatggatcaatctttgcattcgggaggatatgctcccaagttaacacaacagaagtttatttctgctcacatagtagtcctggatggatgttcatgtaataggcaggcactcctctgtgagacccaagcttcttccaccttgaggcgcagccataccacaggccccctcctaacctttttggggccctggacccctttaactatctggcagaccctttctgataacatttttaaatccataaaacaaaacacatagtagtataaagcaaaacaattatatggacatataactatcaaaataaataaaaaccattgtgatatagtaataaatgtgtttctgtattaattgaataaatagtaagacaaaacatttaaaacataagtgcgtttaagctacgtttattttttaaagatatatcattgtgaagactgactacacttgtggcctgcacacctctcagtattgaagagggctaagaattcttatctgacggcctggtacggtggctcatgcctgtaatcttagcactgtaggaggccaaggcaggtggatcatgaggtcaggagttcgagaccagcctggccaacatggcaaaaccccatctctactaaaaatacaaaaattagccaggcatggtggcgcatacctgtaatctcagctactcgggaggctgaggcaggagaattgcgtgaacccaggaggcagaggttgcagtgagccaagatcgcaccattgcactccagcctgggtgacagagcaagattccatctccgaaaataaataaataaataattcttatttgaatcatccagttttgcaaacctctaacaaacaatgcatctacctccacatattaattgaccaacaattggaggcaaggactactggaaagcaacatagattgcgagcaaatgtgacttccacatttggtggtggaatgcctcccctgctcagcatcggccagttgtgtggcacagctgtctatcaacaggaagactgcaattatgtgcagtctagtggcaggtctaataactgccgcggtttctaagtagtgatgaatgtaatgatattttgagctatctgcaacaactgtaatgtgatatgaaaatatctgtgatttctactggtgacaaagtcacagatactgctaacaccactgtggtttattgtctacatttataatagaaagaaatgctcaactagtttaaggtcaggaaaaataaagatgtacttttcccatccaagttcatagatttccctgaatttagggtctgtggaccacaggttatgatgtttcctctggagtcttcttgtcatatctgcagccagccagtaaaacaggaaagagcacagaaaactgcacagatgaagtctttatggacctgtcctgaaattgacacatatcatttccactcacattccactggggaaagtttagccctgtggctacacctccctgcaaggaaagctgagaaatataaccttactttcatgctgaggaagaagaaataacagatttggatgcccagccagcagtctctcttccacggtcagtggtgtgtgtagccttcttgccacatgtagaagacatccagtccctttccaagggagtcaaagcaaaaccccatctagcctctgcattcagctcagtgtccagaacttctaggtgatgtacagtcctttccaacaagtctgatggaatttctcttggtccacagacttacgaactgtgctctactccccatccctgcacacacccaaaatataggataattgcaattaagattgggagacacaggcagtgccttgtccataacaatgatggaaccctgccagacaaacattgtgaagaccctctgccctggcaatagagggggttactgcattagaccctgtatcctttctctgggaggagtctccttgccttccatggcccctgctctgccctctgggaaattctcccttgtctattatctcctgtggccagatctgaaggagttattagtagtatcccccttttgggagttcccactgcttttgtagcacttttggttcatggaagcttgagggtccacgtgtttttctgaactttttaaagaccatctttgtgatttcttgagaaatgcaatttcttcctgcaaaaagatttctgatctatttgcttcccattggttacatgcaccacttaccacttccaaaattccctatacatggttcttaaatctgtttgagttcttttttgcttttttagctccatgccaatccccatttgttaaatatcagctactgtaaggccatctgtagcaagaggattattagagagacaatatccttaacctgatctttgctgcaggaataagtcctttggtttaactgagaagacttcgttggtctttatggctcaaatacttattcagtgttaccacctcctctgtggggtctggaaactgtttcttcaacccttgatctctgcttacaaatagcccagttctttcttgagctctttttttcctactgacaacctgctaagtgaattaaataactggcaacaaaccccacccacctttctccaacctctttcactataggtagagacccagtaggagattaaatgttctcaggtatctaaatgctttcctcctagctcatcaggcctatctgtttatatctgttttctcaccaccttttcccagccaatgccatttattttaatttttgtaatggcatcaccctacttctagaatcaatttctgtgctagagtacagttaggctgctaacaaatagacctcaaaatttcagtggcttaaaacaacagttgcttatttttagcccacataaattactgggtgggctgttccatgtgtgatcattcaagaactgatgctccttgcatctcatggctctacaaatccctagaacttcatttttattgtctccatttgtattgccagaagggggaaagcatggaggaaaaactcaggaagttttgaatgggctaagtctggagttttaaaatttccattaaacgaaacttgatcacatggctaagttttattgcaaaggaagctgggaagtatagtctgactgtgtgcccaagattttggtggacagctggtaccatctgcatggttattttcaacctagaattttatacccagccaatttatcaatcacatataagcatggtcaaaagacattttcagacatgtaaaatctaaaaaatatatcttccattaaccctttctcagaaagctattagaggatgggctacacccaaaagaggaattgaggcaaaaaagaagacaacatgcagaacagaaaacagggaacaacaatcgtgtaggcccagagagccttcagtccatattagggcagaagtttggagagaagtttggagctttctccaggaaaaaaagaaaagtagaactgataacttacatgacaatatgacagagtggaaaattgtaataaggtgtgttttgtataaagttgttgaagaatgaggagattttagtcagaatatcaaagaaaactaatttagtcataaaatgagataattactaaatctagcaaaataaataattttataataaacgagatttaatcataaaatactgtgtagctcagcagtgaacaatctttacatgatcattaaattgaaaacagtgatgatgggcttaaccaaaaattgagatgtaattaaaagaggtttagataaggagtgtaaatagctaaactcttcataataagatatatattagtcaggatgggctaagttattcaatagtaagaagtccaaaatctaaatggcaaaatatgcttttgtcttacacaacactgctcacatggatgctcaggggctttgctccatgtgatcattcagggattcagtcagcagctccaccagcttgtagcaataccctctggaacacatggcatccttggtcccatggcaggacacagagaatggagaaggatgcatgagtttttaccatctctcctcttataatttcacttgccaaaaacagtcatatgttcctgttgaacaggcaggggcttgacagtacagtcttccatgtgctctgaaggggaggaagactggtaatatttgccaagggaagtttataaaatcacctaaaatgaataaatcaagagacagcattatatacacattcttttaaaatatggaagtaagtaccagaacatgttgaaaagctaaaagaaaaaagtgaaaaatgttgaaaatgtttctggtgagcctggcaagtaaccagcatggggagtgaagcaggccagggaacaggagaccactgggttttgctgtaaactcttttagcatcatttcacttttgaaactatctgcatgtattgtttttattaagttttatataacttattttttaagttacttgaaaaataaaaactggaagtaggaagactatcacaaacatacccccagtaaccccatctgggatcataattgaggtcaaccttagacgaccagtcagcagtttccagaattcccaccctccctgggctacttggtcaagctctttcccagggtctctcactgctcatgattccagagacttgaatttgcttagagcaactaggcgttgtcttacagcctcttgcccttctcgattctctcatactaatgtttaccttacatgcctcaatgcaaagagtcttctccttgtgaagacaaatgcaaaacaccagttgaaaacttccgttctccctattagctattcgtaaaaccccatcggtctgaggcttttcaactcgttctgacactttcttctctttaacttttttttgaaaactttagttaaggtagggatctgacctgcgggcacttggtttcctcctttgtgtccttgttacgcactcttctcaccaaggtttataaatgtcctttgaacatcagagaattccgggaatcttgctatgccagtcttcctcctgcccctcttccacacacaatggccagagagagtttcaatgatgtgcctgtcatcatggtgtccttgataactctcctttgtctccttagcaaaataagctaggccctttacaacctctccctacccactttccacccacctggctgcctgccccaggctccctgtgcgccagccaccaggaatctcgggcctctattttggctcctgcggggctccctgcctggaatgcccgtcctctccctgctggatgcgtctctcagatccagaagcctccccaaactcccagcagctgtggggtaagggaaaggggtccattaaaatggacagtgagttcaacactctcttagtgattctaacattgggaaatttactccgcttctcagaacctcaatttttcagctgatgcattaggattggtctgaattatctttaacatctctttcaggtctcatactgctccctcccacccccaccacaaaattacactgaattggaatgaatgtttgtttgtttgtttgagacagggacttactctgtcacccaggctggagtccagtgatgcgatcatggctcattgcagccccaacctcctgggctcaatcaatccccccatgtcagcctcccaagtagctgggactacaggcatgcaccaccacactcagctaatttttgtatttttttgtagagacggggtttcacagtattgcccaagctggtcttgaactcctgggctcaagtgatccactcaccttagcctcccaaagtgctgggattacaggtgtgagccactacacccagctggaatttaatttttaagagcacagattctgaagctagagctgaattgcctgggttcaaatcccatctcaaccgcttactagctacctgaccttgagcaagttactaagcctccctatttaatgggaaatagtaatggtcattgtctcataagattattgtgagaattaagtgatatctacacatatgttgtgatgcatatgaagtgcttagagtagctctgataagctgttattattatcattattctacactgccaaactgagcaattggaggaacaaggccatatcccctttctttctaaacccccagtgcctaggactttgcccagcatggaaaacaaaaatctccactttttccctagtgaaagaaggagagaactgggagaagcctgcattgcatcctatgagtcaggcttcaagagctctgcccagcctcctagactgtcttccctttcagaatgtcactccatcaagtcatatctggccttctgctcaacatttagaagacttgagggtagagctgagagggactgcattggtggggggtaggggacagagcttgttttaagcttgctcaggcctagtccttagctctgaaacctctacaggcataaaaatctgtgaatttaagagaccgaaaaaagacatctctggggctgggagtggtagcacaccgaggagctctcggaaggccaagccatgtacccctctttggggagactcggggaggactgctcctccccataaaatatacaaaaagctggtggcttcttcactccaggtcttcctcagagatgaaggacaccaggatgggcgaggtggggaggagagagtccctgcacccaccatggtcagcctgaaaagcattacccactcatggggtgataaaagctgcagctgctaagaaccacagaagtctgggttagaaccaaggagaaggagcaataaggggaaaaatagtagggctggggaattggttagcaaagaccccaaagacaggagaagggacaggtctcgggaaaagctgggtcaggagagcactccaaactaagacactgctgcccatttgtatctatcacagattatttaataaagagctgccaaagttactgcaatttcattgctaatgtactgatgcctcgcagttctgcatcttaacctcattgctggggctccagaggccccctacccaccccgcctcccagcccaatgtccccctgcagccactggggcggagcgtctcattttgctagaatgtcatccatttatcaaaggacaggattagccccctcctccacattcagcaggcagagccttcctctttctaatttcaacttggcaacagcttaggttattaacctactgaaatatcctccagggtctccctctcacaccacactgcttccccccatgttttcccagcattcactccctgactctttttctctagggctatggtacttaaactttttccatctttagatctttgtatatggataaaagatatctctctcctcactcatgtctgatgctagaggggctagagggggatgtcattaatggtattaatggtgagctgagctgaggggatgctctccaggacaagggggaagactgtgatgccacttttgacaagaggtcggaaggcaagctgataaggtgaaaggagctttgaactaggatcaggagacctgggttcaggacccaactctgtcactcactcaactttcgaccttgggcaagtcaacttctcttctgtgggcctcagtttccctatgtctgaaatgagagcaaggataagaaccaggggttcgaggactcaggaacccccaggggtcaggtggatcactcaaacgagcaaattggccagtataagacaatagggagtgatagggaaattggagcgtacgtgtccaaactgaaagcaatcaaattttttaaattaagatttcaccaaacaaaagagatctgctggacaaattaaacccatgatcaccagtttgtggcccctggaaagccctctgaggtccctttccattgtagcgttctacaatataatcatttatgtgaacagggcccatcttaaaagtactataagtagatatggtgtgaattcaggacataggtctcttgcccaccccacccccagcccctaacctatgcctgatttactatctgaaatgtctttaaaaggtgtggtagtgttcagatatgtccaggaattattcagtactcctttcttcaaaacataagacctgattcccctccccttgtgtgtgggttggacttagtgacttgcctttaacagataaattatgttggaagtcacaagtatgtgacttgtaagaccaagtcataaaaggcattgtggctgcctccaccgcctcctcctcctcctcctcctcctcctcctcctcttcttcttcctcctcctcctcctcttcctcctctctctttctctctttctcactcactcgctcgctcacagaaaccagctgccacgaggtgaggacttaaagtaaccctgtggaaaggcccacatgggagaaacggaggcctcctgccaacactccctgtgagggagccatcttggaaatggatcctccagcctctaccaagcctatagccctaaccaacatcttgcttgcaacctagtgagaaactctcaaccagaatgacccagctaagtcattctcaaattcctgacccactgaaactgtgatataataactatttgttattttaagctgctaaatttgggagtaatttgttacacagcaatagataataaatacattaagaaacaaacttcccattccacaataacagataagacttaaatccacattccccagggaaagaaaaagatctcaagtgggcactgaaagttaggagaaactgggaaggaggtggttgttacatgggctgaagacaagctttgctggctttataatttgcaacaaaccaacactgaaattataataagtaaattaattgttagaaactaggtgctgagctatattaaaaatcataactcaggtgcacctaattcagcctttctgctggacaccttaactcagatgctccaatgtcgctgcaaccttaatccatccaattctcagcccagcttttcccccaaaagtctccatgcctcagaaagacaccaccatccacctagggcatacacaacctccatctccaacttcaaaaactgcagatttggagcgtacgtgtccaaactgaaagcaatcaaattttttaaatttgatttaaaaaatcagacaagaactgaactgcagatttcactccccaattttttttttcttttttgagatggagtcttgctctgttgcccaggctggagtgcaatggtgcgatctcactcactgcaacctccgcctcccaggttcaagcaattctcctgtctcagcccctcaagtagctgcaattacaggcacatgccgccacacccagatttttttttttttttttttgtattttagtagagacaggggtttcaccatgttgcccaggctagtctcgaacttctgagctcagtcaatccacccgcctcggcctcccaaaattctaggattacaggcgtgagccaccacacccagcccacctcaaatattttac

SEQ ID NO: 662 - DNA, 9850 bp, Human
  misc_feature (1)...(9850): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaccaacagccgcaaacacgcccagctcccacccgagacagcacccgcacccacagcacccagctcggagatggcacctgcacccacagagcccggctcccacccaatacggcacccgcacccacagcacccagctcggagatggcacctgcacccacagcgcccggctcccacccaatacggcacccgcaccacagcacccagctccgagatggcacctgcacccacagcgcccggctcccacccaatacggcacccgcacccatagcacccagctccgagatggcacctgcacccacagcgcccggttcccacccaatacggcacccgcacccacagcacccagctccgaggtggaacctgcacccacagcgcccggctcccacccaatacggcacccgcacccactgcatccagctccgaggtggaacctgcacccacagcgcctggctcccacccaatacggcacccgtacccacagcacccagctccgaggtggaacctgcacccacagcatccggctcccacccaacacggcacccgcacccacagcatccagctccgagatggcacctgcacccacagtgcccggctcccacccaagacgacacccgcaccggcacccagagtgcccagatctaagatggcactggcacccacagtgcctggctcccacccaagatggcacccgcacctgtgcccacagcacccagctccgaggtggaacctgcacccacagcgtccggctcccacccaatacggcacccgcacccacagcatccagctccgagatggcacctgcacccagagtgcccagatctaagatggcactggcacccacagtgcctggctcccacccaagatggcacccgcacctgtgcccacagcacccagctccgaggtggaacctgcacccacagcgcccggctcccacccaaaacggtacccacacctgcacccgcacccacggtgtctggctcgcacctgagacggcacccgctcccacagccacccgcatactcagcaccaccagcctcaggacgggtgggaagcccaagcatccgtcctcccagcattaggctctttttttaaaattgagaaaaattcacataacataaaattcaccatttttacttttttttttttgagacagagtctctgtcacccaggctgaagtacagtggcactatctcggctcactgcaacctccgcctcccgggttcaagtgattatcctgcctcagcctcccgagtagctgggactgcagatgtgcgccaccacgcccagctaatttttgtatttttagcagggacgggggtttcaccgtgttggccaggctggtctcaaactcctgacctcaggtgatccacccaccccgtcctcccaaagtgctgggattacaggcgtgagctgccatgcccggctaagaaattgggactgtggccggtgtggggatcgagtccacaactgtggcatcgtcagcatcatgcgctcaccagttgagctagctgactgcccggacactttcatcaccccgaagagaaacccacgcccaccaggagttgccccctagctccgggaaccagtctcacggcatctctgtggagcggcctattcccaacacttcaatcactgcaatcacacatgaccctctacatttggcttttctccctgggcacaatgtcttcaagctccatccatggtgcagcctgcctcagagtctccttcttgtctttttagagccaggggtctcactctgtcaccaggctggagtgaagtgccacaatcatggctcactgctgactccaactcctgggttcgagggatcctccggccccagcctctcgaggagctgggactacaggggtgtgccaccatgcccagatcatttttaagatacttttgtagacatggggtctcactatgttgcccaggctggtcttgaactcctgggatcaagtggactcccaaagtgctgggattacaggtatgagccacacccagcctgtcctttgtggttgaatacaacttcaccctatggatacacgaggcgtttctgccggcatccactgagaggtgcgggctgtttcccatgtggccttttgtaacagtgctgctgcaagaacagctctttcagaagcagcttcaggggatgacagccctgagccccacctgcacaccatctgtcttcctgatgtgtgttctggaggtattctcgcctgcttatagccgaaatgtctcctggcaagcacagccccggggagcagagcaaactgcggcgtctcaccggctgccagcacccttgaccttttgggaggtcagaacatcagggctctctcaagcatcctccacaacctagacggggcctccgttgatggagaggcggagctcagtgagcccctcccaggtgtccatctgccatctcctgtctgccccaggctagacctggtccacagggaagataaagcaagaatgagttaagctgcagatggttaagcttaaaatgagttaagctgcagatggtaacagggattgattctggaaggactgtgcctcccggcaggacctgagactcggcactccccccagccaagcagccaggcctctcaggctgtactctggggagcccctgcctcactgcccctgaccccagcaggagctggcttctaccaaacctcaggattactagcaagagggaacacccgggtgcaggcacttctgcttctctgcgttatgcattttattcatcaccactacaaaaaaaaaaaaaaaaattcccagcagacccaaaaaagtatacacagaccctggcagaacctccgtgccaggacagagatggcagtgcccagctggcctcatatggagcctgtggctggccagtgcaaaggctgggcagtactgggggccccaatgtgcccacggaggggaggagcaggacttgaggcccaccaaaggctgccatagtgttctaagtggcccctacttgggggagaagggcacagagggagtgtggtgatacgcgtagcactgaaagggttaaaggcaaggagggctggtggacaggtggaggtagggtccttggagagggtcactcaggacgctctcaaaggagcaccccacaaggttagggccacaaggaggcaggcactgctctgacacagccgcgtctagtgagcagatgaacgagaaggattaactgctcatccctgaagacagcacggcatgcaagcggcccacaggaagggagcccaccggaaggcggcccacttgaggcgacggccgagctccttccgatcgcttcacacgattcaaagattgaggccaaaccggggatgccctgggtggtcatctgctgagcccaggagactgggagggctggggagaccagaagcagaggggaagggatggggagggaggtgaggatggtcccggaagagagagggcagcaaggaagtgccacaagatgccccagacccagcacaggcgcagacctggccgccggcttgaaatcacaggcaccaggaagtttcccccaatgccaaatgtgggcacagccggaatgcaaatgtggctggagacagctctgtgggtgagctgagccgaggctggcttcacaaccacacccaggggttcccacgaatggctctggctcaacacagtgggaaggtgaaggagacagaaagcactgtcagtcatggctttgccaagcccattcttccctgtggtttagaaaacagaactacattattctcttcccagcccaacctttccaacctggagagaagttgcagggatagcagagcaaacacccattcacttcgccgaggttccctggcggtgtgctttgccacaatcgcttcaccactctttctgtgatgtataggtacacccacatgcactcacacgcatccgtacatgcacacagacacacaggcacttatgcatccgtgcacacacacaggcactcacacgcatctgtgcacgcacacagacgcacagacacgcatccgtgcatgcacacacacaggcactcatacgcatccgtgcacgcagacacagaggcactcaacgcatccgtgcacgcacacaggcactcacgcatccgtgcacgcacacacaggcactcacacatccatgcacgcacacgaacaggcactcacacatctgtgcacgtgcacacacacaggcaactcgtacgcatccatgcacgcacagacacaggcattcacatgtatccgtgcatgcacacacactggcactcacatgtatttgtgcatacacacacgtactcacacgcatccatgcacgcacaccagcactcacgtatccgtgcacgcacacacagtgacacatgtaccagtgcacgcacactcacacgtatccgtgcatgcacacacaccggcactcacacgtatccatgcatgcacacagacacacaggcacttttttcagccccttgagactcaactgcagacatcagacaatgtgatgctgcccctgcccccaatactgcagctgtgtcctaagagcaaggaccttctctgcctcatcacgcctccattgtgacacacaggaaggttaccacagacgcatcctcctctcatcaacagcacacaccatgctcctgaatggcccgacgatgccattgacaagctcctccctgatccaggttctcatcaagggtcccgctgtgttgcgttggcacgtggctttagtctctctcattttaggaaaacaaatcagcattccacctattggaagactgctccataagcacttgagacaaataagtgatacacgggcttaaccgtgagcgacaaggaactggcgcctgccagctcccagaggactctcacccttcctctggggcgctgggcatctttagtcctttaacctagaagagcccctcacacttcggctttcacaacagtgacattttaaagatttgtgcctttttttactccagaaaatacaacgtgttcttatagtctgcgagtgacaagaacctgagagagagcgtgaatctcagagacagtgaaaaagactgggggagggaagagcctgggcctcggatgctctcagcccagggttggaggcagatctgtgcagatcgtcgtcctcatctgcgagggcaaacagcagctcagaccctgcccgagggtccccaaatgcttgactccgaatcccaaatggagcataaacagcatttcatgatgatttcagttaacactctgcttagtcagttaaaagatcatttctaccaaagcacggcccgagaccagcttggtgactgctcccaggaagaaggctggcggccctggctgagcccagggtgaggggagcagcacagcctccacctccccaccccggcctggtactcctacaaaccaagaggtcagagtatctgaaaggcaccccaggtggtaaaagttctgaactcctgggtaaccaagagactgcacaggaagctgggaccacagtggtggggaaggtccgagaaggaggcttcgatctctgaggagcaggggtgctgagccctggcatggggaggggccgctggagggtcatggggacagaaggccccacgccacctacgaagagagcttcaacccactggggccaccagggccccagagcaggtaccctccacctgctacctgtctgctggctgggggtcatcctggaggtgacaggcacccaatacccagggctgtgggaaggggctccaggccagatgccattttctcatcagggaagcgtgcatgtttgtacccggcacccgggattaaatcagtaagatgcaggctcatgaccacagacaatgaggtccgtgaggcccacgggacagcccggccccagagcaaggactgggggtgtgttcacctgctcagcagacagccccactctgacaccaatggccccttctcatacacccacctccaagcagaggacgctgggcgaagaggtcaggaaaaatgaaagaaaggcagagcctgccagacagcgtccgcccgcctgtgctcagagtgggaggcgtggcctctgggcgcaggtgtctgcaaaggttgaagaccccacggacttgggtcagcacctgccagagctctcccaggagggttagcctccttctcggacaggggccaggaattcaggaaatgccaggttcgggtggggacgtggagacggctgtgaggctgtggcccaagtggggcctggagcagatcgtctgctcttggcaccaaggtgaaactgacgagtgtgggcgtcaaacagggcaggagagttttccactggaccctgagaagtgctcaggtggccacaaggcatggacatagggacactgaggagagcccctcctgttccctgattacatgggtcaggccgggctgcgcaggaggaggtgaaggagcaggaagccggagggaatcaaggaacattgttgtggactgaggtggggcctgcgcaggtctcccaacgctgccctggggcactccagccatctgggaaaagggagtggcagcccttgggcaggtggaatgcagatggcccagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaaggccggggaggccggaagcagagggggagggggggatgatcacggacgagaggagaggcagcaaggaaatggaacaagatgccccagactctgcagaggcatagacctgcatgctccggcgcctccgtgccacgctggaggaggggaccggccacccacaaggccctacttggcgtgggaactgctccaattctcggctgcctcctggacagagctcggatggcagaatgtgagccacagcagctcgtggcggtgcgggatggtgcggagaaggcatccgacccccgcgctgagtctgccgggagctggacgtgagtccctcaaacagaggctcagggacggacgggcgctgctaccgagtggtcagggtgctctttttggccagtggacactgagggcacagaaacactcgtttcctggatatttctgttgcttccggaggcactggaactcttctcctttctctgctggtggaagaggggctctgtgcgagaggtcagctgctccaagctggctgtgagcatgcatcaccttccagagccttctgaagtagctatccacaactctcaattatcctggtggcttccagagcccaaaggcacctcgagagctcatcaccacccacctgggcagggctcgaacagagcgcactcatcacggggaaggacagatggccagggggctgacaggacatcttgctatcagagccccc

SEQ ID NO: 663 - DNA, 105045 bp, Human
  misc_feature (1)...(105045): n = A,T,C or G
ctaagtcttcaggaaaatgtctagtgacattaagatttgatcccaggactgtatttctcttttttattttatttatttattttatttattatcattattattattttttttgagacagagtctcactcttgtcacctgggctggagtgcagtggcccaatcttggctcgctgcaacctctgcctcctgggctcaagcgattctcatgcctcagcctcctgagtagctgggattacaggctcatgccaccatgccctgctaatttttgtatttttagtagagacagggtttcaccatgttggccaggctggtctcgaactcctgacctcaagtgatctgcccgcttcagccccccaatgtgctgggtttacaggcatgagccatcacacctggccctatatttttctgcttagctttccgcattgagagttttatgggcaaaagttcctactaccgttttttgtgctaaataaatgtggtaagactaaagagatgctatcatttggtgaaaaatggagaaatgaaaataactgtgcttttaggttcataaaaaatgttgacttctagattttagccagcaccttcccttttctctgaattccatatagatgttcattaccaaacaacacagactattgcagattcctgtgattttggccctgtagctgtattaaagacaagcattatgccattacgattatgctaaaaatgaagtccaagcacaattaattttttaatttcaggaaatgtttatcaatggcatatacaatgccagtaggattctagtatggtttgttggaggtaaaaggatatctgaaacagctggaaagttatacttttatgtacacttattccttttgcatgttatgtgattaactcaagcagaaattgaaattggtaatttcacattctgagactgtgtggaagggcagtatcccaggttttagccattagctgctggttgctttcttagtttgtcccgttttaatcttgccaagtcagttgtgtaagtggcttaaggggaaagccaagtgtaatatgaagtagcatcaagaccttgggtttccatctaggattctttaaatgaatcaaaagcagcttcaagggacatctgcacttatttgactctctgtagacattcccactgtgcacccaggggtctactatgtgtgcagcatctagaatcagctctccccttgtgagaggagagaggaggagctgagcatctcatggtgctttgccctaacctcaacagggaatgtgttcttcccagtttcactccatacctaaatgtacaacttcacttgttaaatacactcttcaaaaaatccacaagacagtcccagactttcatgttttgaaaccactggcttatttactggaaaagtctcacatttttcaggctgcaaatatctataagtaaagtcgataaatgctgacataaacttgtgtaatcactgtctgtggcagagcagctgtacatagagggccttctgtagatgattttgtcattgaatgaagctcagctgatgtgaaaatcatcagttccagtttcaaccccttggaattagcagcaaaattcagacccgtaattcagagcccatctggacagaagtgtgctggttccacacaagctctgcatctctgcccccgcagacaggctccccaggttggctttgatgctcccatcatcagcacaccctgactttggggatctcacagcttcttcagaagggttgctgtcaggcttgttttgctatttttttttttaaaggaaaggtgatgggggctttagaagggcttaaaagaagcacaggtacgtaacagaaggcatcgcttcctaccaaagcacatccagctttctagagactcactcaagtaactgattgtgagcgtggggtggcatccacattctacaaggaggctgttgctctttctccattgcgtggtcttgccttttccttatctgaattaagttcctccagaaataaaaatggccattcaaatcctaccctgtcaccagtatgtgacaggacctcatggctatgtttgacgctaatgcagtgaaacagacatttctgcattcttcctccttctcatatggaaatcaggagagtggccgtttaacttgccgtgttagaaagcacggaaaggaaagggaatagatggcgcagaatgcatggcccttacccatttgtccctctttaagtcggtgcttcccataaggacagacagaaggcacgctgtgcacacgcacacatctgggaggatgagagaggactccctgcctgtcaggtgtttatcgaggcccttccagggcagcactgtgcccagcgcagagggaggaactcgtagatgccaaggtgaatggctttgccctcaggctacttttagacacactcaaattcagatgtagcagcatctcatgttgtcattgctgctgtgatgggcataaggtgctccagaaacacagaagcaacaattcagatattaaagaaatcagggaaggcttttcagagttgatcacttaagatgatcgaggctttgacagatggagaagagggaagcctgttttccaccaagggaagccagtgtgtctgccgtgggctgtcgctgacacacggcgggtgttgggtaggtatttagggagggggttatggggaagggagaaaatgaagctggagacgttgggtccaggtgtggcagacctggaatttaaggctaaggggtttggtgtcattctgtcccaacctgggcccttcaacagtggccgtttcctctgcccttttcttcatcacactctcttcctcagctttcttcccttctagaaaactgtgcattctacaaccaaaattacatctcccttacattgcatcttctaaacatttcacccagtcttcaaaactttcccttttccttctcacgtgaactctaggatgcttgaaagcttaatatctgttttctgcattactgcagaagataataataaagaaatatgaatgtatcccacactgcagcagtgtttacactagccgggaattggagctgcctagcctcccgcctcagtggctgaatgaatcatgagagccacacagtggacgcgattcaggcattcacgagaatgtgatccctcccgttacaggcatggaaaagtgttcccaatctactgttaggtggacaaagcaagggacagagtgggaggtgggctatgaccacatctcggctgtttaaattatttctctcctgttgaggattcatagataagagcttgggaggaaatggacaaaaatgttaaacagggacagctctgagctagggagcttgagagtaaggggggaggggagaaggaagatttttattttgtattatgtttttctaggttgcttggatttttaaaaagagcatgtgttaactttataacaaaaactgatatttaaaaatacatagcattaaaaaaaattcccaaactttctcagttcacaacatcctcagggtttcagtaattagttttttcatggttcccctagatcaaaagaaatccctaacagttctgttcattgagtggttcagtccaaacaacttagtaaccgcttatgtcctaacagcttagcagcagctaagaaagataatacacataaacggaaagaaaactaatattttcttttccttcttccatgaccacattacgtacaatctgatgagtgctcccgttgggcactgcacttctgaaaccttggactcagagtggacacggcctcatttcctgtccacagtgatttcctcaagactcttggttcctctcagggcagctaccaaccccccgctgtgagagacatgatgtcatggaaggcagggtggtgcagtctaatgatgacactctgcacctcttcaagcgagtagttcacctggtctcagaaccatgtttcttatcaaaaactttagatattcctgggcacccctatgaattcagtacagttccctgggttaccttggcacacaatttgggaaccataggcacaaacaaggcttatgggcttgtcctggtattttcactaattaggatgtcttcaatatctgtcttccatgtcttcttccctggctgtgtctaaatttgaactatggtgcagatcttgctggaactctggaccttgagcccttgactcctgtctctttcaggccagcacagcaggaaacttacttaagttatctttgaagttgtattttgaagctcctcttttaattgcaaagtacttggaaaggttctgcctggctggcctgccccagtggagagcaagtttcaggagaagggagatggctccttcctcctttctggtgggccctgaccccttccttaaccttgtgtctccggaatgtcatcctcagcaactgcgtgagaagaacgacctttggccttttttctctcttcccagtatgggcgaacgcctctgcaccttgcggccaacaacggaatcctagacgtggtccggtatctctgtctgatgggagccagcgttgaggcgctgaccacggtgagtgcccacagggcttcgtgaaggagggagctgctgggagcctctggcgcctccagggcaggagggacagggcttgtatggcaactctgcattctgaagcagccaggctgctgttcagccatagctcctccactgcggtaacatagacattcgcctacacatgcccagcctaatgtctccttaatgttcgtcctcttctcatctcaccacaccctgctctgccagggattccgctgcttcccgctggcctttttgtttttcatgtcacacaccagggcccctgcatggtggggtgtgtgtacttccccttcctaaatgctcctctgccccagggtgctggagcccctgccctttagaaggagctgggggaggaagaatcctcagtgggtgttgggtgcagtctccacatttaccccacaagaccaggctgccaggtgccgtaagcaggagttgcttaaagagtcaggcattgctttaggcctgtggagtattttaagtgagatttcttcagttctctcactccctgctcccgatgccagacctagcacctccctgctgaggaaaccctttgattcacatttcatgaaatacccaagaaggaaaatgcatcagctaatgaggtatggttgcaattttatggctgcagtgaaataatatcattcgagtgtttgctggcctgagagtaggctgactgtccagtctttgtgggacagtcctggactcacagatgagagctttactgacagagggtgattctctgaggagaccaagagggcctcatttcctggagatcatccagaggttagcaaaccatggcccacgggccatatcccgctgctggtctttgtaaatgaagtcttattgggacacagccatgcccaaggtttgtattggccctggcggcttccacgccaggtgtcagagctgagcagctgtgacagagaccatatgggccacagagccgaaacacctacttgcctggcccttgacggaaaatgtttgctgaccgctggggctaggatgtcgcctccccgaatgcactcatgttactgggatgtcattccctccccagaagtaataggtctgatctgtgcagtggggggcccagctctgtgctttctctgcaggcccagttattaccagtactccgcatggggtgaggcccctttctagggcacctggtcacccaccgcaaacgcacacaccatacccacatcaccctgctgtgcctgacttgctagatcttgttggccattgtcaagccctgcccagccatgcttgggcacaggttccagttactccctaatagagcatttatatgcattttcaagacgaagaaatatttttgtcctatgtgtggcctcatgaaagacccagccaggccattattgaagatgccagcagctgacgctgctgattcccgcagtgcgggttggggctgctgaaatgtgcggccccctctgtagggtccctccgtgagccgcgggcccctctgcccttgcccacgacatctgtatcagtggtccccgcctggctcctcctcaggtccctccgtgcacctccttgctctcccgcttgccaccgcaggaaaagcgtcttctgtccccaggcccctcccacggtgcccagagctaacctcagagccgcacccgcagcgctcattctgcagccccctcagtcactctgcacacaccgcacccgcagtcactccgcacacaccgggggcacagtgagagcggggagtccagagggacaagacaggcacgcgcccctcaggagacttctggaaatgggagagggatgctgacctgagagtcatagccgtcaattacagtcactgaatgggaccgcgtggtgacaggaaggagtgggtcctgagggcgtggacaggggctgggggcgcccctgcgggaggcattgctggaacctgcaggccaggccccgtcctcagccggacagagtcccgggaggatctccctgccctgttcaggaccggagctcagcggcctccagtgccctcctgcggtgggagcacaatgtctggagctggcgtggaggcccaggagatgggagggtgagcagagcttggtgggcccggccttccccgcagggaaccggggcttcctctcccgtgggcagccaggggagggttccgcagggccggggagaccctccagactggagggcattactgggggcgtcgccctcagaaacgtgaccacaccacatccctcggtttaagtttcctagcagccacatggaagaaggaaaaagaaacaggaaatgaatttcaataatatattagcacaagatatgcaaatattatcatacctgtcaataaatttattgattgatttattatttgtatatattcatagggtacaagtgcaattttctccactggtatattacactggggtgaagtcagggtcttcagtgtgtccatcactggagcaaagcacattgtacccatcaaacaaactcccatcctccacgcgcttccctccccttcacccctccaagtccccgttgtccatcattccacactcttcttccctgtgtacacatcatttagtgcccactttaagtgacagcatgtgatatttggttttctgtgtctcagttgtttcacttagcataacggcctccatttccatccatgttgctacaaaggacatgatttccttctcttttttctttattttttatttttttgtttttgtttctgttttttgagacagagtctcgctcttcgccaggctggaatgcagtgaggcaatctcggctcactgcaacctctgcctcccaggttcaagtgattctcctgcctcagcctcccaagtagctgggactacaggtgcaagccaccatgcccatttttgtatttttagtagagacggggtttcaccatgttggccaggatggtctggatctcctgaccttgtgatctgcccaccttggcctcccaaagtgctgggattacaggcgtgagccaccacgcccaggctgatttccttttcttaatggccaagtagtattccattgtgtatatataccacaatttttaagtccagtcctctgtcggtggacacttagtttgattccctacctttgctactgtgagtagtcctgcagtgaacatacaagtgcaggtatgtttttgacataatgatttattttccttcaggtagatacccagtagtagggttgctggaatgaatgggagttctatttttagtcatttgagaagttgctgtgcgtaatttctctatgttttccatagaggttgtactaatttacatacccaccaacaatgtataaaagttcccctttctctgcatcctctccaacatctgttattttttgactttttaataatggccattctgattggtgttaaggtgatactcattgtggttttaacttgcatgtctctgatgattggtgatgttgaacatgcttttcatgtttgtgggctttctgtcttcttttgaaaaatgtctcttcatgtccttagcccacttttaagtgggattattttggggtttttgttgttcttgttgagttgtttgagttcctggtacattctggatgttagttccctgtcgaatgtagagtttgcgaatattttctctcattctgcaagttgtctgttcactctgttgattatttcttttgctgtgcagaagcttttagtttaagtcctgttcgtctatttttagttatgttccgtatgcttttgaggtcttagtcatgaattatttgcctagacccatgtttagaaagttttccctgagttttccttcagtatttttataatttaagatcttccatttaagtctttaatctatcttgagttgacttctgcaaatggtgagagagaaggatacagtttcatttttctgcaaatagatatccaactttcccaacactctttattgaaaagggtgtcctttttccagtgtatgttcttatcagttttgtcagagaacagttggctgtaagcatgtggctatatgtttctgggttccctattctgttctattccattatctgtttttatgtgggtaccatgctgttttggttgctatagccatctagtgtaatttgaaattaggcaatatgatgtctccagctttgctctttttgcttaggattgctttggctatttaggaccttttgtggtttcatatgaactttagagttgttatttctaattctgtgaaaaatgaggtgagtattttgatggagattgcattgaatctgtagattgtttcaggcagtatggtcattttaacaatattaattcttcccatccgtgagcacaggatgtttttccatttgtttgtgtcatctataatttgtttcattagtgttttttagtttgccttgtagagatctttcacctccttggttaaatatattcctagttttttttttttttttttttttttttggtagctattgtaaatgggattgccttcctgatttggggctggatcgtcattggtatataggaactctaatgatttctgtatgttaattttgtattctgaaattttactgaattaatttattaactcagaattttttggtgacatcctcagggttttctagatataaaatcatatcatcagtgaacagggataatttgacttcctcttttccaatttggatgcctctattcctcttgcctagttgatctggcgaggacttccagtattcttaaattattgagatttttcacattctttggtttatacaaagctttccttctgtgccctcacagcgcatccttactccccaggtttcaagctgagtcaaggcctagggaggggcctctggtcttcctggaaggcccagcacctacgccttcctcctaccctccagaagcaattccatcctcctctccttcagaaccacccttgaccaccagcgccccctgctgccaccttccctctccgctgagtcctcagccagggggacctgaacaagtctgcacgtcctgtccccactttgtccttgcctcccctactcctgcaccctccactgtcttgccttccgttccacgtaaccctcagcagagtccccactcacctcctgacagctttccttctaaactgtcttactataaaagaaagcatagatagaaaaaagcacataaaccaatataaagcttagtgggtttccataagacaaacacctttgaattccacgcaggtcaagaatagaactttcccagccaccccaaagcccccatgaacctggcccagctgttgcctccgctcccgcccactgtgagcccctccctgatttgaagccagctcttccttttgcttccttgttatctttccacccaagccccagctgctgcccctaagcctctttcactggatatccccaggactgggcacccttggcacgccctgacaatcctgcctgggctgagaaagtccccgcgtcctgcttctccctaggcctctgcttcctgctggtccatcttctccctctccatccccctggccctctctggcccccagacttgcagctgtccaacactgaggcccatgctcaggtctctggtccctgcttgcccctgagtgccagcctcacacagcaccttcagaggccctcggcccccccacaccagggtccctccctccagttctgtgcttcctcctccccagtgttcagcctctgcaaagggcttccgcatctgtctgtcactctgcccaggatcatggaaacccttcttactctctcctcacctatttgcatctagccggcagcctactaagtctcctcccacttctccatgaccacgaagcacccgcctctccagcccccacctggttaagggcgtcacccttaaccttagtctcctccagaccagtcggactcttcacccacccctgcactgtagcctcctgccccttgggaccagtccatcccagccccacgtttatctttctagaaatgccagccactcagtgggctccactttcacctccacctggggctcctctgccttcaggatgtgaactctgcagcctctgcccagcctccccttcccctcttctccccttcagttgtggctgggtcctgggaagcccctgccggctcccccatcatggagttgtcacctgctgttctttcaccctggagctcccctttcccccttcaccccctgcgcatagtgtacccacagcatcagcacacacaggcacacatctctctgcccacttctgccctgagggtacctgatggcgctctgccttcagagagagacttggaatgcccgctacgggcatgtgggcacacagcccataacattcggggaagactccgtggcacccactcctcctcatccatcaacattcacctccagcccaggaaacctcctctgttccagcctctccggtgtgtgtgatttgcccctgtgggctggtagtcccttcgccttccttgctctattggaatcgtatccggatttctcctagcaggagtgagcccttgggcaggaatcactgggaattcattgctgcctcctaagtgggctccctgcttccacccttacctgtccacagcctggtccccacgcagccgcctggtcagacgtaagtgagatctcatcctccttgctcagatgctctagcaacttctcatgggaatcagagcccttcaaatgggggcttccccaaggatctgcccctgacattgcctccctgacccccatctcctgttccgcctcctcccgtctccctccacatcagccccatgagcttccttgatgttcttcaaaagtgctggccatccaccgcccgggggcctttgcacttgctattcttgggcctgagtggctcttccccaggtatccatgtgatttggtctctcaccttctgcaggttttgactcgagcttcaccttctcagggaggcctttctggaccaccctattttaaatcctatccctcccccacccccaggactgcccctcatctcccctgccccatttttcttcatagcacctatcaccacctgacctactgtattttactcacctatttgtttcttgttggctctccccactagattctggatcccatgaaaatagggacttttgttggttttattcactgctgtatccatagccctgtgcataatacgcactcagtaaatacctgctagatgaaagtatgaaggaaggaaggaaaaaatgaatggcaccatagtccaggcaggacatggagtgtttgttgaccgagtgctaagtagatgagcccttataattctgtaggttaacaaaaaatccatattttccccaacactatctaaagatgtttaaatgactgtgcacattctttcagatcatcttttcactggggatacacaaataggtttccctgtcaatgcttgccccagttgaaaccccatctgttcctttgcgaagcatattacacgtgtcactagaagtcatgactgtgagcatttccccagacgtcaataagcagcatgtctgtgaagggcaggctcctaaaactggctggcctgtggggctccggcttcttgaacacaataagtgaagtggcctttcacctttccatggatttctttctatgtcatggggccaacttgggaatcactgcccacagtctagaatgtagtgttgtgggctgctggtgcacaagagacaccgtgatttctggacccaactcacccttctgcagccacttggtccccagggctcacgttgagatgatggacagctgagtgctgagacacttggccatctttctatatcttttcaatgcatgcacttcattgagtccatgagccctgttggtaaggaggagggcagcaagtgtaagtgttgcttttgcagcctccgtcggggtgtccagtagagccaagaccaaaatgcagagatctgacttctgcccctttccctctcagacagaaggccaggtagttagggcaattctcagctcttctgtgaataatttccaacactgcttgcttcttctgtgcctggcactgtgctggttctttccatttggttttctctcacctgctcaagaacctgtgcagggagggtgccattttccatcttgcagatgaggaaacccaggcttgggaaggctgagtgacccaccacatagccggtgaggggtgggttcaggacttcaaactgggtcttctcccaacttcaaactgtctcctgcactgccaggcatttctgttgaaagtctgaatagtgtcctttagagcaacatgttttgcaagctgtaaagtgcagtgcaaatgtgaggaaacatttttattttatatatatatatgtttttgtttttgttttttttttttttgagatggagtctcattctgtcacccaggctggagtgcagtggcacgatcttggctcactgcaacctctgcctcccaggttcaagcgattcttatgtctcagcctcctgagtatctggaattacaggcatgcaccaccacacctggctgatttttgtatttttagtaaagacggggtttcaccatgttgggcaggctggtctcaaacttctgacctcagatgatccacccacctcagcctcccaaaatgctaggattacaggcatgagccaccatgcctggctgtgaggaagtattgttgatggtggttctcttgactttgaagaggttgaacagtggagagttcatcctgtcggtgaaaggcctctgcctgtgttttgtgcgcgtctgagctctgcaagaggaacgtcctgttcagacgtgtcgggggcaggaaacttcagtcaaggctcagatttcttctaactagggcagtggttcccaaaccttgctgcataatagaattaacctgggagcccaggatgtaccccatactgctgacagcagtgtctgtgtgggagctgggcgacaggatattttcaagttttacaggtgattccagagtgtaatggagaaccccttctctttatggacttttcttgtgtccacaaaaaaactagagcatttggcatggatccctggttggagatgcagtgtctgataaggcacctaattcacccccaaagcaagcttgaagccctggcctgcccactgggggatatttcaggaatttaaaggaacagagagacgggcagttctgactgcacagcaagcctccactggagcagccacctgggcttcaaccggcagcctaaggcagtggttctcagcaaggcaattttgcctccacccccagcaattgccaatgcctatttggttgtcacaactgggagttagggggtgctactgccacctagtgtgtagaaaccagagatgctactaaaattcctaagaggcacaagacaggcccagcaacagagaattgcctggtgcaaaatgtcagtgttggcaagattgagcaacagtgtctgaatgggaccccaggcatgactctgggagtgacttgggttgaggaattgagaggttgctgttaagtagatttcggatatccctaagcttctacaaggatgcaactttgttattgatacacattgatagataaaccaaatccttacttttttattaaaaaaaaacattcattttcatttttttaaattgcttttcatcttttctacttttgaatttttagtgatctctaaaactgcaacagaacagcccctacatgtcccttttctccccagtggcaggggaacagtgacagcttctgcctctcaggggtgacttcaaggactgaggcttgcagagagcactgagagctgggtcgagcacatattatgaggtggtgttcaataaatacttgctgtcatcgtgtatgttcatggtgtagatacagaaacaaatttattcagtgtgaaactgcagcctatgaaaaatctctaaataaaaagcaagcataaaagtgctgtggactcttatttccttgttttctgttcaccaaaagatctttcaatcaaaattgcctgtcaaactaagtatttcctttgaaatgcacagtaattaccaggagctggtatcatgcaagggctgggtttgtccctgtaaggattataacacagtagcttgcactaactagaatttggcacctaatgagaatctttactgtctgcctgattggagattggagagaggggttcaggacagggaggaaccagccagctgaggaggctgttgagttgtgattaaacctgtggacctgaaaggtgtcgctattggacaggaagacaccaacatgtgctttgttcctgcgtcttaccttcctgtcctggacaatcaagtgaaataaggattgcacagccagagaaacacaccgagacgtgctctttgtccacctggcttgcttctcacacctgctatgcttgtttctgcctcagacccacggaattggcgtatggaacacacacagctctccttttcagagaaaagaaactaatgcatttttctccaacaggacggaaagacggcagaagatcttgctagatcggaacagcacgagcacgtagcaggtctccttgcaagacttcgaaaggtgagaagttctgttataggtctgaagttctctacctgtgtttatgtgaaaaagtctcagtctttttccttatttgagaatgagcaaaatgaggctctagacagccaggttttaggaacagtggtccctgtcctgtggtttacatgtcagtcggtataaatgcatcagctccctatctgttttcttctctatttggacttggaaatcatttagcatgtttgcagttgccgtgcctggttttccttctcccactctctctataataaaccactcccacaaagtagcgggggatgaggacgctgactctgcctctttccttcttatgtttgagctccaagatggctgttaagctcctatttatcaaacattgttgctctgaggcttaaagaaacatgacaaaaataagtaaaggcaggtgcaccctttccagcctacaacatgacagttgtgtcaggagacttcacaatagccataccctttaatctaggaactctgttttatgcttaaagatgttcactgcagtattatttataatacagtaataaaaattggaaacacagataacccacgataatgtctagtaaagggtcctacagccatagaatagaatggctttggccttttaaatattttaagaagttttactaataggagtttattgcttggggtgggggggtcactgggcttcaaagcagaagacagattgtatataggtaataatctctactatgttaaaatccatagaaagaaaatgatacaagtgatgtttttcgattttgctattatactcaacattttcttctttaaacattagtgtattttaaaaaatttaattactgtattttttttaaaatgttataacaatgttacgtaatcatttttttaaaaaccacaaactatctagaaataaaatgataattcatttggtttaagtgcttgctgagaagataatgtccaaaatatgctccagatatcccacaaagttcttgccatatagaccgagaagtgcctggggagaagtgctgaggtcataaccttcacagcccctgaagtttatattttcatacatgtcctgtggtcttgccaggggcaggggggggccacagattgggataatttctttcctcatgcagaatatagacttggagagacacacttcataaatgcatattaaaaccccttggagttgacctggcaggggtaaaatcatgggtgattgattttcacacccttctgctttggattctgagaactggcctcagaggcactgagcagatgttaataaactctgagagctgcgattcagtctcccctttgtcctggaaagtccagaaagagacaagtcaggtaaaatttccctagccttactcaccttttcttaccagaaattcataaattaccattatgggctcagtgatttctcactctgtaccattatggactgtgtcattatgccagcgaatttggactagaaactcaagggaaaccttttcgtttacaggcaaaacaagcaggggcaagggagatcccgtgagtcgtggttaccattcaagaatgagccttttcatagagtttcctaagtttaaaattcactgtctttcaagcagaggaccagccaaaccagacacgttgggcacagaatctcacgcctctaggctggtgtacatccattacccaggcagcatccattgatagtgaaaggagaagagaagtctggtttttgcacaggctaaaagagcacaatttctttttcctgttagttattaggtctctattacggtccactagtaggaagaaacactattaaggaaggctgaaaggcttcttcgacaggcctcatagctttaccgagtgcataagcctgcttggtcaggtgcgctcaggtttccacacagagaggctgcaaacccacctgcagcacctggcacctggcttgcatccctgagtccccatgctgtgccctcccaggtgtatgatgccctggctcagctcacacagcgccagcacttccaccactaccgccctctggaaatccgcttaccacattcactctcaacttcgagtgctgtttaccatctaagaaactgtattacagagcaggggccagggggacctgcagtcagctcattgtgaggcggacactcagctgcagcaaggtgacctgcaacaccctgtcaggtcactcgggaaacccacctcatgcagagggaggaggcgtctcgtgggctgtgctgtgttctgctgcccatgcccccttagcaatggtcccttctttgacttaaaagtagcttactgtgcgagatgcaaacccactgtttggacgagtctgaaaacagtgaaggaatgctcagaaaaaggaccgagggagagcagtgttgcactagccggggatggtcggatcggtggtgggtggaaggtccttctcccgtcctctgtccccgttatctgcagcctgcttagatgactggcatagtgaggagtagagatgcaaagcaccttgctgcggcgcttcctccaaatcctcagtgaaaggggcttgttcccatttagaattctgagtttctgggggtgggctctcaccctgtctcagtttgggattttcttttcttctatccattggtacctttgtttttggtgcctagatttttaaaagagatgggaagtgaactattacagctataaaatacaaaatacaaaaatataaaatatattttatagtttataaaatagaaaaaactataaaatacaaaatattattttgtgttttaccattatcctgtggtctttttctctaaaggagaggtcaaggaaaagaatagtcaccttttttttctttgtttttttttgagatgaggtcttgctctgcggctcaggctggagtgcagtggcatagtcagggctcactgcagcgtcaaactcctgggctccggtgatcctcttgcctcagcctcccaagtagctaggactacaggcacgtcagacacgtgtctccacacccacctggctaatttttaacatttgtattagcaactatgtctcaatacattgcccaggctgtctctaactcctggcttttagtgatcttcctactctggcctcccaaagcagtgggattacaggcgtgagccactgcacctggtcagaatagtcatcttaatgccctaattaaaggacaacatcccccttagcacccagagtccagtgaaaagtcccccctcatctttatgtagaagcaaagtacagagtagtgcctaagagcagagactggaggtcagatggcctgggatccaactccagctccgccacgctctagctaggtgagctagcaagctgttcaacagctctgtgcctcagtgtccccgcttgtcaaatggttgagtcagctgctacctcccacgaccgtgataagggttggatgggtcgatgtagatgatgtcccttgcacactgcctgcacacagtaagcaccacgtgtttcctgttattgttggaaccccgcagaccactctggaacagctgtgaggtgcagcagtggcccctgtggctgggcaccctgagtgtcatttgtgatgacagccaccattgagcgctcagtgtgtgtggtgggcactgtgattttacaacacacagtttgtaaaggtttacagaggggaatgttgctgcaggaaacctggattcaaagaggtgagcaacatactaatcagtgcagacctgaggtcctgacctgacctggaaatacctgtgatctgcttttaatcaatgggctcggggggctccagggcagattcctggccagatgggatatgtcctttccacactggctgctgtacctgtgctgagccacctgctttgtagtgcacagggatctccttcccatggggaggcccagggttctaattccctcagaatcttctagatgctgtgttcaaggagtccctggaatttgtttgtcttcatcatccctcagtgggctcttgacgttagcccctgattagccataatgggaggagttgtctgccaagcattgctaattgcggtctttcttccttgtgtatgaatataaatccccatgcaagtaactgcttggcacctgggcacacccggtactggaatttggttattggaaatgactgagctgtcgcggcagcttccttggagaatgcatcgctgaggattgtggggagcccagaagcaggcaatgcctgtggaggacaccaggaaggggactgacctgcagttctaacttgggtcacctggaggaggagacaatcgggtacatgatcggggaggggaagggaaagaagaagtcattcaccctgcagagcatcttaggaccattttcctttccatgtcatttctccttgatattccccagtgtttctcactgggtgctgttggcagtttgggtgactgggaggccctgtccttgcaggatgtttcttgtccctggcctccaagcatctaacatgctagcattccctacagccatattgtgaaaaccaaaagaatccctccacacattttctctcaacccctagggtgctaccacactctgcaagaaccactgcaggttgatccaaagcgctgtcctggggagaggtctgtatctgggacagctgaggatggtggccctacattgcctgccattttatttggtttccaaatgggccaattgagcaaaagaaatactttctatctacgctgtcagctttcatcagttgacattgcctagcaatgtgtctttaaactatatttgctagggaagcaatgggatttggcatctggaaatagaaccaaaatcatcctgtttgcccgcagcagtggaagatgtgcaggggagagggactggctgttttgatcactggagagttcaaggggcaggagactgaagactgctgaggccaaggctacagctcttggggaagaaggaacctggggcagggctgagctgcatgggatcgactctgacgcacctccacattaagtgaactcgggcagtagtgtgcaggagcctctggtgctgtccctgagcgccgagcttgttttcccaacctggtgacatcacatgggagtcttgaaatcagccagggagggagcatttgcaccacaggaatcagcaaatgctagagatgaagtctgcttctccctaccaaaggttgttgataggttcatcattgctttgggggtccctgagagcccgcgcttggctgtaggtaccaccttatcacagagggaagttgtaccttctacttccttgcgctcagtcagtaacagagccctgggcagctgtccaaacctgcctgaggactgtgttgttgctcagccaaacccagttctccttctagaagaaaggagggaccccttctatgggaaaggggttgatctagatttttatatcagcacccatttttactataatcactgcaagttccattcttatctgattttaaaataagaatttcaagggggttgaggagttggcttatttttattttgtttggccatccttctaatcagattttccgtaagcctgaaattaaaagtaggctgggtgcggtggctcacgcctgtaatcccagcactttgggaggctgaggcaggcagatcacctgaggtcagtagttgaaaaccagcctggccaacatggtgaaaccccgtctctacaaaaaaaattaaaattaaaattaaaataaattagccagagatggtggtgtgtgcctgtagtcccagctactcgggaggctgaggcagtagaatcgcttgaacccaggaggtggaggttgcagtgcactgagatcatgccactgcattccagcctgggtgacagagtaagactctgtctcaaaaaaaaaaaaaaaaaaaaaaaagtagtttgcttttactaaacctaagacccaacagtgaagaaaggtggccaggaatattttgaaaaatgaaaacaattggggagttgcccagattgaaaaattcaccacctgtaaactgcatttgcgtaattaaaagttgctgcaccatccgtgcagtctcactgcaccctgccacatgggcaaggccacatcgcctctcagtgctcttatctggccttcccagaccgtgaatggtcttccccatcagcttgctaatgtttagtcttcttgtctgatgagaaagtgaaagctaagttgctagggagaaaacagtactggaagaaagaaaagtagaaactaggagatttaccagggcttcaaagagcaacacagttaccaaataacattcattcactcacacactgaaaagatatttccagtgtctactgtaagagctgttctaggcactgcagagaccacagtgaacaaaatcggcagaacccagccaagaaaccgataagaaaaatgtgtaagtcaggtcaaggggtggcaaacaatggcctacaacccactgcctgcttctgtaaataaagttttattgagacacagctacacactcttgtctgtgcctggtgttcctacatggcagagttgagttgccacagagaccatctggccctctacagaaagggttgctgcctcctggggtaggtgccatgcagggaattgaaacaggatgaagtgagatgagaggatggtggagtctactttcacctggctgatgaggacctctctgatgtgacactgaaaccaagacctgaagggcaagaagaaggaagcagcccgaggaagggctggaggaagacagaggaatagggagtgcaaggggccgggtagtgaagggttggaggagctcaagcataaaacaacaaagaaggagggtaactgggctagggtcagaggatgtacctgggtgtgcaggcagagaacaatgcccgacatgacccgagaggcggcacagctctatagaccttacccagcgggtgaggagtttgggtttgggccaagtgcaggcaggtgtgagatctgccttaggtttaggaattctcccggctgctcagactggagcctcagggtcaggatggggagcagagggacctgataggaggtgatcttggcagccaggggagatgtgacggtgcttggactggggctgtccaggctctattacttagtgagccttgggcaagaataccagggaggctcctactcctgtgtaaatatttaaaggatgtgattagagctaatacaggtaaatacattctaccctacacacacacacacacacacacacacacacacacacacacacacacacacacacacacacccttatgaccacctggaaggttctgagtcagaattctgcgctccttggagttcggttctgcctcctcctctccccagcctggtctcgccctgactgcaggaggtcttgcccacaccctggatgccccaggtctcctgagtaccctccagccacacccacagacctaggggacacacactggagagcacttcaaaccatgagccaaaaatgtcggtggcaccatagtcccctctcctctcccctagaggtgttggctgcacatggctcccacctggcccagccagggagggcccgaccagcctgggcttcgtgccagccaggtctcagggttgtcttgtaacttgtgttaaacacacactgtgtaaggactactgaactccccctccaaataaatcagtcttcctagcaccttctagacctggcctggagccctctctgagttggagatagatcattacgtggatgaaagctgctttcccagggagaggcctctgcgccacaacccgtccctacccgccatctggtagtgaaacgtgaaaacgtgcctccaccaatgagggagatatattcggatgtgcttagattccccaaggttcttagtgagcaggacgaggggtcatctgccaggatcagctgagattttcttgtgaagggaaatacccgaggatattttgcttttctttgcctttcaagatgatggtgaattctgtaagtctagatcagcgcagtttcctggcctctcttcccaaagacttggtgaagggtgagtgggcacatcttggccaaggctgacagctcctggtggaggggaagggggtgcaccaaggacaggtgcactccaatatttcactccaaagggtgccctattcaggaagtgccttccgagtgggatgcactgtgaggggccctccttggatggtcctcagtgctgtggggttcaccttcaatgtgcacatccctgtctgttcctgtctcctctgcttctgaggaacctgccacctccctttcagtgtccagcagtgggaggaagacctggtagtgagttctggctttgctctgtcaccttgggcaagtgccttggcctctccaagcctcaatttcctcatccgaaagggaggaggatggcattaaccacaaaggttccttggaggttttcatagggaatgtgagtgaaggcatagcatgagctggaaggcgccgtgcacgtggaagttactgctgcagacaggaaacacatctgtctcaactcctcctgctgcctcctccctccttctccatttattgtgctggcccatgaaacaggcagattgccaggagcttctgaaccagcattgccctgcgtggaatttgaaggagtgagctggactgtcagtacagggaagtcacaggcatagcttgccctcatacacaggagcaagtcagcctgcaggttcagtcgcttctagaagcctctcacaggggcagcggtgtctgtagttgaccatggttcgagtctcctgagagtggaagggcctgtgggattcctgcagaaggaatgagcttgccccattcctgcagacaggacagacgtgtgtgctgaagctcaaagtgtcaagatccacaggcacaaaacaggaagaaagagctgcaggcagattcatggcacagtttctttaccaaaatgggggcacccgggatccagtgactggatttaaccaggagcagttttctgccttcccctggtctcagatgaagcagactcgggccggtaccaagaatctctgtgtggcaggagctgcgttcagggaatagatggggaagtttgcatctaccctgtgggatgctcaccatggaaggtgaccactgctcagcacagtggacgcagctcaggtgctcatgcatggcatggtgtgggtatagccttggactcacaaggaagacccagggctgctgcggaaggctggagtaggctgggaggtggaattgctccagggtcggtggcagcgcggcagcatgggcgcacctggtgcacgtggcgctggggacaattcagagccccattccttccagcctgacaggtgccacccccaatgagtaactcctcataatagaatctgtccagcttttttgctgattcaggtaatcagtcagggacattgctatcaagacccccagtcctttcctttccctttggtgctctgtctctgaacctgttgggatttgaggtcagaagaaaacaccagagtacagaccacctcgtgttctacagatcatggtttggtgccgtggcctccaccccagctgccccagcattttacaacacaccttgtgtcacgctcccttgtagaatttatagacagggacgcacctactacacagatagtttcaaaagatcagtagcatgccctaactgtaatataacacagaccttgtgggagcatgcgcatagtgaaatatgctggatgtcagcatgcatgtgctaggacacaggcaggaggaggctgggaaacccagcaggtccctgcactcacgcacaggatcactgagtgcaacccccacagacgcccacggacactggagggctgggatggcagctccagcaccacagcagcgtgctgagctgatgtccagaaatcggagacagcactcagcaaagataaaaggaaaaaagcaaagtgtagttatttgccaatctataaaatagcagcattcgtggataactcagtatatattaaatactgcccccaaaaccctgtggatgatgtgtaaaatgtagttaagttctcagctcagatgattgtaaacaggcttttcccctatataaatgctcatcagatgctcagaagtcaggggacccaggagaattcttcgctgtgaggggcattttgttacagggtgtctggacacccagcgtctggctgcaggaatatcccctcaacattgtgggaactaaaatgccacctcagatttccacagtgcccaccaggggtcagtatagttcctgttgaggaagtctggtcctggcttaggaattgcaaatggaaataggaaaatcaaagccttcaggagagttatgtatgagattgtagcaatgcagttataacagcaaaagtaacactggcttttgctgctggaagagatcaggagatcagaagtaagtgagcgcctcccaggatttagaactgaaggaatggtcccgccaggtgtagatcacatggaggtgcccttgcgtgggtccctctgagttctgtcatttatatgacactggtttatggcgattctacacctgccagggctgggaattccgtctgtccccgcagatgggctcctggtctagaagggagagcaccccataattacaggtcgggggtcaccatggagagccacacatggtgggaagaagcaaccaggaggagatggcaggcaagacaggttttgtgggtttgtgggaacccacaaagcaggttaaagcagagggggtcctcctgggtaagggtgaggaagaggcttcaggctgcacctcacggctccaaacaggtccttgttagggagcagggcaggagtggtgggaagggatggtggcctgtgagggggtgtgacaccagggtggcatggtcagagccacatcacgtaaaccttgagcaggttcccttgggtgcactgaacgccttgcctacactatcctgttaaaagctcttacttggtattagatgtgaaattgttcacatgtctgtatctccccaagaccatggatctgggctgaatctagattttcctgttgtccgcactgcgcttagcatggggttggagggcctccctaaatgctggttgatgaatgaaggagtgagtgagtagcgaactatttcattctgtggagcctcctgcttctccatatcagatggaaaaagaagaaagtaatgaggatattgtgttcccagccccctctgcagcatggagcttgtacgttggagtgccccttctctcatcctcttgtcccattactgccctaaaggatccagacacctccacacagagagggacagatgctcttgctggtcagacagggctgatcctatttcatgattaaatcgaaggcttctacctttcttcatctcctggctttccattttctttcagcctcttaattgattagggtaaatttttgattatcctttttattttatgtgtttagtaatatattaatattttaaaatttatttatttatttatttatttatttttcttttgagacggagtctcactttgtcacccaggctggagtgcagtggcgtgatctccgctcactgcaagctccacctccgaggttcacaccattctcctgcctcagcctcccgagtagctgggactacaggctcccgccaccacgcccggctaattttttgtattttcggtagagacggggtttcaccatgttagccaggatggtctccatctcctgaccctggtgatccatgtgcctcagcctcccaaagtgctgggattacaggcgtgagccaccgcacccgatttgttgtaggtctgttcctaggcttcttaggttgtcatgtggttgaaaccaaaagtgatggtagatatttttaatactcacatacaggtgacattgccatgaagttaaatcaaaagtgctagtagctatttaacagtaagataaggttcctattccagacctacagttatgaagtggacatttgggccatccaattatgtttttctgataaatttctaaataaagtgtgggggtcacacacacacacacgcgcacacacacacacacacattgaaggcttcacagttgctccatccaacttgtcatgcatcaaaatgcaatggaaataggcagattcttagagacagaaaacatctctatggttgccaggggctgagcaaagaggggaatgaatggcaagtgactgctcacgggtacagagcttccttttgggggtgacacaaatgttctggaaggagacagcagtgatggtcctgcagcactgaaaatacactaaaagcctctgaatttcacagttgaaaatggtgactttgatgttatgtgaattttacctgaattttcaaagttttcattggagatagaaataaacataccgccaggcacggtggctcacacctgtaatcccagcactttgggaggccaaggcgggcggatcacctgaggtcgggagttcgagaccagcctaaccaacatggaaaaaccctgtctctactaaaaacacaaaattagctgggcatggtggctcatgcctgtaatcccagctactcgggaggctgaggcaggagaatcgcttgaacccagaaggcagaggttgcggtgagctgagatcgtgccattgcactccagtctgggcaacaagagtgaaactccgtctcaaaaaagaaaaaaagaaacatatcttcagcatgggtaaaaactgcacaccggggattaggaatcttgagaatcattatttgcctctttttctgtcactcactggctctttctcatccatgctcaggatacgcaccgaggactcttcatccagcagctccgacccacacagaacctgcagccaagaattaagctcaagctgtttggccactcgggatccgggaaaaccacccttgtagaatctctcaagtgtgggctgctgaggagctttttcagaaggcgtcggcccagactgtcttccaccaactccagcaggttcccaccttcacccctggcttctaagcccacaggtaggaacctccatgctggccccgtctctccagcaggtgttggcttccgcactctctcctttcaaggtctaggggggaagggagttgtgtttgggtcacttggcctatactggaccctgtggccttagtggttttcaggtccaggttggctggtagccttgtgtgtgctgcctgttgtccagcagtaacagactgacttggcagtagcaaaacaagggcctcactgaaatcacagccacagacacaaaggtccatcctcataaatgtgcaaactgcagaatttgcacagtcagctttggggacacagttgcaaattgcattgcattctactcagggctctggccttagagacaaaaagagctcaaactcaaacagtccaagcatagcacagatccaatagcagcccaagaagggtcctcaacccttatccttctttctggagtgctacaggcagacccagtattgtagatacatagagcaacaaaaagggatttccaggaagcaccatcctgctcagttcaaggttggatagaggtttccagaggctccttagtggttttcagggatggtctctctggtcacatccaccctccttgggaacgtttgctgccttccgggccttccacagacagggttattgattcacattagggggctgtcacgaaacacctggcagtgagcaagagaaaatgatgcaatcttgggtgtgattccaactgaatcctcctttagacagagcgagtgagtttgtggaaagataagagaccttccaagagtttcctaaaccaggacagttttgtgctttgtgccttgattcattctctgtatatgatgtcacagaagagccaggtctgttccccaggttgatgctaaagtttgtgtttctcttacgtcccctcagtgagggaggacgctggggagcatgggtagctgcggagagttggctgagatttatattcccttttcaacttctgttctctgaacacagctatagaattgaaatgaggagaagaaagaataaccaaaacagagttataattcatattattatattgctgatacatatgtcaatatttatagagtactgtgtgccaggaactggaagaaatatggtctgaaggacgcctcatttaatccaagtgacagcttccgaggtgtttttaccgctatttccctgcagccttgaggggtcagttggcttctctgaggcgcacaggtggcaaatcccagaacatctggtgcctgagccagtgcttgtcaataacaccctgcataaggaattcacaggcacacctttccattttccagtgtgatttttttgttttttgtctttgcatattaagttaaatgttattacaaaagagtcaaaactttaaaaaatttaaaagtagataatggaaaaaatgtgacagaaggttaagattaatttattattaaagaaaaaaatttattttatttatttttttttttttttgagatggagtctcgctctgttgcccaggctggagtgcagtggtgtgatctcggctcactgcaacctccgcctcctgggttcaagtgattctcctgcctcagcctcccaggtggctgggactacaggtgcatgccaccacaccaggctaacttttgtatttttagtagagacgaggtttcaccatattggccaggctggtctcagactcctgaccttgtgatccacctgcctcggcctcccaaagtgctgggattacaggcgtgagccaccgcacctggcctccagtgtgatttctgctctagttgaggatttaagtggggttcagttgctcccttagagggaggcagcacgctcctgctgtggttaagggcactgcagcctgaacctctgtggttaggagggtgggatatgagagagagagagaggtcatgagctcatgatctggaaagtttgcaaggcctaagtgggtgtgcagatgatgcccaggagcccccattgtggagtcctgggagtcacctgtggctctgcccttggcctcagaggtgaggtatccatggccttgcttctcctcagtatctgtgtctggtctttgcagcaggttcctggtgaagggtggctctgggtgaccctttttctgcacgccccaccatggggggagcatctttagccagggatcggggagggggtcctggcgcgggggcagaagcccctctgcatgagagccctaaggtgcaggcacaccagctgctttcagcccagccgtggggtctggggaggaggcagctgtcctggtccctgggcccccacagtcagtgccgcctgcccctggtggaggaagtgtgcgctggtggttgcccctgaagcctggtggctgagggatccctgggcaggaggcatagctcggcagctggacttggaggtggatgagacagacaagatgcccccatccctggactgggcgggtcaccaggcacttgctgccctcacagcttgtacatcagcatcagacagcgcccgggaaatgcagagcagggcacaagcacagggcaccgcgagggcggcctggggagattggactttggcagagggtatgtgtgttgggggccaacggagcagcgtggctttgttagacacccgaggaactgccgctcctgagcatgcctccagggactgggcctggttcctgaagcagcaacactgtcacctgccagggggcactgctcgtgcctggcaggccgtgctggggtctctttcaggccagggctctggacaccagtgacctctcctagaattgtcaggcccttttcccttcaatgagagagatgcctacatggcaacatttatatcatcagacagcaagaagtttgcttttagaattttggcccttttccactgccgttctcttgagaacgctggaggccaaggctgagctcccagccaggagaccggacggggtcccctcgaagttttctgttgcacacatcactcagctgtggggacactgagggttgtggctgttgagctgtgggaaggaaaacatccaaggtcataggaggcatgaatgtccaggaagagtatttgaagaagccattcctgttcccgcggagaggagcctgcgggaggaattcccggtgaccaggtaaagtgggtctcctgggagccgtcacgttacaccgccagggggcagtagctaacaaaaatgatttcctgggatttcggtgcttccccatgaaattattgttttcataacaccttgtacaaagcctgtcctaaccttttatcctcccaacgaaaactgtcaccgaggagcaggaatgactgccatttaccaacgtctgctctcattaagcacagggccacatgccactaaaagaaggcttgttcctgacaggcaggcacccagacacaaattccaggtcacagggaagtggacagacccattcttgggcaacccagcagcttttgcaggctgggattaacaatatgcagagaaatacactaaaatggcagctatgttgacatcaagacttacatcattttgcttttgttttctatttacattcctatctgccaactttcctacagaaatagaatatgtgttggtgtttttaagaataaatcttgccctcctagtgccctttctcctttccctgtacctaatcctgcccttaggatccacttttcttctcctcatcccctccgttggatacccccattatccatgtccaaagtcttaactctttggtctttaagtaagggattaccttggtgtttggatcgcctgttttaaagtcagatacccaggtgaaatggtcacttctttagtgcctcgcaatgtctattgtattaatggtaaaccaatggtactgcagttaagatcaatgaatcccttctccaatgcaattcgttcaccaagttcttacagagcactctctgtgggccctgggtcacagccctgaccagaaaggcagcttctgcctgcacaagcctggtgggagagacggggagcagggcaggccagtgagtaactgagacagtgaggaagcacaggctctatgcctaaacgcaggggacccagactctgttattcagctcccgtacaacacccacaagttcaccattgtttacataatgtttcctttaaactgactcactttttaaaatgtactaaaatacattgatttgaaaatgaaagttaatatccctatcataaatgggaacccagtgtcactgccataagtaaaaataaatgcagtgaacagcaaccaatgtgaataaaatcccgctaaacgccaatgcccacaccctcttcattaaaagggaagatgagcaggtgttgaggaaatgctaaaatcggaaggcctcaagtggagactcgctgcaagaacaactgaaaggccttcaagggaatttcaaaaaggagtagctttcacagtgtgtgattcagcattatttaatgctatggcctgctactgtctgaaatcattttccatttaacctgcaataataatctcatgtgcaagagagagaagtcgctcagtgggagctggaggaagacagagactgcgagtatcagcaaagtagcaggaagtgagaagggaagaaacccgacctctgccctcccaccctctccacagcctcccgttggctgaccctaagcagaaatcacatggcaagccagcctagagacacaatccctaggaccagccacccgggcaacagggcggggcagaaaaggttgtggggaggtagagcaagcggaaaagcccacagccttgctgggaacactgctgccctgcacgtgtgagggcagacacactcagcctgaagccagagttggggtggggacagaggcgtgctccagaaaaggaaacctcagggccagcctgggagggagacaggcacacgctgcccccatcgagtactcatgtgatcctttccatcctgcagtctcagtgagcatcaacaacctgtacccaggctgcgagaacgtgagtgtgaggagccgcagcatgatgttcgagccgggtcttaccaaagggatgctggaggtgtttgtggccccgacccaccacccgcactgctcggccgatgaccagtccaccaaggccatcgacatccagaacgcttatttgaatggtatgccctgcctgccccaagggaaggacctcaggtttcccttcaacagggttgtaagtcatccctaaagggagcttgtcctgagctgtatctgtcacttccagaaggaaatccaacacagactgatattcagagtgagccaggactgaagcatggctggctaccatccctaaacagtgaaattaaacactggggtattgtcagcgcctagtaaagcacttggcatacagtaagtgcttgataaatgactgtggagtaaattaataatatttgtacatatttatggggtacgtgtgatatttcattgcgtgtatagaatgtgtatgtaatgatcaagtcacattatgtgaggtgtccgtcactttgagtttttatcatttctatgtgttgggaacatttcaagtcctctcttctagctattttgaaaaatacaacgcattgttaactatagtcaccctattctgctattgaacactggaatgtatttcttctatctaactgcatgtttgtacccattaaccaacctatcttcattcccctctccacacacacacacagccttcccagtctctggtatctatcattctactccctacctccataaaatcaacttttttagctcccacatgtgaatgagaacatgcagtatttatctttctgtgcctgggttatttgacttaacataatgacctccagttctatccatgttgctgcaaatgatgtgatttcattctgttttatgtctgtgcataaatagtgttctgttatgtgtataccacgttttctttattcatttgttccttgatggacacttaggtcaattccgtatctttgctattgtgaatagtgctgaagtaaacatgggcgtgcacgtatccctttgatatactgatttcctttcctttggaaaaatgcacagtagtggaattactagatcatatgttagctcaatttttagtctttttgagaaatctccatgctattttccataataactgtactaatttatatttctaccaacagtatataagaattctcttttctctgcatcattgccagcttctgctattttttttttgtctttttaataatagccattctgattggtgtaagagggtgtctcactgtggttttgatttgcatttcttggatgattagtgatattgaacatttttctcatttacctgttggccatttgtatgtcttcttttaagaaatttctatgcaggttcttgctcatttttgttttcctttctttttcaacttgtattttagattcaggggtccctgtgcagatttgttacctggtcatattgcatgatgctgaggtttagggtacaaatgatccctccctcccaccccctctagtagtccccagttactattgttgccatctttacatccatgagtaccgaatgtttagtacccccttataagtgagaacatgccatatttggttttctgttcctgtgttaattcacttaggataatagcctccagctccattcatgttgctgcaaaggacatgattttcttcttttttatggcttcatagtatttcatgatgtatatgtatcatattgtctttatccagtctgccattgatgggcgcctaggttgactccgtgtcgttgctgttgtgaatagtgctgcaatgaacatactagtgcatgtgtctttttggtggaacaatttgtttcctttcggatatatacccagaaatgggattgctgggtcaaacagtagttttaagttctttgagaaatctccaaacttctttccacagtggctgaacttatttacattcccacaacgtataggtgttctcttttcttcacgccctcaccagcatctcttgtttttttgtctttttagtaatagccattctgattggtgtgaaatggtatctcattgtggttttgatttgcatttctctgatgattagtgatgttgagctttttttcatatgtctgttggctacttgtatgtcttcttttgagaagtgtctgttcgtgtcctttgcccactttttaatggggttatttggtttttacttgttcaactctttaagttccttatagattctggatcttagattatgcctttttggatgcatagtttgtgaatatttcctcccattctgtaggttgtctgtttactctgttgacaatttcttttactgttcagaagctctttaattaggtcctacctgtcaatttttgtttttgttggcaattgtttttgaggacttagttataaattcttccccaaggtcagtatccaaaatggtgtttcctagattttcttctaggattcttatagttttgaggttttacatttacagctttaatttatcttgaattttttttttatatggtgaaaggtgggaatccagtttcattcttctgcatgtggcttaccagctatcccagcgccattgattgaatagggagtcctttctccattacttatttttgtcaactttgtcgcagattgggtggctgtaggtgtgcagctttatttctgggttatctattctgttccactggtctatgtgtctgtttttgtaccagtaccatgctgttttggttactgtagacctttgcccactttttgatgggattgtttgttattttactgttcagctgtttgagttccttgtatattctggatattaatcccttgtcacataaatagtttgcaaaatatctcccattctacaaattgtctcttcactctgttaattgtttcctttgctgtgcaaaaactgtttagtttaatacactctaagttgtctatttttgtttttattacctgtgcttttgaggttttatccacaatatctttgtaggaccaatgtcctgaagcctgtcctcttctactggttttataatttagggtatacatttaagtctttaatccatcttgagttgatttttgaatatggtgagagacaggggtccagtttcattcttctgcatatggatattctgttttcccagcagcgtttatttacaagggtgttcttttccccagtatgtgttcttattgcctctgtcaagttatttggctatgaatacctggatttatttctgagttttctattctgttccattggtctatgtgtctgtttttatatcaataccatgctgttttggttactatagccttgcagtgtattttgaagtcaagtagtgagatgcctctagctttgttctttacactcaggattgctttggctgtttggccactgttttgtttccatacaaattttccgattgtcttttctatttctgtgaaaaatgacattggtattttgatagggattgcattgaatctgtagattgccttgagtagtatgagcattttcacaatgttgattcttccaatatatgaccacagcatgtatttgcatttgtttgtgtcctctcagtgtctttcgtctgtgttttgtgcttttccttgtaggggtctttcacctctttggttaaatttattcctgagtattttatttttattgcagctattgtaaatggaaatgccctcttgatttctttctcagctagttcatttttgatgtatagaaaggctactgatttttgtaggttgattttgtatcctgcaactttacctatttaatatgaatttatttctcagatctaagagttttttggtggagtctttaggtttctgtagttataagaccatatcacttgcaaagagggacaatttgggtttctcttttctagtttatatgctttttatttctttccctttgcctgattgttctggctaagaattccagtactgtgttggataggagtgatgtagggggcattcttgtcttatttcagatcttaaaggaaaagcattcagcttttctctattcagtatgatgtcagctatgggttcatcatgtatgacctttattatgttgaggtatgggttcgtcatgtatggcctttattatgttgagatatgttccttctatacctagtttgttgacagcttttatcatgaagggatgttgaattttgtcaaatgctttttcggcatctgttgagattatgatatggcttttgttctttctgttgatgtggtgtattatgtcaactcatccttgcatccctgattgtggtgtatcatcttttttgtgtgctgttggatttggtttactagtatattgtgaggatttttgcatctgtgtttatcagggatcttggcctataatgatgatgatgttgttgttgttgtttttacattcttttctggttttgttatcatggcaatgctggtttcatggaataaattaaggagaactcctgccccttcagttttttttggaatagattgaggagaatcattagttcttctgacatccaaacctggacttctctttttggggaggctttttaataccagttcaatctcattactcattattggtctgctctagttttctatttctttctgattcaatctttgtaaattatctgtctaggaatttatccatttcctctagattttccagttagcgtatagttgttcataataacctctgatgatctttggtatttttgtggcatcagttgtaataccttacttttcatttctcattttgttcttttgggtcttctctctttttttctaggtcagtctagcaaatggtttagcaattttgtttatattataaaagaacaatttttcatttcatcagttctttgtatttttttagtatctgttttgtttagttcttctctgacctttattatttcttttctcctgctaaattgtggtttggcttgtttttgcttctctagttctttgaggtgcatcattcgattgtttatttgaaacgtttctgattttttgacgtaggtgtttattgttataaacttccttcttagcattgctttggctgtaggttttggtcttgtgctttgattttcatttgtttcaagaatttttttaaatttctcccctaatttctttcttgaccctgtggtcattcaggagcatgttgtttactttccatgtatttgtacagtttccaaagttcctcttgttatcaatttctagttttactgcactgtggtttgaggagatacttgatatgatttcaattttttttacatttgttgagacttttcatgtgtcctgatatatgttctatcctggagaatgttctgtgtgctgatgagaaaatgcgtattctgtagctgttggataaaatgttctgtaaatgtccgttaggtccacttggtctaacaggcagtttaaattcagtgtttctttgttaattttctgtctgtataatctgcctaatgctgaaagtggggtgttgaattccccaaatattgttgtattgaagtctatctgttcctatagatctaataatatttgctgtaaatatctgcatgctctggtgatggatacatatatgtttagaactgttatatcttcttgctgaattgatcccttttgcattatataatgaccttctttttttttttttgacttaaagtctgttttatctgatataagtacagcaactttcgctcacttttggtttccattttcatggaatatctttttgtatccctttactttcaatctatatgtatctttatagataaaatggatttcttgtcagcagcatatagttgggccatgttttattagtcaaacagccagtctgtatcttttaggtggaaaagttaattcatatacattcaaggttattgttaatatgtgagggtttattcctgtcattttattaattggttttttgttgtttcatatattctttattcctttctccttcattatcattgtggtttggtggctttctgtagttgtaatatttgagtcctttctcttccttaatatgtttcctctaccagtggatttatgctttcgtgtgttttcatgatgaaagaattgtcctttcacttccaggtgtagaactcctttaagcattgtttatagatttgatctagtgatgatcacttcccccagcttgtcttgtttttggggaagactttatttctccttcacttatgaagcataactttgctgtctgtagtatccttggctgacaatttccttctttcagttctttgaatatagcatttcattctctcctggccagtagaatttctgctgagaaatctgctgtgagtctgacgggcgttcccttgtaagtgactagacttttttttttttttttttttttttttttttttttttttctgttttcagacttccctttgtctttgacttttgacaattggactataatgtgccatggagaggaccttttttcgattgtatctgtttggagatctctacagcttcctgcatctggatttccaaatcttttgccaaacctggaaagtttttaacaattattttaataaatagattttttatctccttcagtttctctttacctttgggacaccaaaaacttgaatatttgattgctttatggtgtcccatatgtcacaagagttttgtttatttttttatttttatttttttaatgttgtctgattgggttattacaaaagacctgtcttcaatttctgaaattcttccttctgcttgatctagtctattgttgcagcttttgaataaattttctgttttattcaagaagttcttcaattctagaatttctattttgattctttggtaaacttctcataatattctgagttgtttttctgatatctttgtattgtttttctggattctcttgtacctcactgaacttgtttaatgtcatgattctgagtactttttttagattgcataggtttatttttcattagaatctgttgctggagagttattgtgctctttcggaggtgcaatatttccttgctttttcatgtttcttgtgtccttacattgatatctgtgcatccggtataatagtcacttctttgaactttttgaacttgctttcataggggagggcattttcctgaagatgtgtctatggtgttggttgagtagggcactttggctttgattctgggtgcatgcagtagcatagtggccatacgattttttttcagctgtaagcagctccagtggtgcctgtaattttctcagtggcttagggtatggttgttagtggaggctgtggtaaagtttttctggagatggggataccacgtgggccagtcctcagaacctagtggtggcagtggtgggctgagcatgcctgtccttgggccccagggtggtatatgctggtactgatactagtgggtccaggtaggttgattcttgggcctccaggcagcttgctcaagtgctggtagtagtagcagtgggccaggtgggtagtcaggttctcagttccctgggcagcaggcgtggtgtgagtgatggcagtagtcataatgagacagccctctggctcccaagcaatctgtgctgatgttggcagtggctgcaatgggctaggcaggccagtacctagccctgcaggtggcatatacaggtgagtgccagctgtgatgatagtggtaggttggatgggcgtgacctcaggccactaagaggagtgctcaggtgccagtggtggtggactgggctaggtgatccccaggtccccagacagcatattcaggctcttaggggattgtgaagtcaagctcagcaggcctgtcgtcaggtcccctggtggtgcatgtgatccccagcctctggcaaaatgcttgagtcagggaggcagtggctgcactgtggctctgctactgggaagagtggtcctgctttcactgtcagcagccatatgcggccagctggggagtgtatgatttgcacatactttagactcagtggacacagcagcagtggctgcagacaggggattctgtccttggggcagatgaaaatgcacagccactactctgctagggacagtggggtctctgtcaatgggttatgcctagaccttggtggcagctgccagccaaggtggtggctgcaggcagagatgtcagtggggctctagggatatagagatgccaaggccattgggctacagagcaggatgcagtctacgggtgtttggaacatacaaatggtgccgcactgtagctgcttcggactcagagagtgcgtgggagccagcctgagctccctctctggagcaatactgtcatgcagtctccaggcagctccctcagctaatctcagggcccacatgggtgaagggtccccctgcaccaggggcaaaaattgcgggagttcatggtctgtgtgcattttgctctcttaaaagttgggcttcctctgagctccccagagcagagctggctgtggcagcacagagagaagagaaacttgtcttgggaccccaggccctgctcccatctgatctctcacagccccagccgcaacccacctcaggaccccacactccaagagccaatttctgggtaccagaactttccatgcttggcctaagcagccagctttggagggtggtccctcctgcttcactacaagtctgagaaaaaccctttagatctcagagtgcatcttgactgcaggattttgggtacagagtaagcactgaggggtaaacgaggtgaagggagccttcaaatcctgtaatggaagtggccctggccaggccgccccagaggccagtggtgggcggccacagtcctggcaggatgtggcagtgtagagagggggcatctcaggtccactggaggttccgggagtcctgggagctccaggtggaatctaatctgcagatatttctggggaaatgggcagccttcacagctccagtatgggaaagcaattgcccccacatacaacctttgacccctgcttgacactttcctgcctgaaggaccccacctcctcccagatccaagcacctcctgtgtaggcagaactgctgagctctgcatctcacacccctgcatgcttcttgcttcttctgagcagcctggacagggccctcagtcacctggccaagtcagtccctgttgagccaaattcaggtgacttttcatagtcactgttacattcaatatcctataccctggcacgttccaaaattcatgtatatttattcaggacacaaaatcttttcacccaccttctctcaattaatcctctatgggactttgtgagtttgggaatcacaaacctaatgtgggcagtttgtccccggctccttccttgtcaggagtaaattctgcaagtgaaggtggagtgtctgtattaaggatatgtgagcctacaaccgtgtcattattattatggatgtggtgttcacacttctgcgtaatatgacctgatggatctttgttttttccccaggtggttctctcttttttttaatacaccaatatttgagggggagtaatacaaaatatatatgtatacagacacacacacacacacatttccatgtaagcacccaggcatgcacatatatgtgtacatgcatgttgtgtgtgtgtagcactccagggtattagaagtagtcatgatatagatacatatatacacacacataataatgaaggtacttagggaaagagttaagcaggtgcagacataagtagaaaaacagacatggatatacatgctgtagatatgtacgcgtgacacaagtcgatctgcacgtcagtagatgtgtgtcttcgttcattttgtgttgctataacagaatacttgagacagggtaattgataagaaaagcggttcatttagctcatggctctgcagactgggaagttcaaggggcgtggcaccagcatctgctttgattctggtgagagcttttgagctgggtctaaatgtgacagaaggtcaaagggtaagtggacacacgggaagggacaaaaacctgctttacatcaatccacgttctcaggacctaatccattcccatgagaactaatccactctcacaagagcaagaacacactcactcactcactcactccctcccaccagcaccaagccatttgggagggatttgcacttaggacccaaacacctcccaccaggcctcacctcccacatcacctcactgagtgatttcaatatgagttttagtggggaacaaaccatacccaagtcataacaagatgtatacacatacagaagaatgccataagtatcactatgcctacttcgaatccgtggaacgctaagagaatttatgattgaaatttggttagtggtgtttcacgattgttatcatttttctttttctgtaggagttggcgatttcagcgtgtgggagttctctggaaatcctgtgtatttctgctgttatgactattttgctgcaaatgatcccacgtcaatccatgttgttgtctttagtctagaagagccctatgagatccagctgaaccaagtgattttctggctcagtttcctgaagtcccttgtcccagttgaagaacccataggtgagctaagtccctgcaggccagtgatgtcctacctgtggttggccaggaatcgcctcctccttccaggcttctgccctgctcctgccactgctgctgctggccttgcaccaggccatgagcagatcccaccgtttgtggctaacagctgagccaacttcctttctccttcctgctgggagacttccactctgagaagcttcatgaggctcaagtgttcgtggtattctgcaggctgtttttgtttcatgattgcatattcctgcctcaaaggcccactttgaacaatcctttgagaggcatttctcactttttttctacacttgagagccatggtcattgtatgttgggtgcaaaatggaatccctgcttggatagctactgcacctttacctaaagggtacagaattagtcagcagaatgagcagttcttcatcctgtaattccactaagaaacaaagaaagaggccgggtgcagtggttcacggctgtaatcctagcactgtgggaagccaaggtgggcagatgccttgagctcaggagttcaagaccagcctggcccacatggcaaaacctcatctctacaaaacatacaaaaacttaggcaggtgtggtggcatgtgcctgtagtcccagctacttcaggggctgaggcaggaggattgcttgaacctgggaggctgtggctgcagtgagccaagatcgtgccactgcacttagcctgggtgacacagtgagaccctgtctcaaaaaaaaagagagagaaatgaagaaagggagcatgttgactgaatgtgttatcttaactttattcctagaggagaggataacatgaaataaacttcctttggtctttgcccacaacaagagaagcagccttccctggtgaaatgcaatactcagcagtcaattttttttctttccggaaaagcatataatacaaggagttgggcttaatgcccctctgggtactgccagttttgcctctttctttgtcctttttttcctttgttttaaacactccccgaagtgggaggctctttgtgtgacttgcaggtcatttacctctgacccatctctgtggtgttgctgcactcaggcgtctctctttggtcttgtaagcggcatcccttttgtcacaggttaaattttccctctccttgtaagtaggggctatttggagacttgagaaactgcctttagtcattctggtccactttgagcaattttccttgtggcctaggagataggcttatcctgtcgttggccatgctggggccttctagggtcacagtgcacagcaggcgtggggccttcatctctgtggcatgttgcacttgtacctggagagtcggcctgggcatgaggccaacacaccgccctcacctgggcaggagaggcagccaggtaggaggacccaccccctgaagcagttccctctctgcccccagccttcggtggcaagctgaagaacccactccaagttgtcctggtggccacccacgctgacatcatgaatgttcctcgaccggctggaggcgagtttggatatgacaaagacacatcgttgctgaaagagattaggaacaggtgaggggcagccacttagtctccagctcacgggtagcctcctctccctgagaactgaagcagaggtgtgaaaagtacaaaggaagtctcatgaaccagagaaaggttttaaaggtctttctttcttggtcaactcttttcttgtacaggtcttgtatcccttattggaaatgatcggctttagaagtgtttctgatttcttatttgtttggattttaatatatgtacatatacatagcagttgaacatcctagttcaaaaattctaaatctgaaatgctctaataaccatttcctttgcatgtcttgtctttgcccaaaaggtttttggattttggaacatttcagatttctggattagggatgcacaacctttatttttcatttttattaaaacaatgaatccacatagtaaatcaaatacaaatgaagagcacgtgatgaaagcaacccccttctttctacctcccagcaacactgcccggaggtgacttcttttagctgtttagatttcagtactcagtattcagtgttcagaaacactaatcagtatgtcttacaatataagttgcaacctactagtgagtcttaaaattcatttaggaagtcgtggccaattctttttaaaatgggatggaatggaatgggataggataggacaggaaaggacaggacaggataggatagatcagatgtcaagtattattttgtaaaacgtttgtttcactgatgagtatgggtatgtacaggattatgatgtaaaatatatgtttttactcagagtctatcaaaacagtttgaacctgcagctttctataatatgctagtatctctgatcttgcattatcaacttgagacatttatctattgtcttgagacactatatctgttgccagatataaaaatggggcttctattaatatttttaggtcagtgatgtagcttttgcattcacacctctattcttagtccctccactttccacagtatctcttgtcctcacttgtaaggtgcgagcattaggcctcacctttcctgcctcgggagaagctgacatctttccatgctgtgctcctgctgcttcatgcaaacctgaaggtcccgctcctatgactcagactatatgccagtttccccaagtctctgcacccactgtgatgaggcagagcccaccaacagcagggatggggaggggcctttgcaaggacaccagaactttccttccctcctaccagcctcttgagccagtaggagcctggcccctccattaaaaggcctggggacattgactcactgctgaggaggctgctgctcttcccttaggtttggaaatgatcttcacatttcaaataagctgtttgttctggatgctggggcttctgggtcaaaggacatgaaggtacttcgaaatcatctgcaagaaatacgaagccagattgtttcggtaagtacaccatggaaagagcctggacccctttgtacttccttcctggtttgcctctggtttcagggaactgcttcatagtaggacccagtaagaggtgtctgcctggacatgtctttatcctagtgccctgagaaaagaaaggaagaatagagaaacaaggagatgatgggagctgaagggttattatgggcaaggtggaccacttcaattttatgaaattcttaccgatttattggtttctttaacaatattttacttatttattttattttttcagagacaggatctcacactgtcatccaggctggagtacagtggtgtgatcatagctcaccgtaaccttgaactccagggctcaagcaatctgtccatctcagcctcccaagtagctaggactataggcacgcaccaccatgtctggctaatttttttgattttttggtagagacagggtcttactatgttgcccaggctggtctcgaactcctaggctcaggtgctcctcccacctcagcctcccaaagtgctgagattacaggtgtgagccaccatgcctggccaattttgggaaaaaaccaaaaaattcaaaagtgacttattgtggaatatttagaaaattcagaaaagtagaaaaacagtcacaaacttttttgaaagacagaaaagaataaatgaacaaagggaatgagactgtattcttgggttgcaagatatgactattttatttttccctagttatataaatgtaatacaatttcagttagcatctgaatgggttgaggggattgggatttttatcttaaaatttccatggaaaaattcattaaacctattataaagcccctgataatcaatacagttaaataggaggaaaagcttagagggtatagaagtaaatcataatatctttagaaatataatggaaaataaatatgtcatttgaatttaatggggtaaagattatttaataaatgaacctggcacaactggctatttgtctggaaggaaataaagttggattcctacaccctacaaagtccaaaaataaatggattaaagcttttaagtaaaaacatgaaacaataaataccttgaatagaaattgtggagagtgtattttcaaaataactagggactgagggaacctgttaaaccaagatctaaaaccctagaaattttaaaagaaaatatacctgtttgaaaatgtaaaaatttttaaaatttttttctagcaaacaaattaagtaaacaaagttgaaaggtgaaataggctgggaaaaagcattctcaatgctttggacagataaatggtcacaccgtaatgttcaaaaagctctccggaattggtaagaaaagggcgagcgtcccagtggagaagtggtggcattcactctggagtcttcctgctgccgaggcctgaggacaaatgcgggcagatgcctgtctccctctcttacctttgaagctgcctctgggtgtattttttttttttttttttaactgctttgctaataagaaaatgctgtgcttcccgcaccagattctggttctagatgtgcttccagaattctcgggaaaccctttcctgtctccagaaaaccctgcccttcacaccagatatcctcgttggggtcccactgtggcatcatcagaagatagggggtagtccggtgaggcctgggaggaatctgtcacagaaaccaggggcggtgatctgggaactaacagtggtctctgagggcccctgtgcttccccaccaggtctggattgaggctgcattcctgaggcaggagggagtgtccctggagatttttgagctgggctctggcatgatctgctgcttctcagacaccccccgcccaacccctaaactcctgagctcaggcaggtggagcccaccacatcaactgcactcacccctgagaattttgtttttgaatgcagagtggaatttagctgacacaaaagaatttgagaggggagtgcggaattaatggcacggtgtagcctgtggcttatgtggtttctaattcagaggtatgtggattacgtgagtctgtaacatatgctgatctaattaaccaagttaaaaggttaaaaatccacttcagcctacataccaagaatgggtctaattggaaacaatatttcaacaacagtccccacgaatgcctaatttactggtaaacactcactctaatattgatgatgatactcattctcttttcctctgttcataaagtgatcattgcctgagtgaaacagtcacgagagagagagcgagggaagaaaggagggagggaggaaaaagtgagggagtgaaacattaggagttggtgaacattagttgattgagtgactgagtccacaattccaaaaacgttcctagaagactcaaaatctatttaacatgaactaaagagcctttataaaactttatatttgagcaatagatgaggcttaaaagcaagtctaaaagacaactgccccagtactcaacccaaaaaacacaaactagccagacacagtggtgtgtacttgtagtcggagctactcaggagactgagacaagaggattacttgagcccaagggtttgagaccagcctgggcaatagcgagacccagtctaaaaaaagaaaaaaaaacgtcaacaacaacaaaaaaacccactcgttcatcaaatcacctgcaaggcgcctgaatgaaaggtgtcctttccactgtggctctgctcagggcacccacagctgcaggtgagttaacctgtctggccctgccccctctaggtctgtcctcccatgactcacctgtgtgagaaaatcatctccacgctgccttcctggaggaagctcaatggacccaaccagctgatgtcgctgcagcagtttgtgtacgacgtgcaggaccagctgaaccccctggccagcgaggaggacctcaggcgcattgctcagcagctccacagcacaggcgaggtgagcccctgggagcccaggcagggggccgtgagaggtgccagggactcagcctgtcccaaattccagctcttggaagtggtgtgagcctggggaagcagtgtggaaatggtccagctaacctacaacatttccacacgtgtgacaaacacagcctcaagtgacgctctgaactgcagttctcggctcaccttaggagctgtcattttgtcttgtcgtgttttgcttttatttccagagtctgttagtttgggagtgcagtgcccactgccctgggtgactgggtctctcttcactccccctgggcaccaggaacttaatctgctactcctggcagccttcaggatggcttctttgtatcagcgtggagtcatcagctccacacagatctcctgggtgggaaaacagttgagaaaaggcagtgaggtgtccttgtggaggcaatgtctggagatacaaagacagagaactctggtgcacagatacacagagtaatcataattaaagatgcacattaaaaaactctagcaagcaatgcccagcagaaatgattgagaatgggaggctttgctctggttctgtgacattgagcaccagggcgcggtttggaaaccctgttctaatggcatcatatgcctgtcccaggaacgggggcagtgccttcgtgtttctccaccatgtgaaattgggagcctacatgaactagtgtgggccaagaagagcggttctgaatattgcaactaaaagcagctctgagattattaaaagccagatgcttacctccccaatctcaggtgccaggtctggccctatagccagtttgtatgagtcatacaaatttcttgaaactaaacctgaatccacaagccagtgaccttgaaaactggagtcgccgggcagtaatttcatcagcctttaaactcccagttaaatggccagagaatctgccaactcatccaggaatactttaaagtgattgaatccaaggaagaacacaggtgaaggaccacatcttagatgacaagatactgctggatgtaaaaaatgtgtcaattctaattctaaactcctttggcacaggagtcccttgctttctagtagtagaccagcaactttctagatcatatcatatagtctcctttatttgtcattacatccctgcttgcccttgagagtttagtaagtaaatgaagatgtaaagaaggagggtaattaggcagcaggaactacattgtgtggcccgactttgattggccccgggcctcctccagacctgccttccgtatctaatttgcagatcttcagaactccccagtggcccttctgactctgttttctggcccagggtcccacactacgtttagctgactgtcttagctccctgttctcctccactatgggacagtttcgtctttcctgagcctgaggcgatgagcagtgtttaggaccaaactgcaaatggtattccagcaaatgctgtatcaggaactagatcaatattggctctgccctccaggaattttcaacctaggttcaattctgaatagactcttagacagggggcatctttcaggtttaagccagactgtgggcaggaaattactgtgtggtcaccggtggggtcagagcctccaagtgagggagtccagggcgatggccactctccaagaaaggaagcagaactcttccataaagggaaagttccttctgttttttgtcacttttttttcctttctttttatttttttaagaaataaacacaaccaaaaagctaaagtccccttgggccatcatctctggtctcactcctctctccccttctcggaggccaactattatcatggcagcatatcctttcaggccttttctatgtgtgtgtgttaaacattcacataatggtataataatagaatgttctgactcttttttgaaaatgttctcaagcctttagagaagttgcaaggatagtaccatgaactctcatataggctacatttatttatttttttaattaattaattaatttttttttttttttttttgagatagagtctcactctgttgccaaggctggagtgcagtggcacaatctcggctcactgcagcctccgcctcctgggttcaagtgattctgcctcagcctacagacacaagccatcacacccaactaaattttgtatttttagaagagacagggttttaccatgttggccaggctggtctcaaactcctgacctcaagtgatccacccgcctcggcctcccaaagtgctgggattacaggcatgagtcacggtgcccagcctactacatttaagctgatcagttgttgacattttgctacatttgctcgattcctttcctttctatttatttacttatttattttgcagacatgatgacatttcttccctaaataatttagcctatatctcctaaggagaaggatattttcccacataacccaatataattgatgattccagaaacataacattaatatagtactatgattgaatatatcatcctcatacaagggtttgccactggtcccaataatttcttttaaagctatttttatttatgtacttattttgggattcagaatccagtctaaaatcactcattgcatttggttgccatctcccatttttttttcttctttcatttcgctggcctttttgaagacttcaggggagttgtttttcagaatctctattctgacattttcaagctgcttttctccactcggtgtttggtttttgagacgcatccacgtggaatggccttgggtcactccttagagcatctgctcagcctctgttgccggcatcaggccctttagtgctctaagtggctggtgcacctggccagggctctgtccctaagcgtgactttctgttgtccccccgcagatcaacatcatgcaaagtgaaacagttcaggacgtgctgctcctggacccccgctggctctgcacaaacgtcctggggaagttgctgtccgtggagaccccacgggcgctgcaccactaccggggccgctacaccgtggaggacatccagcgcctggtgcccgacagcgacgtggaggagctgctgcagatcctcgatgccatggacatctgcgcccgggacctgagcagcgggaccatggtggacgtcccagccctgatcaagacagacaacctgcaccgctcctgggctgatgaggaggacgaggtgatggtgtatggtggcgtgcgcatcgtgcccgtggaacacctcacccccttcccatgtggcatctttcacaaggtccaggtgaacctgtgccggtggatccaccagcaaagcacagagggcgacgcggacatccgcctgtgggtgaatggctgcaagctggccaaccgtggggccgagctgctggtgctgctggtcaaccacggccagggcattgaggtccaggtccgcggcctggagacggagaagatcaagtgctgcctgctgctggactcggtgtgcagcaccattgagaacgtcatggccaccacgctgccagggctcctgaccgtgaagcattacctgagcccccagcagctgcgggagcaccatgagcccgtcatgatctaccagccacgggacttcttccgggcacagactctgaaggaaacctcactgaccaacaccatgggggggtacaaggaaagcttcagcagcatcatgtgcttcgggtgtcacgacgtctactcacaggccagcctcggcatggacatccatgcatcagacctgaacctcctcactcggaggaaactgagtcgcctgctggacccgcccgaccccctggggaaggactggtgccttctcgccatgaacttaggcctccctgacctcgtggcaaagtacaacaccagtaacggggctcccaaggatttcctccccagccccctccacgccctgctgcgggaatggaccacctaccctgagagcacagtgggcaccctcatgtccaaactgagggagctgggtcgccgggatgccgcagactttttgctgaaggcatcctctgtgttcaaaatcaacctggatggcaatggccaggaggcctatgcctcgagctgcaacagcggcacctcttacaattccattagctctgttgtatcccggtgagggcagcctctggcttgggcagggtctgtttggactgcagaagcaagggggtgatgtagcccatccttccctttggagatgctgagggtgtttcttcctgcacccacagccagggggatgccactcctccctccggcttgacctgtttctctgccgctacctccctccccgtctcattccgttgtctgtggatggtcattgcagtttaagagcagaacagatcttttactttggccgcttgaaaagctagtgtacctcctctcagtgttttggactccatctctcatcctccagtaccttgcttcttactgataattttgctggaattcctaacttttcaatgacattttttttaactactatattgattgtcctttaaaaaagaaaagtgcatatttatccaaaatgtgtatttcttatacgcttttctttgttataccatttcctcagcttatctcttttatatttgtaggagaaactcccatgtatggaatcccactgtatgatttataaacagacaatatgtgagtgccttttgcagaagagggtgtgtttgaaatcatcggagtcagccaggagctgtcaccaaggaaacgctacctctctgtcccttgctgtatgctgatcatcgccagaggtgcttcaccctgagttttgttttgtattgttttctgacagtttttctgttttgtttggcaaggaaaggggagaagggaatcctcctccagggtgattttatgatcagtgttgttgctctaggaagacatttttccgtttgcttttgttccaatgtcaatgtgaacgtccacatgaaacctacacactgtcatgcttcatcattccctctcatctcaggtagaaggttgacacagttgtagggttacagagacctatgtaagaattcagaagacccctgactcatcatttgtggcagtcccttataattggtgcatagcagatggtttccacatttagatcctggtttcataacttcctgtacttgaagtctaaaagcagaaaataaaggaagcaagttttcttccatgattttaaattgtgatcgagttttaaattgataggagggaacatgtcctaattcttctgtcctgagaagcatgtaatgttaatgttatatcatatgtatatatatatatgcactatgtatatacatatatattaatactggtatttttacttaatctataaaatgtcgttaaaaagttgtttgtttttttctttttttataaataaactgttgctcgttgcattagtttttttgatctttaattcaaaaggatttctttttacttgttgtggttttactgttgtcaccccacatagcaggacaacccagtccaaaacctagaaaatcattacacctcaactctcagggttattgagatgccgattattactcaaattaggaatggtgtgggaaagtgaaaagagttcagataattttcacatttcttcccattgtaaataaaacaggccccttagatttttctcgggtgaaccaaaaaaccaaactgactcttttagttttggcaacagggaacagaggaagctttgcgacttctacacaaaaatgatggggatggcaccaggaggaagagaaaacctacagcaaaaagaccttcgtgcctttcttacatttatagttcatttatgtttcaagcaagttgtccacaataaacatgattaactttcataatgagaaaagaagtcctgatgaataaaattaaaactagacataggtgtgtctacaaaggatgagactgaaagggaaactgtggtcgccttaaggagcggaaactccttttcttgtctcagctccttcctgagtgttggcttcactctctcctgcttcaaaagactgcttcctatagcggcaggtaagctaaaaaccagagagaaggggtttgtctcttgcagcatctatatgtaaaatcccagagtgggactctgattcgattagcttgtgtcacatagctatccctgtgcaaatttggaaaagacagagttactaggattggcctcatcacccaatgagctgttgggggagaagcagttctccccaagactagggttctgttagtagaagaaaggtgagggaggatgctggggagacacatttgagttactgcaaaagtcttaatactttttttgagagagagggcttggcttctgtgacccaggctgtggtgcggtggcatgatcatagctcactgttgcttcaaagtccagagctccagcagtccttccaactcaacctcctgagtagctaggcctgcaagggcacaccaccgtgcctggctaattttttttttttttttttaaggagatgatctcactatgttgcccaggctggtctcaaacttctggcctcaagtcatcctcccacctctgcctcctgaagtgagaggattacaggcatgagccacaatacccagccagtgcttttgttttatgcaagtcctaggacaggcacctgttcatatgattgtggggtccccgggctcctgaaatgttgggaccacagtcaggaatcattgcaacccaaaggtcaagagcttaaggatcactcaattcactgccccatcttgggaaatgccctggggcactcttcagggggcagtttggagtctgtaccaggagcttctgtaccaggagctctggtcaggctgaaactggccactgcccactgtatgcagctggctctctcccctgcaggtgggaggaaacaagaccatagcttacctcctgtgtccatagtgagaatcaaaaggtgcaaattctaggagtcagaaagaaaagccaatcatgggaccctgtctcttagagttgctgtgaaatgcactcagttgccatgttcctcgtcacctctttactatagtgtaacagcctctgggtaccacgtccaaacttgggccaccttggggtgcctgaggtctccagtgtggacaaaagtatcccagggacccaaagccagtacggtgtgggcttgaaggcatttgtgggagttgcaatgggttccaaaatctcaacccctacaccttctaaaaggaatcagaacttggtggaaattttgctggtctattttgtagaaaagctgttagggtgacaactacaggattcacaaaaatcataaaactatatttggccctgtcgctgttcagagtccacactggtcttactaagccctgatagagtgaccacagaaaagtcactccaaagtgaggggcccagcgtggctgttcttgcataaacaatggctagataatagccgggctgtaaaaccaagagggaagtgcgcagatctgagcttagaagtggaagctttcattaagagtaaaaagatgggccaggtgcagtggttcatgcctgtaatcccagcactttgggaggcggaggtgggcagatcacctgaggtcaggagttcaagaccagcctgggcaaaatggtgaaaccctgtctgtgctaaaaatacaaaaaaattagccaggcatggtggtgtgtgcctgaaattccagctacttaggaggctgaggcaggagaatcacttgaacccaggaggcagaggttgcagtgagctgagatcgcaccactgcactccagcctgggcaacaagcgcaaaaattacgtctaaaaaaaaaaagaataaaaagatggaggcgggcgtggcgggtcacacctgtaatcctagcactttgggaagccaagataggcagatcacttgaggtcaggagttcgagaccagcctggccaacatggtgaaaccttgtctctactaaaaatacaaaaaaattagctgggcgtggtgagggggcgcctgtaatcccagctactcaggagactgaggcaggagaattgcttgaacccgggaggcagaggttgcagtgaaatgagattgctccattgcactccagcctgggcgactgagcgagactccatctcaaaataaacgaatgaatgaattaaaagatgatttcagttttgcaagatgaagaaagtttctggagggcatggtgatgatggcacaacaatatgaatgtattgaatgccactgatctgtgcagttcaagttgggtaaagtagtaaattttgtgtttctctatattaccacagttttctttaaaaaaaaaaaaaaaactaaaaagataaagctgaaacctaaaaatgtccaggtaacaataaagctggcagagtaatgtacaagactacctactgtatttagagcagctcagccaagcggagccccccagaaaaggggaacaggaaaagggattgattgctttttaaagaatttaatatttgttatttcaaaaaaaaaaaaactttaaagtggtcctcagagggggaagaagtgagagttctgtttggcttctttcctcttttgattggcagagggttttgtttttagtttgaattcgtatttgagacccagcgccacagtctttgcaggactatgcattcctgagaacttaaactgaactgtttatgaggaatagtgtgagggtgagggcccagccctggctcactgagtcctcagggctcagctccacagctgcctgaggaatttgctctcaagggcaatcttcagcgatctggagcatagctgggctttgggtggcaacctgagggtgaggtcagactgtagcatcacaaccaaaagtcacatgctgatgacaggctccaaatcctcccagcccagggcctggtggcttccagatgttgactcaggacaggaaccgcttgtctgccctaaatgaatgccatggccagagagggtggaccaggggcacctctgacagggagagttaaggagcagtgagctcccttccacctccgctgagcagaaaggaaccctggaaataccttcaggacagacagctgctgatctcttcctggaagcgctgggcctcagaagcttgctggttcctgcctatttgctcccacggcaaattcttgattctttatcagaaaggagggaagaagtgtgtgggtgtgagggggaagaagccacaggaatgcccacagcagaggtcctcggggacgctgggctatccctggtggcaacactcttggggctggtgctgggtgaggacggcctcccaagcaccctatgctgtgactccagcccccaggattctcctcagggtagagagaaggagctcaggtgagctctggatgaatgataccatcttttccattgaaatcacagaattttacaactaaagagaacttccagatggtttgagtcaaccgcactctggcagctggaagcagagatgaaaagattcaggcaaaattacacagttcaattattaacaattcagactaagcatcaggccatctgaccccaactgagggcccctcatcctattctactaagtatattacactgcagtctgtatgtgtgtgtgcatgtgtgtgtcatgagagtacacggatatgcaggtgtatgcatctgtattttgtgcataaatgtgtgcatttgtgtacatgtatattaatgtatgtgcgtgtgtcatgtgcatatgtgtagcagagttagtgtgcatatgcacatgtgtatatgtgtattgcgcatgtgtatacacatgtatatatgggggtaagtctgtgtctttggtatgtgcatatatgtgtgtgtgtgatgtgtgtgcatgtgtgtgtgctttgtgtgtgtggtgtgtgtgcatgtggtgtgtgtgggggtgtgtgtggtgtgtgtttatgtgatgtgtgtgtggtgtgtgtgtgaggtgtgtatggtgtgtgcgtgtgtgtgtgtgtcatgagagattcttaggccataatggcttttttttctgaccaagagacttgattcttgctgattcagccatgagtgtgcatttcccacaatcagggtgactaaccaggacatccggagaagtttcttcctctctgcctcacccatcccactcgctccatcctcaaagcggacactcagatgctggggcttctgccccagtgtgtgaccccacgggaggtttgcagagtcctcaggttgcgtcacagccagcgttgatgagcatcatcctgtcttccaagaaggcaggccagtcacccaagaatgagccagagctgcttctgtaaatcacgagattctgtgacccagattaacatgaaaggagaaaccagcagctgctgccgccgtaggcacaagtcagcaacttcagtccttctgaggctggcccttcctggccatgggctgccctttccctttggggtaatttgaggcaatgaaagtttttattccctttggttgtattttctagacatgttttaatgtagctgaaatcatatgaagtgttcaattttataccctgctttttttaaacggaagattatgacacagcttttttacaatgttattagaagcttttcagaaacattccttttaacggctgcaaaatgctataataatattgtcatatcccaattccctactgtgaaacactcaggcgttattccctgttgaaaacaaagctgggctaaacatctttatgcacatttttttctgtatttcggactggacatgatatatgtggctttttgggctgtcggcacataacaattaaaatccaaaaagagaaaacattaattgctgagcaaaactttgcatttatgttgcactctatctggttttcttttcttccagaaaaacattattttattaatcaatggctaacacactttataataatttttaccaaattttttgctacatataacagcttttataatcttactcttttagcaagaacggaaaaaattcattctttccaccatcacaagagattaattactcaataattacatttattaccagtttagaaaactttgagcttcaaaacccattacaggcaatgtcataaattttaaagattactgtcaaatctggtgaacactctatcaagtttagtttcatttgattatacataagctgtaagattttctgacattgcaagtttaattgtctagtgacttattttaaatgctttttaatgccaacactcattatccaattgtcattcatgtccttctctgcctggctttatgggctgaatttctgtgcaggtgccttttgctgagaaggcacccttcccagtgctctgggccattctctgtgtggttccattgctatcccgctccaggtaccaaaggattcggcctccaaactctgctgcccaccttggtggttggacacatactcctggaggacctggagtcaaaacaagccacatacatcctgctgacatggagaacagccagctactgagcaaacatgcaacactggtgatattgtgcaatgttcccagctgtgaatttatctcattgttttcacccagtgacatttttatcttatccctccataagccaggcaaaagtacactaaacgcttgaatagattctctcttgtcattttggaattactattttcattttttatttgaaaatgagaaataaaaaggaatcttataacttctctctgccccttaaagctattttcaataaagagtagcttttttttttttttttttgtgaaatggagtcttgctctgtcactctgtcgccaggctggtgtgcagtggtgcgatctcggcttactgcaacctctgcctcccaggttcaagtgattctcctgcctcaggctcctgagtagcagggactacaggcacgcaccaccacacctggctaatttttgtatttttagtagagacggggttttaccatgttggccaggatggtctcgatctcttgacctcatgatccgcccactttggcctcccaaagtgctgggattacaggcatgagccaccgtgcctggccgcctttttttttttttttttttttttttaactgactcttaaaccttgagacgccttgctattgccagtggttcccacactttgggaatgttatgaaatagcaaacttttataaagaacatggaggactgacactctgacactttgttttgcaaagaacacagaaactacaataactatccaatgctgtcaccaatcatagtgccccaaaagaaagagaaggaaagaaagaaattaataaatagagaaaaaaattccaaatgaaaaaaattaaagcagcaaggaagggcggggcacggtggctcacgcctgtaatcccattactttgggaggtcgaggcgggtagatcacttgaggccaggagttcaagaccagcctggccaacatggcgaaaccttgtctctactaaaaatacaaatattagccaggcatggtggcacgctcctgtaatcccagctaccggggaggctgaggcacgagaatcacttgaacccgggaggcagaggctggagtgagccgagattgtgccactgcactccagcctgggcaacagagcaagacagagcaaaaaaaaaaaaaaaaaaaaaaaaaaaaagcagcaaggaaggcaaggaaggaaggaaacaaaagagagagagaaagtgggaaggttacagtcctagaataattaacattcctttcaatggaataacttaatcttaggggaaaaaaattacccagtgctcttcatttttctccatttccctggaattgtgaaaagttcaccatgggcaacatgactctaaaggtttattgctgtgttttgtttgctcaggagcctttgctctttgctatgcatagaagttcaggaaaagccctcaggccccgtctcatgacatatttcatgacaatgtttattccatcccctgaacactgaaacttacccaaggtccctgcgggagggccacactttaggaagcacagtatttctggttgctcttaacataggggcataggatccaacagtcaggaggaaatgggatgtctcgaagttcagccagagcatcacccgccatgaaatatgagggtcagtcggtctccgctcaaatggtcccagagatggaggattggaaaagcagattttaattcctacgtgagctgacacttaccacctgtatttctcatcccttgttctgtcttccaggctataaagacgccttgaatcctcctccacgatacccgccccactatttgttggcacagctatgatgctgcttatggattgttttcactcctaaagacagtggcgcaaggcaaggtgacctggagcgaggccatcctgagtgcccacccagcttcccaggagcctgttggaatttggaaggacatttgcctctgtttataaagactggctttttgctgaaagccagggtctcaaaaattttgttttattaatagaagctaaaccccaaacatttggctctttttcattccatttcccctttcacaatcttaactattcccaagacaatggatacctctgcctgtatcaagggcagattgtcaataagaaagtcaacaggaaataaacattattatttcaaaaatactatccttatccattttaaattaaggggctaggagaaaaggatatgaggatttactgttgaatgggttaggagtttcagtttgggatgaagagaaagttctggagatggatggcggtgatggtggcacaacaatgcgatgaacttcatgccgctctcaaaaatagtgaaaatggtcaagtttatgttacgtctattttactataataaaaaaaaaattttggttttcagtgggcaggtgaataaggagaccctcttgccacctcttggcaagagcaagaaaggagattggaatatcagcagtgtgagctcttccaagggcagtggtgacagcctgggagactggtcagcgtagcaagggcaggtgcaggtccctggtcctagaatgtgagtgtggcaagccagccttaacttctgcctgcctaggaggcatcctaggaggtgagccttagtgagcaggggtgagctctgtttgtcctgtatgcagcagcagattatctgtctgctcatgcagactatgtagattgctcagagttgctagagggagggcctgtggggcctgaacttcagcctgcactcagctcatcaagccatgggctctctcagggccatgtctgtccaacccttgcaaagcctctggatgggtgatcctgggcactaaaccttgaccattctaaaatactatttggcacagcctggatgaggtctgtacatagagtgtgtagatccctcaagttccctgaacactccgccatgcaagtgatgcagagaagtcagctaggaggaagacaaggtgtggggaagaacagcaccagccaggaagcatcatcccaaatctgagttcatgaggctgatgaagagaatgtccacaccattaaagagattctagcattccttttctatgtttgtcaacctttgtccttgttagtgcctgaataaaactgaacatgagaatgtggccatgggaattatagtataggcctaaggagaggttgtaaacttcaggcttcatcaacacttgaccatttcctcccattttctgggaactaattagcccctttctgtttcacccatgcagtaccccggctattgggcttcattactccagtatgctttccagaactatcatattcctttaatcttcttgaaataaatttggcttggatcgcactcccctaaatctagtctctttcattgtccagggagccacccctcctcccatggttgtgcaagtgtctcggggtcttctgagcagtctgcgtttgctgcctttggtcatcccaacctgtctgacctgccttctcaccctccatgcaagcctgagtgtgggaatattccagagcccacatgctctaagctcagccatcccaggtatgagtgcaaggaggctacagccctcagcctcttgcagaaaacccctgttgctccccaagtttgggaggtgactcttctctcctctttctccaactccaccaagctatggacaattaattccttgatgacactgacctctaggttcataagagaggttttcagactggctccaggaattgagaaaatcttttcctctctcttcagccttggcttttggatcattgtgaactcagaaatctatcgggaaagtctaattctgaacactgattcttttttctctttacattcctattgttaaaattctgattatctgtgagaaaacaatatccctgtctgtataggggtgatgtccttgaaaagggaacacaaaaaaggaaaaaaaatcatatttgcacaataaagtatcaccccccttgtgttatatacaccacaggtctgcaggcatgagactgaggtcagactgtgagtattctcccctccatcccaccctccacctgctctgtgacctgcgtcagaaccccagggacaagataagatttctccaaaactcaatggagagtcacagaaaacaggaagtgcttttgaggaagttttgaatggaagcaggaggtgagagttgggaactgtatgctgggaaatgacctctcggctgggactcttgggagggtgtgatgtcttggttgctgctcctgtgaactgtggagaaggtcaggtttagcgtaaactgtcccctgtggtcctcctgcaattctcctaatgactgtcagccctcagtaccagggtcccatacacccctgcagcactgcatccccatttgttggagttccacctcctgagaccaaatcctggcttcctcactgactagccctgtgcccttgggcaagctccgtaacctctctaacctcactgtactcatctgtaaaatggggatgagggttattctgataatcaaatgccataatacacaacaaggcgaatgtggtgcttggcacgtaagtcagcagtgtgttcccagttgaccactggtttcaggaggccaacaaggacagtgggattttaggtgagtctttgggtattttccccccatttgtcttgcttatctgtattatctatgtttttcataatgatcacttgttttatttgtttttcacctaaaaaattattgaaaaataacagatgaaactgctggaaggataaaaggctaaggtcctctgagaatccttgaaaacggccaccagcaagttattcattagaaatttcaaagggaaatttccaaaccaagccacctcaatgacaggcttagtgctctaggaacaaggtggaggggatgtgggccattattgtttataagccagagagatggtgggttacttgctctatctggtaattaaacattcacatattctacattttttaaataaatcaatgcctttttcatcaaattacgaacaggccaggacactgaagtttgaaggcaaatgttcattcctgtctgctccacatctggctttccaggacaacacaatggtcagtccactaaaagtcaaggaagtcctgatttttctggctagaaatcaagaaaagtcattttttgatgtgcttattatgtttctgagaatatgcaagagaagaaggagaaaaacacaagccttccagatgggccactgccggttaagcttgcattttagggagaggtgatgcccacctttaacctctttcgaggcatcacacacttttgggctcaacaaccaaaaaacaacaggggagaaagcaatgatgatgggagctgttttggctgagaaactccaagggcccaggagctccttcaccctacatcaaaccatggaaaagagctcaccagagatagtgggttggcatagctccaggtcatgcttatggccctatatccctaatccatctctctctgctctgtcctaagacttcagttgactggccttccccaggtctcaagggcttgtcacattcttcattacttttctgtgtttttcgacaattctatctaacatcttcagtaatatgtgttaaggtatggctctcataagagtgtttcaatgattcaggggcactctaaccttccaaaacatttgtaagaagaatagtagctgtgtgcttggaactgccttctaagcactacctaacctatctgcttcaatcttctcaatacccacatttttaattcccctttacaagtgaggaagtgcaggctctatacatttaagtgtctcacccaaagtgacatggttgtcaaaaactgaactatgacttgaactccaaattatttaattccaaaataagcggacttaattactctttacttgtgtacttgattattgcctgtgtctgcctgtcagccatcatgctcaccactcaccagacaagtggtacatcctaaataagtattttcagaatgaacgaatactatcttccctcgaggcccagagattggaggcatcatggtggaacagcagcgggtcagtgctttgtttcacagttcactgaaacatcacggccagtggccttgtggcccctaaggagtccagacaactatggagtccttggtacaaaagcaggaattccttgtttacttgcagaaacacttcatgttgagacttttgtagtcttcttccttccttctttccttttttttcttttactgtttctttccttccttccttccttcttttccctcctttcttccttccttcctgcctgcctgcctgcctgcaaagctagatcaaccagcttaagttgttacaaaactagaaaatctgaattaagtagaaatcatgaattgaacatgtttcagagggaaggaactaaatctagcctcaaatgagaagcttatttcccaaaatatgaaagcctttaaaaattatggctagcattgtttttgtttttctatcaggacaccaaaatcaagtctacgggtgtctgattttcagacttcaaagactttggggcatgcctcagcacccagcctcatccctcctcttctcctcttggattcagtcccttctcctgagttgggaggttgtctggacagtgtctttgctatctgcgttgctcctctccccaccacccatgtgcatttgcccctctgtccctcagtgcatttcccccaggatgctctggccaaactgaccaggtgtctccatctctgccccttttctttcccctgaatgctgtccagtgttttctggaacctgtgaacttcccgtgaatgataaataccaagagcttctcaaaatgagaccccatgttctaaacagaacctgcagtcaggattccagggaaggtcagcaggttcccacccccagaagcactttgccgtgtaagacattgtctatggaacatcaatgtcacttagggccttggaaagacattcaggaagggagttactacgcctgaatttctggagatgtgtttagtagggaagaattcactataatccatgaatgattgattgatttctagaaaggctcacgcatgtttctttttgccactcaggactggacctctgaatcagtgcggaatatgaatgagagcggtcaggggagaactggaggatgctggtggaggctggaaggcttgcagtcacctgcctgtgcttatctaagtgatgagaatgtaggagcagcaggacctggcccatcactaccctatgtttgttacaggagagaggaccgtcctcccacaggtcagagctattgttaatcaaggtgacagtgcaagatgcattcccactcctgacttctcgctgtaaataggtttcctgagtggtgttggtttattttcaatttggaagccagttcaatcaaatgtttcactagattcaagtttgatgaaaatactagcaaatcccccaactaacgagtcactataagtaactcaaggcatcagtcctgctccccacataagggagtactggtcctgaggaaatgggaccacatatatagggaacaaaagtgatacaatgggccatgagggtgtgatgagtatcccagtgattgctttgggtaaattttgctggccacatcggtttcagttcctctacatagacaaggaaatgctcctcatgaccgacaacagctcctcctgcaccgaggctgtctagtcattagaatggtctctagaagacaatatcatcagcaatcactgctagcaaggagctggcttctgtggtactatgttgttgctaatagtttttgttagagcaactgcattgtgggagacctgatccagggaagggagaaaccaaagcctgtgctcccaaggaggttatggaaaatgaagaaaaacaccagcccctctgcaggaggaagctggaaatggttggaaggaccacccatggctagagccccagcacttgggtcatgactcaccctgggtaggtcaagtacaggccccacttcttcaggccttggttgtggatcagaccctggattcttcccctccgggtacagcccagttgccatgatgctccttgagtcaatgagctctttggtctgatcttctgctcaagcaaagaaagggtccggcttcagttctcagaggctgataagtaccaaggtggcagaatatgggagtatcctgcaggtgctcccagcatctgccctggctcaggtgccagaggcttgcgattttctagctcttgacctcacaccctcgattgtttgttttccaattccttcctgaataacggggtgaacatgccacccctcctggtggcgaatggggttcctcagaactgggaggccacagtccagattctgaggctcttcactaagcaagtgctggagagcaaagccactcactcacaactctctctctttctctttcaaatttggggaaggggaggccatctgagcagtttctctcacactccccagtaaggaactcatgaaggaccaagtgagctctaagcccccggtagaaacattcagctgttccaatgaacttcttgtgatcctgaaatctgcaaagttagaaccaaggcagacgtaggtactccagttacctaacaccacagaaatattgtttttatttcataaaataataaatttaaatactgctatggtttccttgtttgccccctccaaaactcttgttggaacttatctccaatgtggcagcattaaaatgtggggcctttaagaggtgattaggacatatgagctcttccctaatgaatacattaatctattcatggaataatgggttcatagaccaacaggttatcttgggaatgggactgatggctttttttttttttttttttttttttgagatggagtctcgctctgtcacccaggttggagtgcagtggcgtgatctcggctcggctcattgcaacctccacctcccaggttcaagtgattctcccgcctcagcctcccaagtacctgggattacaggtgtgcaccaccacgcctggctaatttttgtattttagtagagacaggatttcaccctgttggccaagctggtctcaaactcctgacctcaagtgatctgactgcctcggcctcccaaagtgctgggattacaggtgtgggccactgcgcccaggcaggactgatggctttaaaagaagaggaagagacctgagctaggacactcagccctctcgccctgtgatgccctacaccaccttgggcctctgcaaagaatccccacaagcaagaaggccctcacaagatacacttcctggacctcagacttcccagcctcgaaaactgtaagaaataaatgttgttctcataaattacacagttccaggtattctgttattagcaacagaaaagagactaggacagatatcacagttagattgtattctacacattgtgactggttctccagagaagcaatgcataaaaagaggaataatcggccgggcacggtggctcacacctgtaattccagcactctgggaggccaaggcaggcgaatcacgaggtcaggagttcaagaccagtctggtcaatatggtgaaaccccatctctactaaaaatacaaaaattagccaggcgtggtggtgcgcgcctgtagtcccagctcctctggaggctgaggcagaggaatcacttgaacccaggaggcagacattgcagtgagctgcgattgcgccactgcactccagcctgaacaacagagccagactccgtctcaaaaaaaaaaaaagaggaataatctccaaaatagtaaacaaattcctgcagacaggaaatataatggtagatacctgagctaggagagggggaatggggaactattattcaatggatacagtttcagtttaggaagataaacaagctctgggaataaacagtagtaatggttacacaatgtgaaggtacttaatgctactgaactcaaagttggttaaaatggtacttgctatgtgaggtatattttaccacttaaaaaactataggtgattgtgcttctaaaagagttatcagtttaatcttcaatagaaatcaatggactttgttcatttttaacaaagtcaaaatatgcatacgaaaaggttatggggtaaaggcagaggtaattatttttttccccgaaaggtattttctacaatgaatgtttttatgtaataaaaaatgaaatgacaaaagtttagaatgtttgtgggttttgttccttaaatccttaattacataaattaatatctacattatacagattaagatacatatttttcctctatctacaacatttctccattctctgtatcttaaatcctgacattaaatgtcattaaatttcttaaatctcaagagaacgacttggttaccaaggaagatataatccatagcctagagagtgggcgaataaaagcagcttctaatgttctcaactgcttttctcctgtcaaccaaatgtttctgtaaataactcatttctgttggttttgggtaagacgtgggagaaggaagaatccctgaatggaggagtctggaaaggatgcttgacaaaacgcccgcgctctctggagacgcagccagtctcctccctcctagggtctggtcttgacgatagcatctcgtgttttggggatgcctttccttaccagattcttctaaagcccagctgcacccacccttaagtgggagataaggcttctgcccgcgggctctgcgttcgtccacccggccccacgtttgctgtggactaaacaggagccactggactagagtacacttgactctcggctctgcggaccaaaaattccaggactaaggaatagcaaggttaggctgaaacagtccacacagggcttgcggtaaacgtcttttcaggagccactcgcccagtgcagtaagtcgtgtacttagttgactcgagcgctccagggagacgcccgaccctactctgcgccgccccggggcaccagctctgcttcctccaggtccactgaggcaggcacgcccagctctgggacagtcagtaaacaagccacgaaccgcgccagggatcagagcacccagagtccccgcccagctgccggcacagccaatcgcagcgcagccaggcggcggggcggtgccggccgaacccagacccgaggttttagaagcagagtcaggcgaagctgggccagaaccgcgacctccgcaaccttgagcggcatccgtggagtgcgcctgcgcagctacgaccgcagcaggaaagcgccgccggccaggcccagctgtggccggacagggactggaagagaggacgcggtcgagtaggtgtgcaccagccctggcaacgagagcgtctaccccgaactctgctggccttgaggtggggaagccggggagggcagttgaggaccccgcggaggcgcgtgactggttgagcgggcaggccagcctccgagccgggtggacacaggtaccgcagccaggccgcgccgcgccgactcagggcctggcccggccagacagggaagctcagtccccgcacgccagacagcggtactcctgctggcgtcaccgcaaacatcctctgaccgctacagccagtgtgtggcgcaggcgtcatgtccccggccctgccacgcctggagccctggaagctggctgcagggcgctggcttcccgcgtgcggccatatgaccccgtccctgatttaggggagcagtttggggtgtcggcagcacaggcccaagtgaatgaaggagggagcagtgcgtgctctccttcccagtttttcctgggaaagcatttcagaaaggtttcatttaaggagaggttggggcggcgcggtggctcactcctgtaatcccagcactttgggaggctgaggtgggcggatcacctgaggtcagtagttcgagaccagcctggccaacatggtgaaaccccgtctctactgaaaatacaaaattagacgggcgaggcggcgcacgcctgtagttccagctattcaagaggctgaggaagaatggcttgaacccgggaggcagaggttgctgtgagccgatatcgcgccgttgaactccagcctgggccacagagcaagactccatctcaaaaaataaataaataaataaataaataaataaataaataaataggagagattggaaaacttatctcagcttttggtgtttgttagtcaggaagatgtgtgaaggcctcctaactcttggggatctctttgtccctacttgggaatcccaccttatcattagtgaggttttgcctgggcacgaaacctggattttttgcgattggtacaaaacctggatcaaccgtttcccggtttcctagttgttgccttaagcttctcacacacaaggtagtttcataccgttctcataacctaaattgtcatcgcataaactgtttcagctcctacagctctggacaggctgcttttcattttggtgagtccatccagtacctccacgtgccctgtttttctccaggcacatccttggcctcttccacagtccttgggtaaatgcttgggagaataatttaaatatttttattctaccatggtggccctaatttttcagggggcagtaagatggctttttaggattggtctaatcagatcctcatttttgttcccttcctaggttttaaaacatgaatcctacactcatccttgctgccttttgcctgggaattgcctcagctactctaacatttgatcacagtttagaggcacagtggaccaagtggaaggcgatgcacaacagattatacggcatggttagtgaaacttccccagaaagaatagtcttggctgttgagaagttttagtcagagagtagcttctagaggccagcttttaccaatagcctaatgtaataacctaatggcgtggattatgagcacaatgtggacattcatccttgttgtgtctcagtttggagaacagcatccccagaggtgtcaagccttcccttgccatggtttctcttccatctctgtctgcagattcacttggtgaggatgagttgggttttaggtagaagtaaagagcatcagttacatgtttgcctctagaatgaagaaggatggaggagagcagtgtgggagaagaacatgaagatgattgaactgcacaatcaggaatacagggaagggaaacacagcttcacaatggccatgaacgcctttggagacatggtaagtgtgctgtggactgccgagctctgtgcttcctctcttcggttctttactaaggtaatctcttgcttttcaacattttatttccttttccttgaagaccagtgaagaattcaggcaggtgatgaatggctttcaaaaccgtaagcccaggaaggggaaagtgttccaggaacctctgttttatgaggcccccagatctgtggattggagagagaaaggctacgtgactcctgtgaagaatcaggtgagacagtgtcaggttcagacctcccatcttcccaggaaagccaagaagtgattgacatctttgttttggtagactttaaagtgatgtacagttcactttttaacagtattcagatgtgtgagctgttgtcaaagtcttattattttttttttgtggatgacagctttttttaattcccttttcagggtcagtgtggttcttgttgggcttttagtgctactggtgctcttgaaggacagatgttccggaaaactgggaggcttatctcactgagtgagcagaatctggtagactgctctgggcctcaaggcaatgaaggctgcaatggtggcctaatggattatgctttccagtatgttcaggataatggaggcctggactctgaggaatcctatccatatgaggcaacagtaagtggagctccttgtcatcattccagctcagcttttggaaggtggacactttaagagataacagatacctttttcggaattcatatattagggctgggtggggtggctcacgcctgtaatcccagccctttaggaggctgagccaggcagatggcttaagctcaggagtttgagaccagcctgggcaacaaggtgaaaccttgactctatcaaaaatacaacgaaaattagccggctgtggtggtgtgcgtctgtggtcccagctatgctgaggtagggcgattgcttgagtgtgggaggtggttgtgcaaatgcactctccagtctgagtgacagaatgagaccctgtctccaaaaaaaaaaaaaagttcacatattagatggcagaatatatatctgcaaattgtcagtactgtcattataaattattagcctttgcacaatcctgtgattagatgggtaacatatagctgttcttgcttctatgtaacgtgaagaatatacaagccattctaaatatacacatttctctattgtgaaaaatgtcttatggaagtaaacccagaggtctcattgaagagactggagtcaattttcagtttcagattaactaatagcatttcacttcctgggatgatttataacagtggtgacttggaaatactaagctgcacactgctgagtgttgtggttctaactcatgttctccaggaggaggacagcagtaatcaagtcttttttttccctttacctttgaaaggaagaatcctgtaagtacaatcccaagtattctgttgctaatgacaccggctttgtggacatccctaagcaggagaaggccctgatgaaggcagttgcaactgtggggcccatttctgttgctattgatgcaggtcatgagtccttcctgttctataaagaaggtaagcatatttttctttgtagaaattgatgcagaaaaagagtatcatgacatacgagcatgatagactctggtttgcaagtaaagttcagtgtagatatttaggtgcttagcatcatagttgttcattctgtacatgcaatatttatacctgatgtttccatttgacattatgttgcgtatatctccatgaatataagtacttcataactttttataaatagctatatttactgtgtagtttaatatacttaaaatattctgcaattgttggatttttataatttttccaaagatttttacttctattattaaatccgaaaagagccttttgattcaaggattttagtgttctgtgctatttttttagattgatatcctagagtagaattacaagcttacaaagaggggtctttttttcctctaggaaagcttttttttaatgaaggatttatgctgatttctatttctgctagttgtaaatgagagcttaaatccctggccttcttattgttgttaagtactatctggaatgtgtgtcacttcactgaattcagagatgcctcattccctgtgggtgacaggatgggttactgtcatgtgtcctctggagcttctcaccccagccctcattttaccatcccaggcatttattttgagccagactgtagcagtgaagacatggatcatggtgtgctggtggttggctacggatttgaaagcacagaatcagataacaataaatattggctggtgaagaacaggtataaattgccagaaatacttacatttgaaattcaaaagagaatacttatttgcaaacagtgtttggatacagttccacatgcccttaggcatacttctgaaatccccagaagtctaagttgaacatataatattaatgtttgattataaaagtaagaaactgtcacaaatatcttgggagtatgaatatagtatttgttccattgtataaaggtgtatctaaatctgaacagtttttaaattctgaggcatatctggctgcaaagacatcctattgttttcctgtctctgatctgtagttctgtgaaaggtcacagtttggaggctgggatggaaattatgtccaggttatgtcaagaattttttaaggataaacaggaacattgcctgtcctgattctttctgttaagtctatggcctctggcacagtgtttaagttgggtgttcctgttaataaccctttgggctttattctttctctgaaatggaaaacctgctcttttttcagctggggtgaagaatggggcatgggtggctacgtaaagatggccaaagaccggagaaaccattgtggaattgcctcagcagccagctaccccactgtgtgagctggtggacggtgatgaggaaggacttgactggggatggcgcatgcatgggaggaattcatcttcagtctaccagcccccgctgtgtcggatacacactcgaatcattgaagatccgagtgtgatttgaattctgtgatattttcacactggtaaatgttacctctattttaattactgctataaataggtttatattattgattcacttactgactttgcattttcgtttttaaaaggatgtataaatttttacctgtttaaataaaatttaatttcaaatgtagtggtggggcttctttctatttttgatgcactgaatttttgtgtaataaagaacataattgggctctaagccataactgctgtgccagtggctcactaggaggaagagtgggtggccttctgggtcttctagtcacagatgtacagatctcatgtcagctgcccagtggctatgtcttaaccaatccttgattgcagcaaaatttgaaaatgatctatgaggacaaaggaaaattgtttgaataaagaaaaatattcactttttagaaaagtgaacatacatatatataattttaatactagaaaaggactttagtgatcgtgtttatttcacccaaagtggttgcatctcagtcaagttacagggcaaaggtctcagcctgtttctggagcatcttcgcccactgctggtgaaggccctgtggacactttgcagtcaaggtgggttaagaactagtgcattgccaaggctgtttgtttttgggtcctcaagggatgaggaataaacttcagggtttgaggctggggttcagaagtggtgctctggcctcagaaaataaaagacaagtgagaggctagaaatgacaatctgttgccctatttagagcaagctacctgaaaatacctgatttatttttttttaaatagaaaaacttcccacatcgcactagctaaacagcccatacttccatcacctgtgtgttttcagaagtctcttgttccaactgaaggaaatataaagaacagatgagaatgtccaatgaatagactccatatcacagaggagggtaaccaggtgtacaatggagtctcagcttacaaagcccccgggaggttctgtccaagtccatctcgattggaccacatgccttgctggactctcatgtgcccttcccgagtagttgctaaaatttcaaactttttgacctaaaatggcaaatgtggcatctgtgaaattctttgggtattgtaataaaagtcaccaggggtagcaagatttggggaggttcccaggctaaatccctcgtgcaggttggggcttagatttgataaactggaatttatatacaacacccactacatgctggtcatcaccactgtggaagagacagaccctgacctcaaggagctgaacagttagggagagtgaggttagcagggagggcttccaggaagaagttaaagcagatggctagagcagctagtcaataagggaagatgaagaggtgagcatcttagcagagactagcacatcagcaaccctgagaaaagaccctgtggttacagacccagtaaaagtcactgggtccaggtgttgggagatgaagctggtcaagaggtagattttcaggataaaggagccactgggagtgcagtgaacagactgttttggttctgttactgtaaaacaaaccacccagaaacccaatggctgggaaggaacatctttcacatgattctgcctggacttggctgtgtggttttcacgtggaggtctatatctgtgcttgagacatctgcaggtttgagtgaactggacatctgcaaaggctcactcacatggctggctgcagatgctggtgctggctggacgttcaacttgggctattgaccagagcacctgcccggggcctccccatggcttgggcttcccacagcattgatactgggggaaatacatatatagtgcaattcagtgttttaagtttgccaacttggaaggtgtatatatacagctttaaaccctgaatttcacaaatgttcatgattatctctttgttaataagttaataagaaaaataatttccaggagacttggtctcttttctccagtaatacagcttaaacattccataattcacatgtttaagattgttttatttacactttcaacaagtattcattgggcaccatttatgaggcagtgctgtgctgccaacacaaaagtgaagcaaatactcatgaccccttcctctgtagctcatgttcccattgaaaaatcaaagcctggcacagacccatgggtaagtgcagcactagggaggtctcaaaggagcccagggacagtcagggcacacaccagggacaggccaccctccacggtcagagtaggtataagcaggggccatctgatcccaatttcaagcgttcatagctgtcatatcttggaaaaggcatgagagggcagtttctctttgcgctgtattatttcaatttttaggtaatggaccttcattattttcacaagataacagattccaaaagtatgcagttcaagaaaaaagttaaagaattgacaagaaggaggaggaggaagaggtggagaaacagagggtccttagataacttgatgaaggcgagtctcccatttggggactgatgttcctgagatctgtgcagatgctgctcagagggtccatcacacagcacaggcgtggggaagcagcactgcccagctggactccagggtgctccatgcacctctcagtcacacagaacctctctgaggatggtggctgttggctccaattgaccattccctggcaagagaaacagggaggggggtttgctaagcgcttaaggagggatggacaatgaggggatagaccagggacagtgttctaatgagactgctttagtgaggacgcagagtgactctgctcagaactccagaacacttgctcccttcagctgccccactccccacaaccatgcacactcccctcatcccaacctggggcagcatgttgagcacttaacagaactgccatttctgtggctttttcatccctttccttttcctccatattcaggaagaacaacagattactaatcacccacactcagggaagtccaatataagtaggagcaagagcaaatcccgagctttgggtggttaattcttctgaaaaaccatagcagagacttcctgtttccattacaacgtggaaggagttttgaagttgtaaccatccactcacaagtaaaaagctgaacaaattgaaaaatcaacaactcttcttagaatcatcagacaagtgaagacacacagcaaaccactgccttaataattagagaaatgaatgtcaagaatcacagcttacagaaggagaaatttatgagcagagatttccacaggaacaagtgcttagtaaggaaaaccaagctgtaactgaggaattgccacaggtccatgtggacaagtctgagagttaaaattctaggagttgtgccttagaggggctcctcaagttgtagagctccaatagctctaccaggttctcaaagtagaaatctaagacaaattccctcatgattcaggtatgtgtggtggggcgggagggggcgtcatgatttgaaaatatgccagagcattctgttcttcttaacgaggcctctcctcaagaaaaactttttttttttttttttttttttttttttttttttttttgagacggagtcttgccctgtctcccagtctggagtgcagtggtgcggtctcggctcactgtaacctctgcctaccggtttcaagggattatcatgtctcagcttcctgagtagctaggattagaggcgcgcgccaccacacttagcaaatttttgtatttttagtagagacagagtttgaccgggcttagtagagcttagtttgaccgggctttagtagagacatgttggccgggctggtcttgaagtcctgacctcaagtgattctcccatcctggcttcccaaagtgctgggattacaggcatgagccaccacgcttagccattttttttttttaagtcaaagctgacctattggggtttcatcaaaacctaactgaactgggggatggaaatacccagctgcagcctgcttcagccttccatatggagaagggtaataatcaactccagttcactctagccatcctgtctcacctaaaaatggaaaacccgagaagcacttgtgaattccacagcccagggacatggttaggttgattaaaagactgcgacccactcataggactaaggaatacttctcctccctctacatatttccagcgcattcccaaaggcttatttaccagtgtttcttttacctggtacaccataaccctctttctaaagaatattaaaagctatactaaaaggcaaaagtcacaactagaagaggcaaagcaagcatcagaaccagaatcagatatgtcatgaatgtcagaaacatcagaccaggaatttaaaataactatgactattatgataagggctaatagatcaaatgacaacatgcaacaacagacagagaaggtagagagtaagtggaaaattccaagcatccaaaagtcatgctaattcggccgggcgcgggggctcacgcctgtaatcccagcactttgggaggccgaggtgggtggatcacgaggtcaggagatcgagaccatcctggctaacacggtgaaacccctgtctctactaaaaatacaaaaagttagccaggcgtggtagtgggcccctgtggtcccagctactcgggaggctgaggcaggggaatgaacccaggaggcagagcttgcagtgagccaagatcgcaccactgcactccagcctgggcaacagagcaagactccgtctcaaaaaaaaaaaaaaaaaaagtaatgctaattcttagcaaactagtaatggaggggaacttcctctccttgataaataacatctataacaaacctgtagataacgtgattttgacaaaataaaatctttattactaagatcaggagcaaggcaaaaatgtcccctttcaccactccttttcagcatagtactggaagtcttagataatgcaataaaacatgaaaaataaatatatgtctatagattagcaaggaagaaataaaattgtctttgtttgcagatgacctagagaatccagaagaatcaacaaaaacctgttggaactaataagtggttacagcaaggttctaggatacaagattaatgtccaaaagtcatttcctttcctatatatcggcaatgaacaagtggaatttgaaattaaaacacaataccatttatgcaagcaccacacaaatgaaataattaggtatcaatctaacaacaaatgtataagatttatatgaggaaaatgacaaaaccctaatgaaacaaatcaaagagctaaaaagatatctcatgttaattaataagaagactcaatattagcaggactttattttttttcccatttcatttatagactctgcaatttcaatcaaaattcttgcaattagtttggcaattagttctgctgtttgcagaacaaactgattctaaatttgttatggagaggtaggaatctagaataactaacacaacactgaaggagaacaaattcagaggacatagactgcagggtttccagacttcctataaagctacaataaacaaaaaagaatgattttggagaatgaatagacaaatcatccatgggacaaaagtgagctcagaaacagacccacgtaaatatagtcaactgatcttttactaaggagcaaaggcaatacaatgaagaaaagatagtctttttttttttgctggaacaacttggcatccactttcaaaaacatgaatctagacacagacatttgcatgcttcacaaaattaatatagatcatacatccaaatgtaaaacaccaaactataaaactcttagaggataacataggaggaaatctagattaccttgggtatggcgatggctttttagatataatactaaagtacaatccatgaaataaataattgataagttggactttagtagaattaaaaactactccatgaaagacagtcaagagaataatcagacaaacctctgactgggagaaaatatttgcaaaagaaacatctgggccaggcacagtggctcacgcctgtaatcccaggactttgggaggccaaggcgggtggatcacgaggtcaggatatcgagaccaccctgggtaacatggtgaaaccccgtctctactaaaaatacaaaaaattagccgggcgtggtggcaggtgcctgttgtcccagctactcgggatgctgaggcaggagaatggcgtgaacctgggaggcagagcttgcagtgagccgagatcgtaccactgcactccagcctgggtgacagagcgagattcaatctcaaaaaaaaaataaaataaaataaaaattaaaaaataaagaaacatctgacaataccattcaggacataggcacgggcagagatttcataatgaaaacatcaaaagcaattgcaacaagagcaaaacttgacaaatgggatctaattaaactaaagagcttctgcacagtaaaagaaactatcatcagagtaaacagacaacctacagagtgggagaaaatttttgcaatctatccatatgccaaaggtctaatatccagaatgtttgaagaacttaaacaaatttacaagaaaaaactaacaaccccattaaaaagtgggcaaaggacatgaacagatatttctcaaaagaagacatttatgcagccaacaaacatatgaaaaaaagctcaacatcgctgatcattagagaaatgcaaatcaaaatcacaatgagatatcatctcatgccagttggaatggcgattatcaaaaagtcaagaaacaacagactctggcgaggctgtggagaaataggaacacttttacactgttggttggaatgtaaattagttcaaccattgtggaagacagtgtggcgattcctcaaagatctagaaccagaaataccatttgacccagcaatcccattacctaccgggtatataccccccaaaatataaatcattctattataaagatacatgcatgcatatgttcactgcagcactattcacaacagcaaagacatggaatcaactcaaatgcccaccaatgataggctggattaaaaaaagttgtacatatacatcatggaatactatacagccataaaaaggaatgagatcacatcctttgcagggacatggatgaagctggaagccattatccttagcaaactagcacaagaacagaaaaccaaacactgcatgttctcacttataagtgtgagctgaacaatgagaacacacggtcacagggaggagagcaactcacaacggggcctgtcaggggggtgggaggagggagagcatcagaaagaatagctaacggattctgggtttaatacctaggtgatcagttgataggtgcagcaaaccaccatggtacacatttacctatgtaacaaacctgcacatcctgcacatgaatcccataacttaaaataaaataaaactttttaaaaaaggaaataaatataggctaggcacggtggctcacgcctataatcccagcactttgggaggccaaggcaggtggatcacatgaggtcaggagtttgagaccagcctagccaacatgatgaaaccccatctctactaaaaatacaaaaaattagccaggtgtggttgtgggcacctttaatcccggctactccaggggctgaggcaggagaattgcttgaactaactcaggaggtggaggttgcagtgagccgagacagtgccactgcattccagactgggcagcaagagtgaaactccatctcaaaaaaaaaaaaaaaagaaaagaaaagaaaatataaaaagggctctcgaaattcagccataagaagaacaacccaattacataatggacaattgtcttgaacagacactttaccaaatatatgggtggcaaatgagcatatgaagagatgctccatgtcatatttcatcatggagatgccaatgaaaacaacaatgagataccactacacacataccgtgatggccaaaatccaaaacaccaacaatgccaaatattggtgaggatgtggaggaaagacagtctcatttatcgctgtttggaatgcaaaatggtacaacctttttggaagacagtttggaagttttttaaaaaaataaatcttaacatactcttaccacacaatccagcaatcccactcattagtatttacccaaatgaattgaaaactgtgtccacacaaaaacctgtataatggtgagtggtgactatctgggccatggcacaggtggtaaaagaatttaccaaggcaattgtaggtaaagaaaggcagatttactagagaaagtaggaacacatgttgcaagggtgcaacaggcagggcagcaagagaggagctgactgccaggagacaaaagcttaccacggattttgtggaatggtgtttgtgctgggtgctgaagtgggctttgtgcagtgctgataacgccaaaattgcagtgagctcatttgcatttttctatcagccaagggtctggtgatagctgggtgcaggaagattgtaagttatttgtgcaggaggactgtgcgtcctggaccatgaagaaaaggcaaactcatagcttatctgctttctttttttgctttccctccatcctgccagcctgactaccctttcccaattaggactccacaatctgcacaagagcatttataacagctgtattcataattgcccaaacttggaagtaatcaagaagtccttcagtaagtgaatggataaataaatgtagtaaatccagccaatgaaatattattcagccataaaaagaaatgagttcttaagtcatgaaaagatatgaaggaaacttaaatgtgtattactaatgaaagaatccaggctacatactgtattccaactatatgtctttctggaaaaggcaaaactatggaaacagtgaaatcatcaatcgttgccagagattaggaagtaggaagggctgaatagggagtgcacggaagatttttaggtcagtgaaactattctgtgtgatactataatggtgaatccatgtcctcatacatttgtcaaaacccatcgaatgcacaacaccaagagtgaaccctagtgtttattatgaactttggatgataatggtgagtcactgtaggttcttggactgtaggaaatggactactctggtgcatatgttgatagtggtggaggaggagaggttgtaggggtttggagaagaagggcatggaacttcctgttctttccacccaattttgataggaacaaaacttagctcttaaaaattatgtttattaattttaaaaacaaacaaagaatacctaatttttttacaaattgctctaatttcatagaattgcacattaaaaatatgagatactacacaaaagaaattatagcagtgctttagacaggaaaggggcatgagagaactttctggaataacagtaagttgtatgtcttgatagggacttgggtcgtactgatatatgcaattgtcaaaactcaaagaacatacacctcagatttgtgcatttcaatcaatgtaaattttatggtaaaactaggattttaaaacaagtattaaacccttgttaatgatatgcgcgctaaagtatttaggaggaagcactacctgcaaatttcttgaaaacacgtgaaaaataacatgaactaatggacagatagaggcaaaaatagatctacagatgtgaattaaaacaaagattaaaatgttaatgataaaatcttggaggtagatatatggtattcactgtaaaaattctttcaactttattgtatgtttgaatatttgcataatataatgttaggggaaaattgcagcagagataatattctaaatagctaaaaaaaaatttgactttcagaagaccagactcattgagagcgaaaaaattatttttgttttgttgttcgtttgcttgttttttaattctggcaacggcagaggaactctgactcctggggtgcagaaaaattgtctgtggaagccccgtgaaggaggtgggggaccgctgcaaaagcaaggaagaggacgaggatgaggacgtctgggataactgggatgatggtgatgacaggaaaaagaaaaaagaggaagcagaaataaacattttagaaaagaaaaaactaacagagaagataaaagaaagaacggcaacagaagaaagggcaggaagaaattaaaaaggggttagaagaacctgaagaactccagctgctaacaccagaggaacaattagcagataaaccgcagctggagaaatcacaggaagagtcagacatggaattagcaaaggcaacttttggtgttaagactactgtatatggatcggatgctgtaaacccatcttcaagggatgaccttacagagtttggaaagttactaaaagataaaattacacaaaataaaaagtcactatattatgccagttttttggaagtcttagttggagatgtgtgtatgtcattggaaactgatgacttgaaaaaggttctcaatacattgtgctttgaagtgaaaaacagaagcaagcaaagccaagccaaaaagaagaacaaaggtatggttcctggagggagattaaaagccaccatgacaaatgatctggtaaattatggtggtgatgatgcagggtatgcacaagactatgaaaatgtcatgtgacattgcatcttttcctggtgtcatctttatgttgcccacgaccccttcaacgcacagcacaacttcctttcctttcagttctgccaaatgctacaatccaaagtgcagtctctttcgtgctggttatttaaccccttgacacttaggtgttaacgtgcaaatgagggagcttggatcttgctgccaaggggttaaaatcaggaacctcaattgctactaaatcatagtccaaaacaaagcaaacctaataatgtcatttttggtttcagatttcatagcggcagtcactgaaaattggaaacaaaaggctgcaacaagacaaaataaattgtgtagtactcaacagcactattcagtaatacagccttaaccatacctccttgaactacttcataacttgtcaagaaaagcagctgcagcaagggcatgtggcatgcacctagtatgaaaattgctttgtcttaaaattgaatgtgaggctattaaaaatacattgtgaagaagactgcttatgccagagtgaagatactgtggctgaaaagcactagtttgattaaaattaaatgaccaaagccttccaactttgaatctgaagagggtaagcctctccattataacatcacatgttgtggattctcttgaatacaaagactgtctagttactgaaaccacctttgcaaaattatgactgagacagtgaaagagatctaactgaattgattccatcctgcttctaacctccaagctgtccttgttcattcttgggtgtaggctgaagtaactttgggagaaacttagtttatagtttaaaacaaagacgataacagccctatcccaaagcagacttcctccttgcctggggactactgcctttgcaggactaacattagccacaagattagaaattatggtttaggagtcatgcagctggaggctgcaagattctgaccctccctaacctgttcctaagatcagtgcgtgagatattttgcagcccctgcacttaatgaatcagctggcaccacccagattaataaactgtctcatctgaccttgtggccccacccaggaactgactcagcacagaagacagcttcgactccctattatttcttctctgaccaatcagcagtcttggctcattggcctctccccacccaccaagttgtccttaaaaactatgctccccaagtgctcttctgggagactaatttgagtgataatacagctctggtctcccacacagccggttctttgtgaattactctttctctattgccattcccctgtcttgagaaattggctctgtctaaacagtgggcaaggtgaaccccttgggtggtgacattacttatcaaactatttctactgatgaagtgcttcagatgggggcttcaggactctttacctgtttttgtttgcctgatttaagtgtctgagaaacaaatcttagttctcctgggctgcaataaaacaactttaccagggttttggcatttcctttcttttcctttataaaatatgctcaacaaactgcaccagttaactacagtttgataaattgctaacaattatgacatttgcaatgatttataaagcaactatttcaaataaataaattacaaagagcattaaaggagtttattctatgaacaaaagacagcagtttctgccccagcctagagaaggttcagaacatgagaaggatttgaaaggagagcagagaagtcacctttgggtgtgagtccctgagccacagaggtaggggatgggagacaggggaagggtcaagaatatgcatttttgcacataggagtctatggctataaaactgctcataattaaactaaagagcttctgcacagcaaaagaaactaccatcagagtgaacaggcaacctacagaatgggagaaaatttttacaatctacccatctgacaaagggctaatattcagaatctataaaaacttaaacaaatttacaagaaaaaatcaaacaaccccatcagaaagtgggtgaaggatatgaacagacacttctcaaaagaagacatttacgtagccaacagacacatgaaaaaatgctcatcatcactggccatcagaaaatgcaaatcaaaaccacaatgagataccatctcacaccagttagaatggcgatcattaaaaagtcaggaaacaacaggtgctggggaggatgtggagaaataggacgcttttacactgttggtgggactgtaaactggtttaaccattgtggaagacagtgtggcgattcctcaaggatgtaggactagaaataccatttgacccagtgatcccattactgggcatatacccaaaggattataaatcatgctgctataaagacacatgcacacgtatgtttattgcggcactattcacaatagcaaagacttggaaccaacccaaatgtccatcaatggtagactggattaagaaaatgtggcacatatacaccacggaatactatgcagccataaaaaaggatgagttcatgtcctttgtagagacatggatgaagctggaaaccatcattctcagtaaactatcgcaaggacagaaaaccaaacactgcatgttctcactcataggtgggaattgaacaatgagaacacatgaacacagggcggagaatatcgcatactggggcctgtcgtggggtgggaggagaggggagggatagcattaggagatatacctaatgtaaatgacgagttaaccggtgcagcacaccaacatggcacatgtatacatatgtaacaaacctgcatgttgtgcacatgtaccctagaacttaaaataattaaaaaaaaaagaaaaataaaaaacaaaaataaagttaaaaaactgctcattattatatgttaatataaacatactacatgttattatatattaagtttatcccaaatgtttctgacaatgtattaggttggtgcaaaagtaattgcgatttttgtcgttacttttaaatggcaaaaccgcaattatgtttgcacaaacctaatacatattaaagacaattttcaaactcatgggttctagaacccttgtgagaacagtcagttttcctaatgtaacttctaaaagtacttattaggtgggaaagcagtgttctttttttttgaaatagggtttctggttctgtcacccaggctggagtgcagtagcgtgatcgtgactcaatgcaacctccacttcccaggctcccaaagttctaggattacaagcatgagccactgtgtctggccacagtattcttgtgatcattggaatctgtagtgtaatcccaccataatgatttggtaatggggtttaaggtcccacttatacttagaaaagaaagttttaataacaggaataaattaaggggataaatttttctgaagttttgttgaaactttaaagagaaaatcttacaacatgaaggctaaaaagatttcctgaacaaaagaaggctaaggcacagttaaataaaacagtgttcgttactgtcaatttgcacttggtttctggtggcaagtaattggggtgtgtccttgactggatctctcaatgagatttatcagtcatttgaatgaatatggtggtgacgcttacaggaagcttgaaggtactttaaatgcttttttactttgtaatttttgtgggtacataataagtgtatatatttatgggctatgtgagatattttgatacaggcacgcaatgtgtaataatcacatcagagtaaatggagtatccatctcctcaagcatttatcctttctttgtgttataaacaatccaattatattcttttagttatttttacacatgcaagtaaattattattgactactgttaccttgttgtgctatcaaatactaggtttgtttcattctttctatttttttgtacccattaaccatccccacttcccttgacactcccactacccttcccagcctctagtaaccatccttctaccctgtatctccatgaggtcacttgttttaatgtttagctccacaaagaagtgagaacatgtgaagtttgtacttctgtgcttgacttatttcacttaaaataatgacctccagttccatccatgttgttgcaaatgacagatttgattcttttttatggctgaaatagtagtgctttgtgtatatgtaccattgtgtatatgtatattttctttatccattcatctgttgatggacacttagattgctcccaaatcttggctatcctgcaacaaacatgggagtgcagatatctcttcgatatgctgatttcctttcttttgggtaaatacctagcaatgggattgctggatcgtatggtagctctatttttagttttttgaggcatttccaaactgttctccacggtggttgtacttatttacatccccaccaacagggtacaagggttatgttttctccacatcctctccagcatttgtttttgcttgtcttttggatataagccattttaactggggtgagatgacaccaccttgtagttttgatttgcatttttctgatgattagtgacgttgagcaccttttcatatgcctgtttgtcttttgtgacgttgagcaccttttcatatgcctgtttgtcttttgtatgtcttcttcttcttcttcttcttcttcttcttcttttctgagatggagtttcactctgttgcccagttgcccaggctggagtgcagtggcgtgatctcggctcactgccacctccacctcccaggttcaagtgattctcctgtctcagcctcccaggtagctgggattacaggcgtgtgccaccacacctggctaatttttgtatttttagtacagatgaggtttcaccatgttggccaggctggtcttgaactcctggcctcaagtgatatgccagccttggcctcccaaagtgctggaattatgggcgtgagccatcacacccagcctgccatttgtatgtcttcttttgagaaatgtctattcagatcttttgccaattttttaatcagattattagacttttttcctatagaattgttggagctccttatatattctagttattaatcccttatcagatgggtagtttgcaaatattttctcctattctatgggttgcctcttcactttattgactgtattccttgctgtgcagaagctttttaacttggtatgatcctatgtgcctatttttgctttggttgcctgtgcttgtggggtgttactcaagaaatctttgtccagaccaacgtcctggtgagtttccccaatgtttttgtgtagtagtctcatagtttcaggtttcgaattttagccattttgattttatttttgtatatagtgagagataggggtctagtttcatttttctgcatggatattcagtttttccagcaccatttattaaagaaactgtcttttccccaatgtttgttcttggcaactttgtaaaacatgagttcactgtagatgtgcttgagggcacacacaaaaatccatcccaccccactaagccacccaaacaaacatgaaagacaaaaactgtttttgttggggaaacacagctctggaactaattccctgggccccttgttaacaccagcccctcctataagaaaatgatttgtcgaagcttcagtgaccattgaagggatgctctataagacaagtctgttgactgaaagagacagaaaccaatgttgaagctacttatgcaagaggaggacctgggtggcacagacctggctggatgcagggctcacagatcgtcatcagcactccatctcttcccaccttcaggacctactgtcctctgttttgcacacactcccagccaggctcactttttatcctccttggaggaaagtgggtttcccagttgtgtctgggctggtgctgcttggccctgcctgggtcccatgctggcctcaggatgagagggatggtcacctcagctacagcacatggattgctctgtgaaaagcaatctccacaggaaaccaggatggcttcaccagggaggcagaacaacaaatgcccatgacagagggcatgcaccgtgaataaaagaatcaggattttaaacagaaaggcagaaagaagaggacttccaaaccctagaaagtttaaaactaatagaataaaatttactgtgcgtaaatgtaaagccttatgttgagattaaatatatgtatgtgtgtcaaattttatctaaaaatatatgtagccaaagagtcagaaaaaataaaaataaaaaagtaacaaaagtaaaacaaaaatatatgtagccatattcatgtgatgcaactacaagaaaaaagtagaaatggtttagtagtgtccttaaaaaaaaaagtcttagtttttggttgctggtcactttgagatggttatcaacgtgatttggacactttaaaagtttgcaataatgagattaaaaagcaagataaaggaggaaatagtgctgttaatgcctatttcatggtgtcatgtctggaatattgtgcttgagcctgggggtgcgggtgggggtgacattttaaggacactagcgagcattcaaagaagaatcagcatccagctcgtgaaaacgaccatgacacctccccttccaccccccttgccccagagcatgccattttaaggattattttgagtgtaaagaaactaaaaatcaatagatagaagattatttctctgctctcccctcggatgcctaaaacccgggcataaatttccctttgttaaggtggcatggatttccccctctcctgtaccaggatgaggagagggaacacttgtcaccagggacagagagccaacaccaaaataagtctgcataaacaagcctccctaaataagcaggataatccattagttcccacatagttttcctagtcacttttccacaattaatcattcctcaaagcccaaatcttctttcctttgttaaaatggcacataagcctctgagtttagccatttctttgactttcctttcctttctgtgaactcctgtgtatgtaaaatattagtaaactttctattattttctcctgttaatctgtctcttgtgagtcaaacttgcagagcctcccagtcagtgaacctaagagggaagagaaaatgtatttccttcctggcactacaaatggtgcatgtttgttgaaaggaagtacttaactgctacacggcaggaggtataatccagacagaagtaagaagtgtgctggatattagaatattcctgctcttcataagtggatgaattatatgaccaccaattttccagtactcctaaaatttttgatcccaaaggtaccttaaatccctctaaaacaagaataaaaaaattgaataccttgttgagaaacagatgttcagaactttttcatcttgtagaatggaaactacacctattaaacaacaactcctgttttcctccccatcccagttcccactaatcaccactctactttctatttctatgaacttagctgccttagataacttgtataagtagattcacacaatattttcctttttgtgaccatgctcttactcttaggacaatggccttagggttcatccatggggcagcacgggacatgatttccttcctttctaaggtcacagaatgttctattgtgtgtctattttcaaaggaggaattctggagatgggtgattatatcaacactcacggtatcttatttaatttttaacacaaaattatgaggtcattgctgttatacacatctatagtggttaaaatcaagccttcgagactgaaagtaatttgcccaaagtttatgcataccagaaatgagacttgagttatcttcttcccaaacctttgccattgagtaggaaactcataaagtcaaagggcactggaattgttgcttctattggtttgtcatttttttccacttactgttttagtgcagacatgtctgaaatgcaaacaggttttaaaatggaagctttggagtattccgtaattatggctatcaacgtttagtatttccagcaaaacattcttatttatcaacttccccatttatctcaatcaaaataagtaggaaaaagaaaaagcataaatagttctcactgcttctacaatccaaaagaaaaataaaaaatataagcgagaaatgcaagttcagagaagttcccaattttcttccctttcatcattgggcaaaatgatcaaactattcttgctgagtgggcaactccccatggtacttcagaaaggctttgttgcctggtgtggcaatgcctaaaaattccttagatgctaggggaaatgcaacagcattgtcccagatgactgtactatgctgtttttctttttcttttatttatttatttatttatttatttatttatttatttatttacttttgagacagagtttcgctcttgttgcccaggctggagtgcaatggcatgatctcagctcaccacaacctctgcctcctgggttcaagcaattctcctgcctcagcctcccaagcagctgggattacaggcatgcaccaccactcctggctaatttttctattgttagtagagatggtgtttctccacgttggtcagactggtctcaaactcctgacgtcagatgatccatctgccttggcctcccaaagtgctgggattacaggtgtgagccaccgcacccggccactatgctgttattcttgatatcactagattagatattttgttgagtcttaccttaaatacccttcatgctagtttgtaccagtaatctcacacacctcaagctgtttctctttctcttcactgtccctccatggttccctgggagaggggcagcagaagaaggtcccagctccctgtgtttgaaaactgatgggttcaggcaggattggtggcccttggcttgccagcccagatgccacccacatggacctcttgcattgtcctgcaggactctggcagagttccagaatccaccaggcccctgagaatggagtggtgaggccttagaggaccgctgctgaggacactggctagcttctgatgatggggactctctaaagaacacaggagttctaagttccctgaggcacttctaagcatctctaggatagcaaggagggtctaggattcctgtgtcctgggggcaggagaaattccccaagtccacctgagacccactgagctgtgggcaaagtgccagggtcccggggagttgtagccaaattagcaacaattcttctcttagcctaattatcattctgccatggtatttactgggtgtctatcatatactggggacccctacactgtaaaacaaagtctctgtcctcaagatgctttggttggggagatgggatatgtaacagttttgtttgtccttctgatataactaaaacatgtttcttatatcattcaaatcattatttagtttcatttatccctttgaacttggggaaaaactcactcgtttaccacttcacatatttcttaatcaaattctactcacttccgcagagtcttgcaaccatccctgacactactcctgagtgttgcatgtcagtaactttctacatgaagcacatagaaatttggaagttggaagtgtgcatgaggagtagggtactgtgcactgtgggtggatttagaggattcacaggccacatccccagtgtagacaataattagcctggcaatggtgaccttgtatggaccttgctccgtgaaccacaaatctgggatgctggccaaggaaacactcaggcagaacaccccaacaccaaggctttttattttattttattttattttattcttttttatttattattattattattattatactttaagttttagggtacatgtgcacaatgtgcaggttagttacatatgtatacatgtgccatgctggtgcgctgcacccactaactcgtcatctagcattaggtatatctcccagtgctatccctcccccctcccccgaccccacaacagtccccagagtgtgatgtaccaaggctttttaattgcccggcagtgggactgtgaacctgggagacctgtgccttcagccattgctgattcctccttctagagtgggagatcagcacctggacagaggacactgtgactagaaaatgcatttaaaagaagggattattgcttcctcggatcagactgtgtgatctacaatgaactcttacatgttattttatctggcattctaacaatgatcccaaagaaacatcagactccttgttcagaaggtaggttagttctcagcagtacaagttgggtcctcagtggatcctgtgcatttgaggatgaagtttacagatgctttggaccgtagctgcaggtctgatttgaggacaatgagaccaagtcagggaggcagcaactaatgggggagggaataagacacaagaaataacaaacataaagtaccagagtggacttagtaactcagcagaacttccaaatctcatattgagattgccctggttttggcatgttgaagggatcatatacagggaatggggaatgcctaattatatgggtctatttcctctttatggtctcaaagatttttttaagagtttataggattatttttttaattacataagaaagatttaatttttaacatcttaaaatggttacagttcatgaataccacaagacaacctaaaaaggtgcagtctagagtagcctatttggctgttagtagcaaaggttttgaccatggtcaatgacttaatatccatgttagtcactcctgagttgatattactgtaatttttttttctcattgacttgggtgatagcataaaaagtatactcattaattttacaaatgacaaatgtcagatgttacaacttattttaaagggattcctgtggtacttcaaactttactaaagacaaaacaaacggtttttatcttcataattgttttgcttcctggatctctcccttctgttcatgatatcagtgacttcactgccaaggctaaagtgatatcatgaaaagaaaagagaaacccagaaagcaaaacagttatgaagataaagaccatttattttgtctttagtaaagtttgaagtaccagaggatttctaggtaggtctagtaaaaaaaaatgtaaagtttgaagtatagcccagtcaggaaagaattcagtgttaacagatacatatttcaaagtcatccatccacatggaattggaagctgatattataaaagtggttaacatgaaagaaaggtcaaggaaggacttcggtgaatgtctatattttggggaatacatggagggaggcattgtataagtcaggagtaggcaggttatgaagtggtaaaaacaaccttaaaaacctgaatggctatatcagtttgtaattgcagctgggcccaacttagctggatgcctctgcctcacagtctgtaaggttacagtcaaactacagactggggctgctgtttcatctgaaggctcaactggtgctgcaggatgtgcttccaagctcacacacgtggtttttggcagacttcagtctcttaacacatgggcccctttatgaggctgcctcatgatatgacagttggttttccctatggaaagcagtccaaaagagagagagagaacaaccaaaaaagaagctgaagtctttcgtaacctaagctcaaaagagacattccattatttctgccatatgcttttcattgtaagcaagtcactaaatcaagcctaaactcaaagatttaaaatgaacgttttgtgtgtgtctttagtagaattggcaaatacacaaactttgtgtgtgtttacttatcacacatatgtgtgtgtgtgtgtatatatatataaaatatgtttgttttctttttctcttattccttagtcatgtaacataagatgttccaactatataatagtgtttaaatataattaatttcatatcttagtgtttaagctacatggtatcaaagaggaaacatcattcaaagaccttaccttgtcttctaggaaaacggttagtgcattgtcaattgtatgtatcaggttaatcagaattatgaccttctgattatctttctttgaagattgagtatggtttcaggagatgcatatgggcaccaagttgacaaggggcagaattgaattgttctggttaatttcatgtgtcaacttgactagtccctggggcatccagatatgtgttccaactttattctaagtgtgtctgtgaaggtgtttttggatgatattgacatttgaatcagtaaactgaggaaagcagattgctctgcttagcatgggtggccttcatctgatcaatgaaaggcctgaatgaatcaaaaaggctgacccttccatgagtaagaagaaattccttttgcctgattgtgagctgggacattactcttcttgggtcttgagactgtcagcttttagactagaactataccattggcttgccagggtgtctacctggccaacttcacatcttaggacttctcaacttccataaccatgtgaggcaattctttgtttttttcttttgagatggagtcttgctctgtcgcccaggctggagtgtggtcacgcgatctgggctcactgcaagctctgcttctagggttcaagcgattctcctgcctcagcatcccgagtagctgggactacaggcacccgccaccacacctggctaatttttgtatttttagtaaagatggggtttcaccatattagccaggatggtctcgatctcctgacctcatgatccgcccgcctcggcctcccaaagtgctgggattacaggcatgagccactgcgcccagcccaccaattcttaataatacatttatctgtaactatatctctcttcttttatctacttcctgttggttctgtttctctggagaaccctgatgaatacagcctttatgaaatctttccatgaatccaagaggtctgtgaatacaaaattatgaatccccacctgaagactttttagtgctaggactccttcacaaggcagagaatatatcagaccaatttagagtcaagtcttcaaggatccattgccttctcttaccttattcaactgttcaccactcacaaactttccatttttaccctcttgccttagctccctcttaccccagtgcacatatttgggtcagggctgcatgacctctcatgcctcatcctcagctatgataggcagatggttatgatcctagagacctgcaaaagagatggcttgtgggaccttttgctactgccattgcagcctttcctgttgaccccaacctcctcatcccccaagccccctcagttccttgcagttgtcatctcaagcactgggaaagggtcaatgttttgggtaatatgcatatggcaacaatgtaggcttctcatgcccctaattactgcctgcagttgtggagttattgctcaataatctgatttatgaactaaaacactggggttttaacaataaataaccaatcacgtttaggcatttggaaagaacaatcatgtgattggagggtaagggaagattgacaccagctgatattttcttgagaacattcaaaatttgttttcattgaacctgcatatagtataatatggagagataaggtggaaaaggagcaatattttcctttgattgatatccggccacccttgggaaaaagtgtactgtcacaggattatatttttataaatcgattatcccctagagatcattacagatggtgctaaaccatttttaaaaaaatattgaagacaaaggtaacaattttcataatgaattgacttctaccttagagaaatccctataagaatttgaatctgtaaattctccactgatccatccagggttggctaagatggcaggaggaggggaagacccacactgtgagtgtcatttagttcagatttcttggaggataatttggaaatctttacagaagttttaaatagtatactaattggtggagcaattcccccaagaatctagagcaatagcaatacaaatatgggagaatatttgtatatcactgtccaaatctataattggaaaaatgttatactcctggagataggctgagtgcctaccaataggtatgtccacatgaagaaatcctatgtagccatcacagccaggaggaacaagttccagagatctgttgtacatcatggtgactgtaccatgatggtgactgtagacagatcattaattatctacagttaataagaatatattacatacttctaaattgccaagagagtagattttgagtgctctcatcacaaaaatatgtgtgagctaatgtaaatattaaatagcttgatttagccattgcacaagcgtcatattttatatcatatatatatgatttttactcatcaattaaataaataaatacataagtaatgttttaaaaaggataacatagatctatatatgtattgccatagagaaatgaatgtgatatattgttgagttaaaaataagtggcatatacatttttatctgatataaataaagaaatcacacagattaacttattttttcagacaagtgaatcacatggtaagcagctgagaatcactgtacagagtatgtatttttggtttctaaaaaatttccttcctattccaaataagtttggttttttagaatcacttcaactaccttcaacttctatcctgttgggtggaggggagcagccactcttacttactcttgaggcagaattggccctctctttgggccttgaaaagaacactcataagagaaatgttttttgccttgccagccctgcagggatttgcatccgcgagggaagcatggctcagttataggcagacatcagcaccacatggttccctgctcctcatccacctcaaggcagcatcaggcaccattcatctttatatccatgtctatttgctgagaccctgtgaatgtagcatcagcaggttttatgactcagaaccagtttcttctcatttctcttcacagaataaaaaactaaagcttagaggggtcataaaggtgtgctctgattctcacagtggaaggaggccccaataacctgcacccatccccacctggtctccctcacctacttgggaatgagcccggggagcacaggctgattctgggatgatgttagagaggtcctacatcctgcgggcactttccactccacgttacccagtgagtcaaagtcttctaaaaagacatttagtcattcaaaactggtgcagatcccagtgtccagggaggaactttcactctggaaaacaggagctcatttccctttgaggaaatcatttctttaggatatcatttccagccaccacccaggatcctgagcaggtgctgcagctcccaaagcaccactgcggagaagctcaaaccttacaaataccatgttattgttcctgtggaggactgcttctcccagagataatggtactgataacttcaattccacgtggccttttaaccaaaagacctcaacacctctttatcgagtgatggctatatggccacttttctttgattttttttttttttttttttttttttttttattgatcattcttgggtgtttctcgcacagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaaggagcatgctgccttcaagcatctgtttaacaaagcacattttgcaccgcccttaatccatttaaccctgagtggacacagcacatgtttcaaaaagcacagggttgggggtaaggtcacagatgaacaggatcccaaggcagaagaatttttcttagtacagaacaaaatgaaaagtctcccatgtctacttctttctacacagacacggcaaccatccgatttctcaatcttttccccacctttccccgccttctattccacaaaaccgccattgtcatcatggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccggacggggcggctggcctggcgggggctgacccccacctccctcccggacggggtggctgcc

SEQ ID NO: 664 - DNA, 11602 bp, Human
ttctaagagaagggctcagttattattggagggtgggtgtgggggtgccagattctaaagagtacccaggccctatagaaaaaggcccaaattcttaagcagaacctagattcgataaacagggatatatcttttctaaaatggaatttaaagtcctagaccaaaccagcaagttcctgttcactatcaatatgagcagcgtctctgccaactgtgggcccctacagagagaagctgcccttgtggagcagggaatatgatttgagtggagggggctgggatttgtggcacctggagtaagcaggttagcatcatttgggtgaaacaaatctctctggggatgaggagcctgcagggagggagagctgtttgcagagtcccccactcccatcccaaggggcctaatttatttgctggctcctgagaaggaagaagagatctcctggggtggagaggagcccagagaaaacagagactactctcacctggcagcagtcagacactgaacctattctggatagcaccgcccctgcccccagcctagcacctgaggctgacttgtggtcaagactctgtcctgccacagataagcagatagggaggtgcctgcatgttccctctcctgaaggatagaagcaaagtagcagcatgcctgtctccctggacacaggtggttggcttgcgttctgagaacccagtcaggcctggttccgcctggtctgggcctctccaaaagagaagagataagggacagatagccctaggtctggtttctgaacccttttcctgaacttctacttcctagaaagagagaagaggagagcaaggaactgtgtgtgtcaggatgcatgtgggtttgtgtgtgtgttgtgtgtggatggatataggtgtgtgcttgggtgtctctgtgcctgatctctagcagtctgatagtaccctttcctatgtgtgtctggaaggtgtacctgtgtgtccatatgtctgtgtcaggcacctgtgtctctatgttctctgcctttgggtgactgtgccttttttcctgaatgtgtgtgtgtgatgtgtgtgcttgggtgtcactgtgaggacaatgactgtggtgagagctggaacacaaggtgctctgccctctgactcaggatcagcgtctctgagagtaggagtgagaatccctggggacaaccctggctgccccgggaggggccctgcctaagtgccagtgaggaatcctttgtaggtgtccagggaaccctgctttgccccagctgactctctccttgaccccctcctgcgccttgggttctggaccactgaagactcttacagctcccagtattgacattctcaggggctgagctcttttactctgcctccaagataaacaagcctcatgctcagctgggggcttcaggtcaccagctgtcaaagccttggtgccagctgaggacttctccaccacccttctgtgcccacctgagtcctcatgcacacgggaaaagggggcatggacgcagcagagggccacagttttcagaagggaaggggtccagccctacttactaagaggtcctggatccccaacttcttctcaagtcttctccttcccctcattcccagagatgattgggcttccctgagatcgagatccttatcttgggttcccaaatccttctgggaaattcagcctggggagcaaaagacccaggaccagttgtagcaaactgaactcaagaaggagagacgaggcacgcgctggtctttcccgagggggcagtacggtccccacctcccacgcgtcgcgcgctcccgaccggagcgggacggggcctgtcgggggcgcgccaggggcggggcttcgggggcgcgcccaggagggcggagggaagggctgggggcgtggcctaaggctgggggccgacggcggcggcagcagggagctgggaagcggagaagccgggagcgcggggctcagtcggggggcggcggcggcggcggctccggggatggcggcggctccgctgctgctgctgctgctgctcgtgcccgtgccgctgctgccgctgctggcccaagggcccggaggggcgctgggaaaccggcatgcggtgtactggaacagctccaaccagcagtgagtcggggaccctgggagtccgcgcgtcccgtctcagtgagagggggagccggtgggcccgagaagtcctgggggatcccggggtgggagtcctgggagaccagagctgggggctgggaggggacggagagggggacgcactctgtgggcgtctaggaaactcgggggtgtctgaagaggctgttgggctatagtaaggagcgctcgggccgtgtggaggaggctgctggaggggccccccaccccatcttggcttctctccgcacccgccgctggaatagcatgcccctgtcccatagtcccaccagttgggctggggtttgggggtagcgctgtgctggggataggccgctgcattttggggcccagggatgacctgtttttggccatgagggcttccaggggttctgtctaggactcctgcttttaaaagtggggtccagagctgaggcagggagtccgaccgagcacctccctagaaggaaggcgaatgggttgtcttggttgtgtggataagcccggctagggtgagctagggctgggtcgctgagttggggggccctgggaatgctgcttggttaggatgggaacgtggggtaccggcgagacggaaggcggcagagagatgtcggtgtgtcacacacgcacacacacgcccgggctggggacggcgaatggctccaagtgtgagcgggcgtgcgcggctgtcagtgtgcgtgtgtgtctgagtgtgtgatttgtgtgtctgcgtcggcgatcgtctgggggtgggagcgggctgcgggtcggggaaggggctgcggtcgctgtccgcgcggccagctgcgtctgggctggggtggctgttggcgccgccgcggtctgggcgggtgtcagggcggccgtgtggtttcccggggtgtgtggcgcggtggccgggtgctggctgcggggccgggtcctcattctgctcagtccttgctgcccttgtcttctcctccccgccaagccgccgtgtgtatctccctggccacatcagtgtgtgtctgtgtgttagtagggggagatccctggggacgcgggggtcactgtcacacctgcccgggcggtggcggcagcactgcctctggctgcccaccccagggaccgaccgaccagggagcaaatggccagaccccaggggaggggaccgggagggccgggcggccgcgacccccaacctctcggaggaggggctgccgctcgccgctccgctctttgttgtttggggctccgcgcctccccctctctccctcctcgcgcccggagtgtcagactgggggtggggatgagccaacgacgcccccctctcgcttcccatggaaacctcgggggtggggacgtggcccctcccccccggagcgggactccaagaactccggggggcgctgggggctgactttccagctctatctagctcagccccctcccccagactcacacgtccgccccccaccccgctagagtctggcggggaacggagagctcgcaggtgaggggccccgggttccccgccacccttggagcacctcagcgttcttaggggaagccagagccggggaggatgcgggaataggtttggtggggggaggtgttgatcaggttcccctcccccgcatacacctgggcgcaggtgaaagctcagggagcgggtgggggagcccgggttccgggagcctcctttctgtcctctctactccgtgcgggcctgggccggcagaggtaggagggggcgcacaccgggccaggaggctgccgccgcccccgcctcgcttcccgggcctttgttgccgctgcgcccgggctccccggctccctcactgcggcagccgcggccccataaatcgtgagagcgacgtgctccggagccgagaatggagagggccggggagctgggggcggggccgaccgagccacaggctcccgcgccccctccccctagtcacgtgagctgggctcctggctcccacctcccgtcacgtgcggagggtctctgccccttggggtcacgtggggagggtcttgcgaccccgcctcctgggggggtcacgtgcgtcggcctcctttgacagacctggggactgtgccttgcacaccggccgcgacctagccctctgccccccactcagtacttccatttagtcccgtggaacaggagagacctgttcccaatctggcccagaaactagggatggggggactgtattggagcgatgcattagagtatgaggtcgaggagtcccctaagccgggaatcgaacttggtgaggggggttgggacggccgatggccaaatatatgccccctggcctgtgtttcatttctttgcagaactgagcaaggatgttggtatttgctccgttctcaaggagcttcgggaacatctttctatatagctgtctctcgacctatctctgaaatgcttctgttgctgatctctctttcattcatgcattcattcaacaaatatttattgaggctctactacgtccctgatggtctttctctgtgttttctcccagtctctgagtctcagccttgcacccttccctgtccctgcttctctcctttgcgtctctgtctccgtctccgccgtctgtgggcctctctggcctgcctgtctctcctgttctccaagactctcggttctcgttctcttccctgcctctctcggtttctgcgtctctctcgcactgtgtctcccttcctttcccctttcagtgaatccggcctctgccaccctccccttgtcggtgtgtgtctccccctcactccgtctctgtgtctcgctttcggcaggtctctcgctcctctccgccgctgcagatcaataaaccttcgccgccgccgccgccgctgtcgcagggaggaggggcggaggtgtcgggcgcgctgattctcccccacccgacgcggcccagggaagccttgcgcccagacctgggctgtccagactgggacgggcggggcgccgaggcccagggcgcctgaggggcgcagaggtgtcagcgtgcaaccgccgccccccagcgttcccgccaccaccgccaccaccctcaaagcccgggcgcgcggaccccacgccgcgcacacgtggtccggcctcgcctgctggagcgggcggcgcgcagcctcgggggcgcgcgctagagggaagaggaacccgggtctacattagtcctccacccctgtaactctgcagcccggcgtctaagaccggggctgggggtggaggatggcgaggatttgacaagttcagggccccctgggatcctttccctactccctggtcttgttggacaccctgtttacctgccctaattgccccgggctgggggagaagtttgctccttccccgctccgcccgcctgccccctccgcggacactccgggttaagtggagccaggcgcgggccggcagggcactgaaagcgagagagaggtgtcgggatgcgcctcagaggctgtgagagccaggagagaccgaaataacggggtgaggggacaccccctccaaatggggtgtgtcggcattcgcctttctgcaagagaggcgagaggctataggggatgaagtggagcaagaagagagaacagtacgaaggggcagggcacaacccggtccccaggtcccagcccacccccacccttccgcaggaggcgcggccctagaggcggggttagctgcggagcttcgcgtgggcccagcggcacctctctctccgcactgctagggagaaggagggaggatgacagattcaattaaagtgcccaagccaagcagacacgttgggtctccaaagagttgtggctgggaattcctggctctcaccccgtttgtccccgtgccctctgtgtaccaactgggcccagccaccccaccggcaggtctttctctcacatgcccagccttgggggggcatttcaggagctgttcctgccacccagcgcaggagtacataacagatggcttcccttcacctgtggtcgccctgcaaccttttttataaggctagtcctgccctgttgaggaaatggaattacctgtaggaataccttgggtgttggcttcctccctgctggaatggggtgtgttgtagggggaactgggcggtacagcagggaggggctgcttcagagtgggactggaaacatgggtgaggctcaaagacagagatcccagtgtggctgtgcagctgctccagacctggcaccctcaccactggaggccccctccccaaggcctgaggggaggaacagactgtgggttggtgacggacaggcaagcctaggatggcagtttggagccaggcctggtctaacccgttttcctgctcccagtgccgcaggccgaggctcctgcccacctgagtgccagggcaagggaggggcctgagtgacccattaatcccatgggaacagagtggggctggtggcattcctgatgaccaaaggaggctgtgccaattcttactggggtacccaaacatcagctctctgcctgcctcactgtcaggcttggaatgggttgctggtggaggggacagcacaagcaaagccaaggaagtggggtcaggggggagggacccccaaggccccaccgtgtgcagaagcctccacgctcatttctttaatggatctaattactgtttggggaactgggtggtgcctggtgacatagggagccagtctctccccccagggagctcccagggactagggaccccgtggtatgacattttgccaaggaccccatgcctttctgtgtccaccactctccttgcactgccaagatatgtgcattcttacgctaaagaaattagggaaaactcctgccccctctccgagtttctttctccattcagaggtttctccatccccacaccgctcactactgccatcgagggtgttaagaccaacactttgatggtgactagcaaggcaggtggggattacaagggacccagcatctgcttctctgtcccaaagagggatcagggaaataagaggcgcagccatcttgtctaggccctgtgcccactgctctgcccagcatcattaaggggggccgttgtgccaggttgaggaaggaggtgcacaatgagacagaagtttgggctggttggcatgatgccatgtggagtcttggtactgagtcccttagcgccctcatgtgtttaaagttcctgggagcctaactgtccttggcctcagggtggggtctctgtcacgggactcaaggtacagaagccagtgatactgtagtatggggagggcagggggagacccccagattggtggggtcaaccaatactggcatgcgggccagcacacatacagcccagcttttctgtgtgtctgctgcctatgagtgggcggtggacatatttgtgcgtgtgccatagaacttatgcatgtatatgcatgaagccgccatacatgcgtctgtaagggcaggtcctgttggactggcctccggggtggactggcagccgcagggaagcatggtgggagaagcgatggagggtgtgtgcgtccctcggaggggatccctcccacgttcacccttggcttccatccctcccatccctcctcccggctgctgaattatgggggatggacggaggaaatccgggcctgggtctgagagtcgctggggcctgcgccgtttctgtggcaaccaaagcgtacgttcccttcttccctccgcccctctccctcgcctccttttctttggaggcaggccgggcttccctgcgcctttgctaccctctggtggccaacaggagaaggacagaccaagaaggagggcacggaaggagacttaggggagcggcggcactagggccccgggggcagagacagggctgagccgcgaggaagctcggaggaaaagtcggaaggctacgcggaccctggggaggggctgcggagcggtcagatggaaagcggctttgctctggggtttcttctctctgagccgcttcctcttccccacagcctgcggcgagagggctacaccgtgcaggtgaacgtgaacgactatctggatatttactgcccgcactacaacagctcgggggtgggccccggggcgggaccggggcccggaggcggggcagagcagtacgtgctgtacatggtgagccgcaacggctaccgcacctgcaacgccagccagggcttcaagcgctgggagtgcaaccggccgcacgccccgcacagccccatcaagttctcggagaagttccagcgctacagcgccttctctctgggctacgagttccacgccggccacgagtactactacatctgtgagtgacggcggccgggcgggcgggtctgaacgcgagagtctgagtgacagccggggggtggagcccctaggctccggggcggggccggcgcggcgggcgccaggtctcgcggctgagaccagggaggaggcgtgggcacgggacgcctgaggggttcagctcagacgaggtcgtggggccaagagaggagtttggtgacagtcccaagtttgggctgcggagaatcgctgtttctgtgagggacattccggggttggaacatcagggatcccagtttcttgaggggtgggaccaaaggggcgtctagggccgacggcagagctaaagtgacccgtgtccaaagggtaggggagctcctgaaggagaccgcccgacggggacagtttggagggggtgagaaatagagccgtcgagggagggcacaggcacacattgggcgaaagtgactcaggcccggtctcctccccagccacgcccactcacaacctgcactggaagtgtctgaggatgaaggtgttcgtctgctgcgcctccagtgagtagaataggctccgagccgcgcccccatcctcagctccctgctttggggctcccctggcttcctgggggtgggggcggagggcacaggtgaggggggcttgctccccagccgtagcaaggggagggaatcctggccctgactctcccctcctctctccccacccgcaccccaccccgcagcatcgcactccggggagaagccggtccccactctcccccagttcaccatgggccccaatgtgaagatcaacgtgctgggtgagtctgcgcagcgccctctggtggccactgctggaaccgcagccccccgccccggtgcctgctcacctcgcatgccttccctgggggcactgatacttcctaccctgtgggtggtcacgtccctggctccattgctgctgccgcgtgcccctgccctggcgcgcaacccagccctcaccagtctgtctgttcctctgtccacagaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacagcgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataactgagtgtgtgtgatttcaaggggccatcacccttctgttacactggttaaacctcacagggcacagggcctgagtaggagagggaattctggggccaaagagtcacaacgaggtgttcaaatcttgttctggggctcatcttcattacaaaggcagcgctgcttggaaagagcaagaggggcctccaggcagggcctggttgactttgggcaaatcactcaacctctctgattctcaggtatcccaccagaaaaactggttgtggtatctctctcttagggttggtgtagggattaaatgacgcagggagttaaaggctccatcaattatggtttccaccttttcttccccttccatgctgtaattgaggttcttgactggagtctatggatttcaggggatttgagaacctagacagaaaaaaaactatctttattttcacttgcctataactaaaatttaacattctcttgtgtgcttgggcagcaagccataatagtattaatagtacctgtgactttgtaaccagaaatcacacgttttcaggctgcattatagttgttgaagatatctcaaaatacaatttacactcatcagtactttgaaatgatcatagttgttaggccttcctcatttttaatgtgttaataagaaagcatatatattactatatcaagaaatgtaaatgttttgataactctttcaatataattagctttctttataaccctttgtaattttactcatttcaaacattatgcccaaggtgctgggagtttgctggggctggggctgctcataactacaccaccctgcatcgctcgggagggcagagaggacagaagggcaaaagacaggataatggccgcttcccaggggccccagagaaggtcagggtttacagaccagcacagcataagggagtgcggataggggctgaaatgtacctgcaacttcacttgctgagccaagtgcctggcccagggaggggacaccttattgcc

SEQ ID NO: 665 - DNA, 34725 bp, Human
gaaagaaaagaaaagaaaaagaaattgagcacattattacaatttaatatcttgattgaagggaagaggtgagacatcagtttcattcatattaaagaggaaataggtactgttatgtcaatgggaaatgagaggaggaattaaatgtaggaaacagaataacaaagaaccaactcataaaaaactaaaacaacccatatcagacacaccttataatctgtatgtctgtgttgacttatcctcttggaatgtgaggaatattctttattaattttacttactgggttgccagatataatacaggaagcccagttaaatctgaatttcagataaacaacaaataactttttagtatatgtcccaaatattgcatggggcatatttatactaaaaaactatttattgtttatctgacattcaaatttcaccagatgttctgcatttttatttgctaaatctgggcactcttcactgggcatcttctcagggcactaacctgccaaatgccaactgctgtggggctgctcagagaatatgacctaatgacaatgggagatgacatgttgctggcaatgaaagaagtgaataaaatgttgcatacttgttttcaggagctgttctcaaagcttaccacctttttagtgtgggattaggtcttcaacttcaactttgtcttcacctttgtcttaaggtcaaaagaagacgttagagatgtctttggtagggcataatgtatccttttagattgatatttgtgggccatttgttttacagggggttagtccaggaagtacaagacaatgtcattaggcggatagagttccatttaaattaaaaataaaatctattgttaggtttaaatgagtcactgcttcattaagctatcaatattagataacacatattgaatgaatgtttcccataggccaagctctgtcccaagcatttcacatgtatttgcatttcgtgctcacaaactgcctctgactgactgattttgattttcttgattttatggatgaggagaccgagaagcagagatgatgaacttccccaaggtcacaccactcataagtgggagaaacaagctaaaattcaggccatcttactgcagaatactcaaaatcaaaataagcaaaatttcatctccagttctggcacctcaccaaaaaccaaaacacgatttaaaaatataaaattttaataacaccacacataaatttcaaactactttccctaagtttctagctgaagttttaaatgagtgtgtttttaatttattagaaagtggattgaagagaaaacattggaagatgaaggaaggcgtttcagttaaaccccaaataactctgtgttacactgagctatgaaacggctccttctagctccatttctcctcagacctaagtgctattcctgattgtccttcattgtcatttccagggagaaatgacaccagcacagtggcaggccttccaatctggagcacggtccacacaacttccgaattggtgttcagtgtaaagtgtaccggagtgcggaaaatgcgcagggcattgccaactatagatgctcggagtaattcagtgtattcagagaacacggtgaaacaaggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggtgcgggccatggtcttggggagggtgctgggtgcgctcgagcaggctagcgtcgggagccgccgctgctagtgagaggccggggccacacacgctcctccccggtacctcctccagcatcaccaggggaggagagggtcggggccacaaggccgcgctaggcggacccaggacacagcccgcgcgcagcccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagtgaggaggggccccgggggcgaggcgggagtgggaggaagggcacggtcgccgcgctggaggtcgggaccccggagcggcgaccggccggggtgggctcgctgagccgcacccgctctgctggccggtcctgggctcacagtccctgcagccctcggaaacagcgctaggatccttgcggggagagggagaggatgacggtattagacaccagttcttccaaaccttttcccgaaaggaagcaaccctaagagctcagagctggggggagaatcaggacaggcagggaacacatggagttttcttttcttttttctctctctctctctctttctttcgttccttctttctttcttttgaggcggagtctcattttgtcgccaggctggagtgcagaggcgcgatctcgactcactgcaacctctgtctcccgggttcaagcaattctcctgcctcaacttcccgagtagctgggactgctggcgtgccgtatcacgctcggctaatttttttgaatttttagtagagacggggtttcgctgtgttcgccacaatggtctcgatctcctgacctcgtgattcgcccgcctccgcctcccaaaatgctgggattacaggcaggagccaccgcgcccgccccggagttttcttatctgtagatctcctacagggacaatctctctctccgtctctctctctctctctctctctctctctctctctctctcacacacacacacacacaccactacacacctctcactctgcctcctctctctctctccctccgctctctctctcacacacccttctccctctctccctctctctcactctccctttgaggagtattgcgtttttggagcccagttatgcgtggctgctgtaagaacaaaacaaagcactctttgtcctacctggagcatccccctgccggccagataagatcacagctgtgtcaccaagtcaagggagaggctcatttttaaaaaattaagcaaaatcagaaaacagagaacactgtcttcctcatcatctcctggagcttgtaagagaaatttctgtcaccaaaaacgaaaagttcgggcttttattcatgcctgtggttcttgggattactgcagtggtgatgaggaaggagaggtgcgtatggctcataaatggcagcttgccacctttaaaaggcacacggattcagatttgggatgtgttaacaaatcaggcttgcacaaattacttttgatccaaatgagaatgctgagctgggagactggtatatgggtaggagctggaaaatgtatcccctgaggtgttggcaatcccaagaggctcagcacgaaaccttgagcttacattgaattcagagatctgagcattaagcactggcctgatcaagaagaagcagatggccttctggtcacgaggcactggtgagcctccatcacccaggcagattccctcacagaggaattctgctggccctgcagaaagtggtgagacagcgcaccaccttggcattttccagcaggcctacttcagctccttgcacttgggcactgaaagtgctttcccctccccagatatttgtgcaccagaagctgctgctggccatgtggtgatgtctcaatgtctttcttcattgaactgggcccttcatacccaaggctggcaccatagtctgtgactgcctgtacagccagcaagactgaaggagttgcagcattaggagtgttgtgaatctggttcagccactcattttacagttgagaaatcccttctgaggtgtggaagggcttgcttagcaccgcaggacttttccctcagacagaacctgggacagctgggtcctcatttcctctccattgtgtctctgtcccctttgcacttttgttgtgaggaacatacatgggcctaaacacattccctcactctcacctttgcacatgaatatgacttaccacactctttgaagctctgtcagcacagaacattaagaaaagtgctaactgggtacctgagcagctggagtgggagcccctgggaaagtcagtttaggagtcccctttatcttccttttcctgatacccaagaagatggctatttcctggaaaggaaggtggatattggattatttacactctgattcctcttaagcctaattttttttcaagattcatgataataagcctgactgacgtctcaagatgttgagaaatttccataaaataaaagcattgaagagaaagtactgagtgaagggaaattgaagagaaacattcagttctaaaattgtattgtttcagaatatgattctgggttcttactgactttcttcatgacgccagccacctgttagacacattatgtgccctcactgtcattttgctcaattttatgggcgtgactcaacactaacagaaacaggctaatacatacaaacatgtaggtttttggtttttaaagaaacttagcagttgaggagaaataaaaagtctattgtaagagtagatgctcattgaattaagtgggctagttgattcctagtagaacttgtattcattcattcattcacttcaaaaaatatttattgatcagatcctaagtgccaggtactgagtacagcacagttagtaagatagatatgctctctgctctcacagtgctcacattctagaattgagggatgaacagggtgaattcatataatgagaagaaaagcaagcagattgctgcagtatagtggtgtgtgtgtgtgtgtgtgtgtgtgtgtgtatgtgtgtgttggatatatgggaggggcctagcttcttggattggattgtgaggagagacttctctgcaagaaggcctggagatgaaacctcaggaagatgggcagacgtccctgcagagggaaccacaagcacaaatgtcctgctcctgggaacaggtgtgatgtgttggaggcacagttggaatgccagtgtggctggagttaggtgagggagaaggagagttggaggagtgagctttaggggcaggagccaggtcaggaagaccctcataggccaagggaaacatttggattttactctttacaatgagagaagccaaaagagagtttgaagcagagatgtgacataattgatttactttatagagagatgactctgggtgctatgtggagaatggattacaggggaaggagaggggacagaagaaggccagaagcgagtttactgatggggggtggtagcagtagatgggcgtaggctattttttggagttacagtgggaagttaatgtttctctgtctcgaatttcccatctacaaaatgggaatgagattgctatacctggtccacttgtaaaaactaataaacaaatgaatatgccctgaagcataatgtaagacattattaccattattatttgctcatattgtattactttgaattccctgtgctttatcttaaaatttattttaataaatttgatgtcttattatattattttcagtaaacctaatttattatacataaaagtatctttctctgttcggagaactggaaactcttaactaagagttaccaataaaaacaagtcgtcacaaaatgcagggaaattattgctaaaataatagctggcttaatttcaaaagttgaatatggtcagataaaaattcaaaaatagaataattaaagctgggaatgggaaaaaaatattttggacagatttgcctttgtcctggctgtggtcatgcagatatctgtgagtgcaaagatttgtagataactgaaaatatctatatggcagcagaatttctggagaagtctgtggaccagagttgggtagggttgtttcccttagtgaagcattctctctcagaggaagctcttgaattttctctcgtttatcactaagttttagagtgtcaggaagttttaaagttgtttaccaactaggatagtgacgttcttcgcagagacaggacaagtaactgccacaataaggcaactctatttctctttcctgactcactctgatgtgcaagttactagaaggagatatgcctgcttagaggaaaaaaagctcttcctcatttgtattgtgggcagcagaaatgtcagctcgtgacttaatagtccctaggtcatgttaacttgccagatccccttaattatttattggtcagtgtgtctgaatttcagcttgaagtggctagtctggtgattcaaattgcagacaaaatgtgatagtaattctgggatctgtatgatttatctcttgccatatcaaccaccatatttttcttagggctggagagtgggggtgtttgggtatcttaaagggagaggttacatctctccttgaagccagaaatctatttgtttcactcacgttttgaaaggttgaattagttgctcctttaaaaatcagtggatattacatacaaatgtaattttccagtttttcttggaagcaatcagatgatctagtgacatggagctgccattcctacatggaagcaattaactggaatagagtggtagttgccttctttggatggtccagtttgcaccatccaaatagaataaggacagttcacgccagtccttattctattgcatgaacctgtttgattcatttaaattacctgtctggcccttgtagacttttgatttttaacttcaggtttagggcaatcaagtgtaacctgtctgttatactttcaccttcatgtaatgcaggaatctatattccagtatccctgctggtagtccccaaacctgtactttaactgctcctctgataaagaagataatgctaattgttgaaaagctactgttgatggagctgtacagtctgggcctacatagaacatgtttaggaactttgcacaggactgtggctgtcacatgcaacctaggttttccacattaaaagtaaacattcctcattccttcaacagctcctcatgtgacttgctgccttgttccctcatcattctggttatttttgggttactgtcccttgtcctgaacctttatttgttaaaatccttaaatccccaccaattcaataagatgtggtctaactggtgcagaatgcagtgggagggtggcctccctttctctatgatgtcatacttttgtcatgcaactgaagatgtctttagatttttcctggcctatccattgtgtttttaaatttactttcagggcttattttccagttagattgttcctgagagtttacaggagaactgctcaatgtacagcttgagagcaatggttttcagctgaggatgatttatgcccccactccaggggacatctggcaatgtctggagacgtaatatttagttgccacaactggggtgtgctattggcatctagtgggtagaggccagggatgttgctaaacaccctgcaatgcacaggacagcccccacagccaagacttatcagcccctagtgtcagcagtgctgagcttaagaattcctactttagggtccgggtctaggttcagatcctggtttagctacttcctatccttgtgaacttgggcacgttatttaacctctttgtcttcattatctcaactgtatgtcaaagaactctgaggactaaatgagttcatttatatgaaatgcttagaagggtaactgtatgtacaaacactatcttatttttctaccatattttattcattttggtgtgtacatatgacatcagataagtgggtgggtaaagtttgagggatagcacttcatttctaatcttgcctatgggatgggcactagtgcatttggatgttttagggagctaacagcttttctcagaaatgccttctctctatggtccccattatcatttttccggcttcttttagtattttcctccatattggggcatatatgtcagtttaatactgcatcctcctggagaatatggacactgagttcctttagcgggagagcatctgtgcctgttgcttgtacatcccatttccggtgtgccccaggctcctccacaccccagtcaccgtggcttgcacctgcacaacagattcctggggctgtgtagcaattggtagactttggataataataatagcatttctccaagggctcacatccccataagaaccccattatcagggttcctctttgacagatgaggagagaaaagcagaaagtaggtaagaacttaactgaagtcaccaaactagtaagtagcagattcaagattcaaaccttggcagccagaaactggagctaaatttctaaaccactttattattctgatacaggtaagttttctcaagaagtatacccatgaccttaacctaaccatcatgtagccatttatgcatacaacactcaacagatccagttactcttactcttactattgtgagtaatatagttgggggactgagtctgagagtaagatcaggaacttacagtatagcagcaggctgcccattgatcttagacaacttttaccttttatgacctttaagccatatagaacaccaaacatttggacatttgcacatgggatgcagattaattcccatttccaaaattgtgagtagaatcaactaattatatgttacttgcaggttttgcatctcatgcatctgcctccctagaatgaaataaatatttcttccttattaaacaaggatagagttgccccagcattttcttagaccagggtttctcaacctcagcattattgacattttgagattcctctatgttgtagggctgtcctgtgcactacaggatgcttaacagcatccctgactgctactcactagatgccagtagcagccccctcctggttgtggcaaccaaaaatatctccagacattaataagtgtcttcttggggggcaaaaatgccttagttgagagacactgctgtagagtgatgttctagctgcattctccagccttcatcctattgtaaaatatccaaagaagattttatcttcttcagcaatcatttggtgtggtaatgggtcagttttgaggtatttaagccactttctttgactttagttgaaactgaattgggctattatttgctttttgtctcattcagttactttatatgctccatattagttttctattgctgctgtaaaaattttctacaaatttagtcacttaaagcaacataatttattatctcatggttctgaaagtcagaagtctgacatggccttactaggctaaaataacaggttcagtgaaccttcagaggtcagctagtctgtgttgctttcctgaggctctagagagaatctgtctccttacctttccaagattctagaggccatccacatgttatagctcatgcccgcttccttcattttcaaaaccagccatggtgggttgagttctcacatcacatcattcagatctcttcttctgccatcctcttatacttttaaggactcttgtgattacattgggtcagataatccatgataatctccctattttaaggtcaactgattaacattaattccatttgcatcttaattcttttttgccatggaacattacatattcacatgttctggggtttagaatatggacatttgggtgggagtgcattattcaacctgccacatgcccccattccaaaggtcaatcaggaagaatttggaaagagagtactgatacttaacaaatgagcattttcttttctgactctttactaataacacaagagctaaggcccacctgccctaatctcttgccaggactgggttttacttggatggtttatctgtcagcttttcacagagatttcaaactcgagattggacattttatctattgttttgggttgtcttttgtttcgaaaagggaaatgatgcctgatgagaatttaacagtgacaaataggggaaatcgggatttgtggcagttatggttgtgtatggagactacaactgagatctgaagaacaggtagggcactgtggtttcagtgggagaaatgaagtctgcaggagagaggcagaaaggtagaatccgtttaaatggaatgtattatctgagtgctcattgaaagtcttcttgattgccaggatgatattttatctagtggtcaaggggccaaattgaagatagttattttcaggccttactatttgaagaaaatcattgatttttaaagtgaacattcccattgatttagaatgttggtggctcatgcctgtaatcccagcactttgagaggtagaggtgagcggatcacatgaggtcaggagttcataagcagcctggccaacatggagaaaccttgtctctactaaaaatacaaaaattagccaggcattatggtgggtgcctgtaatcccagctactcagaaggctgaggcaggagaatcacttgaacctggaaggcggaggttgcagtgagctgaggtggtgctattgcattcctaggtgacagagtgagactccatctccaaaaaaaaaaagtttgtgtttttgtattgaccagtgattggggttatggtaatagattttcatacaatatgatgatgaagacggctgtatcaagggttttagtgtagtcctgttggattctctagttctaagagaatgtctaaagttaccattaagtttttcagggtcctagttcttaaatataaatacatttctagctaactcatatcccatggttgagaaaaaggcacttatctgtgtaaagagaactttaaaagttaaaagacttcttatgaattattcctgtgtgttcatattcagaagcctctgtggtcattgtgattattacatgttaatatggttcctggctcataactcccgttgcccttgctacagtctttggttataatattggagtgctttagaccccagaagcaggtctcagaaagcagaatctttctctctgaccttttcctgccttcctttcacctgcccaaggcaggactctaatctgattgtaggttataagacccttattcagggaagggtcctcttaccttggaaaaaggaatgctgcacagacagaccaagaagaatctgaatagacagggcttgctgggttgcccctctgagtctattagcattagagcttacccttactgtccagtcatatttctacacagctgttcatactttgttgaacctatgcataaaaatagacagtttcccctgtatctttgggtcttcattctgaaggctccttgtgaatacacattaaataaataatctgccttttacaagttgatttttcagtgacccttcagaggtccaaggggaatgccacccgtggcccccttggccccttcagtgtgcatgtattcgagcctagaaatgcctctggaaaaaaatctgttagcaagtcattatttgcgaagagataactcaatttacctttttctgttatgtttggatttttgaaatcatgtattaactttataatataattaaatataatactgaaataagatcaaataaaatcaaccaaaattataaataatcttaaagagttgcacatatataccttttttttctgatcaaaagaaagatgttgaataaggaaatacagtccctctgcaagtagtttaagaagttttggctggacacggcggctgatgactgtaatcccagcactttgggaggccaaggtgggcagatcatgaggtcaggagatcaagaccatcctggccaacatggtgaaaccccatctctactaaaaatacaaaaattagccgggcatggaggtgggcacctatagtcccagctactcgagaggctgaggcaggagaattgcctgaacccaggaggcagaggttgcaatgagccgagatcacactactgcattccagcctgggtgacagagtaaaactctgtcaaagaaaaaaaaaaatttagagctccagcaacacatttaccagctgcctatctgggtctttctagcctgtacaataggagctgcccttacacgaaagccccatctctttgaaatctttctgtctacattcctgttgctctcagaacttgtaccatatcatctaagaattataaaatgcccctgtaatttgctttcttcctgtattatattgttaatatatgctagtcttgtctctgaaacacaattgtaaactctctgagagtagggattgtgtcaaattctctggtacttaccacagttgttgccataggagagggcatatagtatttgcttaagaaataccctttgattgaatgactgcagatctgataatcaggataggccatgctgtgctccattaaggcaataacagcttcacctggaaatttcagtggcttaacacagcaaaggtttatttcccatttgtgaaaggtcatttgaattggcaggggctcttctctgttcagtgactaggtatccaggcgtctttcacttcaagactgcactacatcagcacatgatttctaagtttgctgtgtcagggaaaggaaggcatgaaggagatacagtgactctgttgcagacgacttctgttcaaatttttgtttctcaggaattagccccatgggcccagcccaaccacaggggcggctaagaaatgtagggaagcacatagatgttcaggagcactcattgtctgtgccacacatctatattacatcttcccgcaaaatagctatactaacgagtgcttcattagtgtcagtgggacaccggatcattaaacttggctcggtttgtattagtaaccagatgtgctagatttattcactcagcaggcatttactgagtgcctctgtacaccaggcactattctaggtcttgggaatacagcagggggaaaaaccatcaaaaatccttacactcacagaactaagtttttagtggaaggtgataaacaactaacaaataacatacaaggtacgttagttggtgataaatattggagaaaaataaagtagggagggaaatagggaatgtattggtgtgaagaaggaggttagattgcaattttaaatagattgaaccgggaaagtgtcactgagaaagtatcactggagcaaaaacccggaggtgagaggaccagtcatttgggtgtcagagcaaagagcattcccataaaagggaacacattcaaagccctcaaagtggggatggaaggtgggtgtggagtacttggcatgtttggtgaatggcaaagaagcaagtgtgattgcagcaggtgtccaagaggggctaggggaaggattgggagtgtgttgagtaaaggttatgtagatcattataagctattttgggtgaatggcttctcccccgtaacatataacaccatttgggggttttgtgcagaagggtgacacaatcactctggctgctgtgttggggatagattttagggtcaagggcaaaagcagggagactcgttagaggtgatggcaaattttaggtaagagatgatggtggcttggaccttttctatcccccacaaaagttgaagggccaaattttaggggggaaaatggatgcacaaatgcaagatagtttttgctaataagatgttagcatacagactaattataatttattattaccacacatctcatattctcttgtttcatttactgattcaacaagcatctatgcaatactacttcttccaggccctctattaggcactgagacaacaaataagacctgacttctgctttttggaaacttatatcatagtaggattatagaaattagcaagaatataacatcatattaacacccaaaacaaccacagcagcagaaatatagtcactatataattaaatgatggaaatagccaaaatttatgaattatttactatgtgctagacatacctatggatattattatgatgatgacagatggttgttatatttgttatattttgttggctatttttatagctgaccatactgttataaagttagaaaactagtgaccaaaaacttaatctaactgtctgaaagtattatttctctgctctacaatccaatgtaatccttagtaatgtaggtaatggtaatcctacattaccaaggattttaccattgtagtaccaatctaaaacccagcacagaaaatacatgttttattttttccaagtgttactagtacctcagcctttcttgatttgtcagcttatttaaggcctcttcattgcatacttcttttttcttttaatcatctgcttcgaaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcaggtaagaggtgtatttgttcaaggtcttgagcaactgatctgtcgccatacttcaagtgggccccaagaagttgcacatctgcacatctaaacaagtcctatttaaaggcttatggagatcctgtattctcctggagtaggggagaggttctcactttttcctcatttcaactgaaattgaagaagcacttgtgttcttcagtatcaggactgcaggacagaaccaggatgggacattttaagatatactggacgctcagcttgcaatcaccacggagaacctccttaatgccaccccttctctctctgactgccctaacgcatgcccacacaagcatagtaatgcaactggtctggagtccactccaagacagcctcaaaacctgcttccatgaggtgaaaaagaagcaggtgtcttgttcaacaggcatactcctggttaatagtggaaagtcatgtgagataacaatttcaggtcttgggatccaaaaggaaacaatctttcctacctgataatagagagaagtagggacaagtaggtgctagggagttccagatgagaatggatgtgatcactcattctttcttgccttgtggtaagtggggaaagaaagaggtggaaggcatagactaacccaggaggagtggccaaaacgggacagccatctttagacggctacatttaatgtcactaagagagaccttaattggaaaaagattgtttctggagctttgcaaattcctgctcatcccagagggttgtgatgcataaacttctctttccagtctcctatggagagcagtgtaggtggcttctgaatggtgtcatactgactatacctacagagctgtgcacctggatagttgtgggtcactctggatctaattgttcaagcttgatgggtgactccttacgatagcatttgcaaaagagctttcataattcagtaccttaaattttgccctactacataagcaggaaaatgaatgcgttaggagaggttttatatcttatatctacatttgcataggaaatagaataatatctcacaggtccattcatcctataacgcatcaggaagttaagtcatcaaggatacactggtgactaagacaataaatgtgtagtcaaattcaagggtcctgcatcctagatgacattaagttcatttttcctactacctttttcatggattgagaacaggtaatatcttagatggtgggaaaatcatcattcgggaaacatttatatccttcacttttaattggtacagggtaaaaatttaaacatttttaaaatccctttgtctttaaaaataattggaaggctgttgctggactgacagaaacttgaggacagggacgttgctttatctttatagtcccagcattgagcccaatgcaatgcccattctaaatgttcaaaaatgaatgcaggccgggcatggtggctcgtgcctgtaatctgagcactttgggaggccgaggtgggtggatcacttgaggtcaggagttcgagaccagcctggccaacatggtgaaaccccgtctatattaaaaaaaaaaatacataaaattagctgggtgtggtggtgcacacctgtagtcctagctacttgggagactgaggcaggagaattgcttgaacccagaagaaggaggttgcagtaagctgagattgcaccactgcactccagcctgggctacagagcgagactctgtctcaaaacaaacaaaaaaagaatgcatatatattggtttaaagtattagaaacagtttattaaataagattaaaataataggtgattctttataatttcttactaaatgaatacacagaaaatatggctatgcaggttaaaaggtttgtaggaatgggctagagatatcctctttactaatggaggacataaagccatataagagtgtaattgtcctagcatgtatacagttcatctccaaacccaagactgaacatcaggaatatttgacaaatgaaaaccaccaaaaatatgtaataaaattaatagcatgccataggttccaatcctcctattaaaataaagttgaagaaaactaagaagagacatttataaattctgaaccacaaaactgtgtgagtggtcatttgatctgatgagtctcctccttccacttccttaatgatgactcctgacagatggttagagaatgggaaatccaggcccataaccgggtcagctgtaggctatggagcctgttccacagccacccccaggcaccctggcactggtgcataggaccccatagacctataccaaaacctggatcagcctgatgattcctgaggtcttctcagaggtcaggtgtcctggaacaggcagacctcaccttgacctgaatgctcctgaatgctgagtgaggaaacttcccagggagaacaggtgttggacaaccagggcactcctaacttattggaaaatgttcccctgtcctttggaattgagatctcacaagcggaggcttgtgttgggtgaaaccctcccatgcctccagaactgagcctccaattctagaggtagtgtctccaacagcagctgtggccctggggctccttagcgagttgtgtgagccagaggtctccctgcagcaagccctgcacaggcacaccatgcctgcctaggggtggggttgcagtagcaccaggctgcttaccacagaagaagaagcaggtgtccctaccttaaggtcctcctccttgggacttcacatctccctgttacaccagaagcatggctcagtagatactcttttaatggaagaagagccttttgtaattcaaaatagaccctgaaagttcaccttgcaggtaaagtttaaaaaaaaagtttctggggtttgaatctacctggggagaggttagacctgctaaaacttccctaaggactcagcacagatttacctagcaagagtaaatggactctggggaaggagtaaacagcattatttgtctaccccttatgtgtcatgttttgtactaagaacttgacctacattctcacctcatctttacaactgtactgtgggctggtcaagtgcttttatgtcattttacgaatgtggatcagagaggggagcaactaggccagaggattatagcttgtaagaggtacacctgaaatctgaaatagaaccatgtccctccaattcacagggtttgttcatctccatcccctctccccttgcctttcttgaaactacctcctaccatttgaccatggattgctgacctgtgtgtcaggcaggtggtctggaacttcagcccagtgtctcttaaactttaatgggcactccttttctgattgagtggaattgtggtgaagtccaggagcctgcatttccaagctccagctggtgccagtgatgctggtccatggatcagctttgagtagctgagccttatgtattgaaaggcttcatcatgggcaggtgtttcacacatgagtcaccagtgtggaggctgtaaattggtttcttcccatgactcaaaacttttctgggcaatgttccatggtattgatgcagacgctttatctaacatagctcttgatagctggctagcagagagtaatcaactcccaccatccaatggaaggaatgggtggacaagctgaatatgtcaagaaaagtgagagtctgaatacactgatattttgtaattaaatatggatttgattgaggtttagaaaggagaacggatgaagctgctggtgtgtggaagattgcaccagagagagaaaagtagttttaggagtggatgagtaaaatactgcatgtgataaagggtttaaaggaaaacaagagagaccagtggccattcaagttaactgagcttattttcacaagtatttgttgagcattgactatgtgccagacactgtgttaagaggatgcaaagacatggatatggctctgaagaaagagcctagtgtagcatgcagacacataagtttaatatgtgacaggaagaatgattacatgtgtgtatacacacatgcacatagaatctatgtaatattgaggatgaaatgattaagtctgtctgggaaatcagggaaggtttcagagaagacaggacatctgaccaaggtattaaagtgtgaatgggagtttgctaaggggatttaagcataggcagtagcatttacaaaggtgcagtggcatcaaccagcccagtgtgttgctcaggagtactgtagcacaaggaaggggtataacttaaggggaagaagaagaggaagagtatgaggcaatgggcctccagtggagggtttctttgcagtgcccagaaacttgggatttaacttgtgcacctgtgaacctcagtatgtttcaaccccagagcactggaaggataggccacatttttgcaagtagcagagtattggcttaggaaagcatgtgtagatttaaattcctcctacaaactgccttccaaaaagattacaatacattcctccttcaaggaaagaacacttgctgatagggaggcattgaaggattttaagaattgtctggtgtgatttgtgctttaaatccctccaggagctgtgtaaaggatgcatttgaaggggtcaagatccaacgtgggtagaacagttaggagagagagcaacagtctggtcaagagacagtgagggcataaatgagacagttgagctagagggtcagcgatatattgtggagatcattctaagctaaaaactaatgttagcaatagaggtttggggctgggcgtggtggctcacgcctgtaaacccagcactttgggaggctgaggtgggcggatcacgaggtcaggagatcaagaccattctggccaacgtggtgaaaccccgtctctactaaaaatacaaaaattagctgggcatggtggcacatgcctacacctgtaatcccagctactcaggaggctgaggcaggagaatcacttgaaccagggagtcggaggttgcagtgagccaagattgcaccactgcactccagcctggcaacacggtgagactctgtctcaaaaaaaaaaaaaaaaaaaagaaaaaagaaagaaaatagaggctccgttgaatgtagggtggttggtgagaaagaggtaggagaataggatgattcccaggtttctggcttgtggtgcaggagatgaggagttcttgagttgccggctgtgtggttggaaagtgagaagggagagttgaaagatgatcatttagtttcattttggaaactagtttcattttgacattcttatgggaaggacatcaggtagagatgctcaaggagaagttataggcacaaatctgaaatgtgaaataaagttcatgtttaggaaaaacagatttgtgaagtcatctttaatttactctggatagaagtagaatgagagggcaaggctgcaaacattaggaggtaacagtccaaggcagcttgagagaaaggctatgtctactttcatctctttaccctccaaaacccctacacagtgtttcaaacagagcagaccctcaataattgcatatcttacttgttaggttgagaaagaaagaaggccagaaactatgggaagtaacttgattccgttggaattcttttgcataataaaatctgatatgtaatggatgacaaatgagataatatttacctgtttttcagcatgggtcaacaaaatacaagtactgatggctgctgcaagctttggccaaactaaaatcccccggggaaatgggccttattccgttggttgtacagacttaatgtttgatcacactaataaggtaatgctttgatttatacaacttatcctgatactctaatattgtctgtcgctatggaccactagaaggtgttcaaatgtgaccttgccctcacctgagaatgactcattttgcaatttgtattgtttcatatgaaggcttttactagtttggccattcctcaattctttgttattgtctgattaatttctctataaaccttatttttcacttccttaatacctgaagccaggctgcttgtattttcctttcactgagatagaatattgtttttctgtttctctttcatgactatcttcaatcaccacagcagcctaaaaagttctttagacctttttgtgaacacagaggtatttgagtccccactaattaaatatgcaaaatagctgctggaatatgtttgagacacaacttctctaaaagtgcattaatttctttcttaacagggcaccttcttgcgtttatattatccatcccaagataatgatcgccttgacaccctttggatcccaaataaagaatatttttggggtcttagcaaatttcttggaacacactggcttatgggcaacattttgaggttactctttggtaagatttctgttgatccttctttgtaggctcttgcatgtatgaaaaccttgaaaacaacaagaacttcaagtagttaagaccaaagtagatttttcttcagtccaaatagctcctaaaatgataaggaaagtatttctttaaagcccaggcaactacgacagaatcaaggttctcattttgtccattctgagttggatgggagtggccgagagtatcagactgactctgacatctttctgtggctgctctttagttttcatctgacataccatggagaaggcaataccgtggtgagaatagcaggttatttggtgtggccactatcccgcatgctctgtgctaaagttagacaaaaagagaaagaaagtagaagccatcaaactctccagatccaaaacaaaggagtcaaagctaatgcctttcttgtcatacatgaagagactctactctcattcccatcacctacccccatcgctaagacaatctgatgtgtattcttcacttactgtctacattctgctaatatagacttttccttccttatctgtttgactagacactactgttggactgatgttaactgtgtcttcacatttacccctcaaaacgatctacaaattttgggattcatcttaaacatcggcttttaattttcttaaaaaccacttataacagacatgaaaatagcataactctgcatatttatgttgcaaaataatttataaatcacttccatagcaatcatcacattcagtctttatgactgcatctgcattttatagatgagaaaatgaaacacaaatgattgctgataataatggtgacaataaaaattgagaagtgaaagaagacaatatttccattttttgagccccttactatgtgatggattgcaccactgctttacatatattacctaattaaataaaattctcacaaaaaccctatgaaagagatatcattttctgaagtttacagaagaggaatctgaagtacagaaagtttaaggaacttgcccaagatccatagttaggaagtggcagagctgcatccatgactcagtatgaagtcagtggtttctctaccttttcctgcatgattatgaccaaatcataatgaacagagtctctgtttcttagattctggctcttagtgtaatgtatccaaggttttatgggtagtttggtttcagaacattccctttaaaatttttccaaaacctgggaatggcagtaagtagcagcctttatgaatacacctataagtgggaaaatctctcaccttaagtccagagctgtcagtaagaactcatcgttaatgatcctatggtctgaggaaagaacttacgccgggtgcggtggctcacgcctgtaatcccagcactttgggaggctgaggcaggtggatcacctgaggtcgggagttcacgaccagcctgaccaacatggagaaaccccatctctactaaaaatataaaattagccaggcgtggtggcgcatgcttgtaatctcagctaatcgggaggctgaggcaggagaatcgcttgaacccgggaggcagagtttgcagtgagccgagattgtgccattgcactccagcctgggcaacaagagcaaaactccatctcaaaaaaaaaaaaaaaacttacagttcagctctttggttggtgggtatctagtagcagtctttttaatgaatctactattcatccataaaaaagtagatataaatcagatgggtctgcattttatgctaatgagatatgaattaaattcactagcaacactcagagaaaaccttaactataaccttccattgttgtctaggttcaatgacaactcctgcaaactggaattcccctctgaggcctggtgaaaaatatccacttgttgttttttctcatggtcttggggcattcaggtaatgtttgagaggttgaacaattttggcttccaggaataaatgacaatttttttattcaagaaagaaatagcagagtttggaatgtcatgcaggcccttgtctggaggagttggggttcctcaataattggctgtgggtctattgatcagtcctagacctgtctggtcaagtagttttttccctactatcagctcattgggattagcctcacagcagagaagaaagggtgttgcattttctatagttgtccttcattattgtaatatttacactcttaaaattatcctctgtaaagtttagaacttttgagaaaccaattttagattagctgggaaagactgttattaagagaaatatctgtgaaggcaagagaaggagcaggaaaagatggggagaacctttggaccatgacacaggttggacacctgaaaaggtgatggggaagggagaaggattggataagaagagcttcagaatgaagcatggttctaagaaatattgagccaggccaatggaaggagtgctggactatatttgcttatcaagagtcctgtatctcataggaatgggctaatgttagtacccatgctgtgccaagtctctgggagcagctcactggatgcttagcttccacttgaccatggtgatggatacagaggggcaggagctggatagggtctttagtaagctatgcagtctgtagcatgatagctgagtggcacattttcataacaacaaccaccctcttcactttcttccaccactttctcacctgtcacccctcttctacctcaagggattgtaaaactcagaaaataagagagatggcttttagctgggaagaagttgggtagcacttgcaataaagaattctcttcagcactgtaaatgtagttcagctagctatttgatttctcctacattagtgactggcaaattagaacccaagggccaaatccagcccactgcctatttctataaagttttattagaacacagccacacccattcatttttgtacactgtctatggctacttttgtcctacaacagcagagttcagtagtggtgacaaagactatggcccacaaacctggaaatatttactctctggccttcaacagaaaaagtttgctaatccctgtgctatatcattcccccctcttgaaaaggtcctgtatcttcagcaataaataaatagtttctagctacctcctttttattctctgtggacatttcctattgaatgcatggtatgaggaaaaggttgtgcaaatgaagctgtggaagagggcataaatgcagtgcttagcacatgatttttcaactatttcacccagtccaatcatttaaataatagctaacatgtgttaagtatttacctgtttctaatataagtactgaaaatgtattaattcaattgatcctcactgatgaggtagcatactattatagtgtcaccattttatagataaggaaccaaggcagcaaaaatattgtgacttattaaaggtacacagctaacaagtggtagaaccagggttcaaactcagtggtcagactgcaggtctcattcttgtaactacaatactgtactgctttcctatatacattatcttagcaaaaccttacaactaccctaaaacaaatgctttactcttaggcccattttacaggtgaggacaaaaatgcagtaattacctaaaatcatatagctgggaagtggcagagccaagattaaaaacccaaaactctcaaaggcaatatttataatcactgccctgggttttctcaactttagtagtcttgacattttggaccagataatctcttgttgtgaagggttgccctgtgcattgtaggatgcttgacagcatccctttacccactagacaccagaaataccctcgcccacattcatgataatgaaaatacctccagacattgtcaaatatcccctaaggaacaaaatcaccctcctttaagaaccgtagctctccactccaccccagggcactactacaggggtgtaatggcctccatgttcccagttttattagtggactcagccttgtaatcatgactggtagttgtaattcttccctctttttgttttgaaggacactttattctgctattggcattgacctggcatctcatgggtttatagttgctgctgtagaacacaggtatgttacctgatataattgggctctttggccaactacagggaatgtcaatgctcataactatgtttctaattttcataaaagtttatttaaaatgttgatggaactttcaagtatggtaacatcatgagcaaaaaaggagattgagtttatcgacttaaaagacttaaaagcacctaacatttctagagtgtttattgcctgccatgtcctatgcgaaatgtttttaatacgccatttcattcagtcttcataacaatcctatgagatggttattattattattgttgttgttttaaggaagaggaatatagaggtgataaagggtaatttgcccaaagtcacacaactagtaagtggcagtgccgggatttgattcctgagactgagtttcaacatggctaacattgcctcccagaattaggaagatagaatggattgagtttacctgcaacttgatgatagacaataaggtttttttcctggaactcttttacagtcttctttaatttaagagaaaatatagagtggaagaagaaagggaagtcaaaagatcagaggaagttgagtcaaggatggaactgagaaacatgggtcagatgaggaagggaaggagcatgcataaataataattttgcttgtattatagagatagatctgcatctgcaacttactatttcaaggaccaatctgctgcagaaataggggacaagtcttggctctaccttagaaccctgaaacaagaggaggagacacatatacgaaatgagcaggtacattgcagtgaaaggagaggtggttggtgacctaaaagcatgtacaaaaggatgacatttgttaatttaattttacacctggcaagttatgctcctagctctcctatttcccattcccaaaagatctgtcaatagattcctggagcagtaaaattcccttaatggaatatctagttcatagtaaaaacaaaggcaaatacaaaaatttgggagatgacagtgaatattcagaattcccttgaattaaaacttctaattttagaatctaaaaagtgctagaaaataaattaatagattcttcctcacagacaatataaaaagactacttttcagagaggcagtatacaatagaattaagagtatgggccttagaacccaactttctatgtttgaatcctggctccaccacttaattttgttatagaataatgaatagaaacattatttgtcttacagagctattagggcagttaagttaagtgaagcatattggcttcctctttatagtgggtgttttacatgtgttattatgtttgagtccacccacatttcctttaggtaggaattattatacaatcaatggaaactcagagaggttaagtaaatcgtctgaagtcacatagtaggtaagcaacagagccaggatttggactaagctatacctatgtgcaaagctggggcctgtgtcattatggtagcaagtaatagtcactaatcagatttccagtttataactgaccaacgatttttcccaaatacagcttctacctaaactttaaaataagtgttataactttttactttgtcatttccttcttctaataattatattaggtacggcaaagagcaaaagaatgttcccaagctctcagtctgattcttgacattgatcatggaaagccagtgaagaatgcattagatttaaagtttgatatggaacaactgaaggtaagctataaaaagtaatttttctcttgtcctacagttctttattgttttttgtcatttaattttctgctatattgcaaggtacaatatgataaagggctgcaaccagccccctccccaatgcgcacacacagacacacaaagcagtacaggtaaagtattgcagcaatgaagaatgcattatcttggactagatatgaaattgccaaaagttagtcagttttgatctacaaaaacagcaatgtcatatggttcaactcaactcctgtggaagtattattatttcatggacagctcctgcatgtttttaagcttgatcttgaaaacttgacacaagtttgggagcgggtggaaaaatatcagacagagtgggcagcatgaacaaagactcaaaagtgtgtgtggcatgtgaagtgcagggattagggggaactagagaataagatgatggtctgttctccagatacaatgaagaaatttgttatccctcaagcagccactctcttctgtatccttgcctttgtacatgttgtccccttggcctgacacacccttccccttgcctaactcctacctaatttcaagactccagttgagcatcacctcctctaagaagctttcttggaccccaatacccacttctggactgggctcgctgtctgtcatgtgtgctcctttgtaccactgtactgtattgcatcatgcctctgtataactttcttccctgatggactgcaaactcactgaaatgagactgcagtacctggcacagagtaggtactcaataaatactcatggaatgaacaaacaaataaacatggggtgaggagaggcagaagtcagaactgatgttgaagtttccagtgtgggtgactacaaagaacattaagtttactttcaaacctttacatatgttatatatatgtgtaaatgtgttttatatgtgtatatagatgtatatgtgtgtatggtatgtataaatgtatgtgtgtatatgtatattctattttataagaaatcaatgtatttaaccatccccatgaaatgaacaattatatgattgacaaaatcatttcttctaacaccacgaaatagctataaatttatatcatgctttttcaaataggactctattgatagggaaaaaatagcagtaattggacattcttttggtggagcaacggttattcagactcttagtgaagatcagagattcaggtaagaaaataagatagtaaagcaagagaatagtaaattattggaagaaattatattgtgagatataattttttattcaaattcttagtgaagaagggatctcttggagtttataaggctattcttttgcccccataaaatactctatatacattttcctaggctaaaacatctacctctcctgctattaaaatctccccctactcccataagttttccctcattattcttgtttacccaaggggttaacacttttcactgaaaaatttatctttatataattttttgtgacataatgattgtgataataatattgtcatcttaacagtattgccagacttctccagtgggcaggacattttttaattaggtttttcccccttccacctttaagatggagctggatctaaaattacaattatttgggtaagagttgggacaagaccccagttttctagcttgcaggaacattttctttcttaaaccttcattccagactgatgagatcacatagaaccaaccgtacagagagtgggcaggatcatttttgaaacttcacctcaaatttcttaaaagtccatttcagtgtaagaattctcttctttgatccatttaccaaaagatcaggaaacataggataaacttacttttaaaaaggaagttagtttcatcttcaaatgatatgctccatatgtttttcttcaaccctcagacagtttttcagctgaagtgcctctaaatataaagtaatgggcccaattgttactctaataaagctataataaatacactacaaggtgcataaaagctctgaaaacaaaggtgtatttattatactttttcagatactccacagtgttgaagaaattattatgtattctaaaatttattttgaataaaaagttttaaggatatatcactcaaatggttgcaattcctaaaggcatataaagaaaatgattatataaaattccaggtctgctactttacaaagttaatcatatccctttcccacattgaagtatgatacctctttattccaatcagataacccataataaactggtatggtgcgtgtccaccaatcctagcattattaggatgtcctcaatgttggctagtatgtaaccagtttaatttcatcattgtcaacaaatatctacagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggtaagtattagtgacttatttcattatgtgaaacaaacttgaagcttgggtaaatatcaatcgatatcatttggtaactattaaagaattgctgaattggttgtttagactttcaataaggagagaattagataatctcagtttctaagtacatttagtcttactctttttaaaatgggaatgttaacgtatatagtatatatactggttatattagtctgttcttgcattgctatatggaaatacctgagactgggtaatttataaagaaaagaggtttcattggctcacagttctgcagcctgtacaggaagcatgatgctggcatctgctcggcttctggggaggcctcaggaaacttacaattatggtggaaggcaaccggggcatgagcacttcacatggccagagccggaggaagagagggatgggtgaaggtactacacacttttaaataaccaggtctcacaagaattcactgtcacaatgacagcaccaagggggatggtgtgaaaccatgagaaactgctcccatgatccaatcacctcccaccagtccctgcctctgacactggggattccaatttgacatgtgatttggtggggacacagatccaaactatatcactggtaattaaaattagcattatactacatgctacttcaatctaaacaccagaatatgcctacagatttttggggttagagctagggggaagtattccatcattaggctggggtaggaactctttaaagaaaaagtcagattatcgactgagacctgcaatatactaacctgttgagaaagaatatgagtttataaattccccaaagctataatggggtaccatgacgtgttggcaattcttgtatcctggaggtgaaaaagaactcctgataaggttttgaactctcgatgagatattacaaagcaaagatggacctgaactcacccctttcctatctgaaatctggtttatttaggagaagagaagaggcaggaaggaaatatatggagtataggcaataaacactatgggctcagagaatagaggggtctcttccaacagaaaaggattcatagatgacactaaaattggattttgtaagatcaagagagtttagatagtaaggaagggtttaggtatttcaggcaaggacttcatttagcttatgtgtatgtgcaactctttctaattctaaaacggaaataatacagaacacctaaccttccctcaaccctatttccttactaagctctcacctttgcttttgtcccttctctgctagaaaccttcaaagaatagccaatattagtcattgcatgtgcttacttctattcactctttgactcttgtggtctagcttcctgggcccccacgggcatgccaaaacaaagacactaaaggcctgctgcctgccacaccagcagcctcttcagagtctcaaccttgctctctgcatctgttcaacattgctgaccacccctcttcctgctcccttggctactatgacccacctctttgctgcttctcctgtcatttataccactccttccatttcttctcctctggcagttctctacagtcagatcatccaagcttctgctcgcaattctcttgtattcctgctgtttatcttctttatgtttctgacattcaagtttcctactacaatgtggggaagagtgagagggagttaagtggccctgttttgagcttagatgactaaaagaatgatgggttgcttataagaaccagcagagtcaagaggcagagcagctttgggcaggactgggaagatgtcttttaacttcacaatttcttagcttgagaactgaggaatctgtacacagatgtctggccacacattggatgattacataatttacatgataacacagatgaaacatttgaagtagaagagattgcaaagtgagaaaagagttggtctgccagtagaatcctaaggaatgcctacattcagccaatgggaaatgggtgaagagccagtgaagaacatagagtggttagcgtcagaagggaaggtgcaatgttaaggaaacgtaaagaaaaaaagtgcaagaaggccatcaagtgtcaaatgtcccagtggtggtagaaaacgaggacttaaaaaaggccattctatttgacgttaggctattgatgaatttacagagcagtgcaaatgatatttataaagtgcttacagtttaatactgggaaaagtggtgtttgaaatctgtttcctctaaggcttaaatctaaagtgatttaaatttaaagtgactagcatcaaatacataccacgttcagtggtgagggcaggtagcaggctctggctctgagttcagggacccttcaatacagaacacattccagtattcaaactggaagtattccaattcactaaaaagcaagaatcatttcttctaaaatcaagataccaagcaagaacaagattctttgagttgtatttctagagggaagaagaatatactctgggatccctaaacaaacagcctgtgacccttgaaacacatctaagtagatcaaattacaagttttatttcttctttggttttcagtaaacagaccaacaagaccagtacctttcttacactctaactaaaaaaataataattttatcaaacaatgtgacttttaaatgtcttgttctcttttaggggttcagtccaccagaattttgctgacttcacttttgcaactggcaaaataattggacacatgctcaaattaaagggagacatagattcaaatgcagctattgatcttagcaacaaagcttcattagcattcttacaaaagcatttaggtaagaaactatttttttcatgacctaaaccagatgaatctcaggacaaagctgtctatcttaatacagctttagtactatttaaactatttccagttggtttacaatggaacaaagcagtatatcaatttgaaaacagaaatttgagaaagtcaattttgctgctttacatcctctatatcatagaaagcaaatccaactgttaaaggtaatattctttgtatgaagcctagagtggacttccatgttgaggatactgacagcaggttgcctcactcctatcccgtttgcattcagctgctaaagcagccatgaggcagctgatacagagcacatcgtctctaccatcctaacggaacttgtgtaatttgtaaatctttattgccacctaggggcaccaaactgtttaatgctctcaaaagtttaatatgttgattaacactttatattttataggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgagagagagagagagagagagagagaagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaacctgttgcaatgatacaagactccctaaacatagagtaaaaaacaatttcttgccttttattatctactatgggcagtggagtttaattatagcaacatgatattctaggtagaatttggcagctcttctctttgacttttggtcacggtaagaaaaattagaacaagcaaaagccattgtttcagcacaggattggtggtactacacaatttcaaatgatgactaaaaggagtagagaagggttaagaatattagagatgaggcaaaggcagtggattaaattggtaattttttgacactttctttaattctttaaggcattctacttgctaaagaaaggttccacaggtattacagcatatagcagggattccagttagaatacattagttactcacacaaaggctgtgaaggataataaaacattcagaattacatttagcttcttcatattccagttaattttatttaatgttttcaattctatatgtagtagtaaaacagaataacacgattaaatggaggtaaaaatatagcttaagaatttatacttataaatatgggaatcatggaaaatgattttatttcccaggggacataaaaatttataccactcatttggtaccctagtcctatcttagtggtgtcaggtgcaaagtcactcattctgagaaattttacttctgtagccattcagattaaattttttaaaatagggagttaaactcagcttgaaattgaaggcttcctataatctgatcctaatgcatcttctctgagctttgcttctggcaattcacattatattatctatatgagtaagccaaacttgtctattcattattccaggaataagtaatatactcatctacctcaattacttttaatgcaaacctctctcccttctacttacggaaattataatgggtttttaaggttcataattctatttccattaggcttcagagtctgataatgcttcacagagatacacctttaccccagtctcatttagcaaaccttttccctattcattttagaaataagcattccaactgtatggatgtcccattcaacacttttttgtttgtttgttttttacagtcttttgttgatggcgcatgctgatgctgaaaggagaaaataactattgaaaatatctaataagttaaggttaaaaagaaataacctaacatagtgcacactgagtatttttcagggtaaagaaagacacatttatcaaatgcctactccttttcagggactttatatcaattatttctcatcttaaaaaaacactgcaagaaaggttttattatcaccactttacagatgaagatcaaagttcaaaatattacataatttgcccatgtcacatatctgttaagcagcatatagctcagatctgtttctaaaagctaagatctatgctttgcaaaatcatgtttaaaaagtcatgggcttcaaagttaggtaggtctgggtttgatcaagcctctgagactcatcagctatctgaccttaggcaagttatttaacctctttatgaagcttcaattttctcacctataaaatatggataatattgatatgcacttcaaagttgatgaataaagtgaaaaaatgcatttaaagtataagctaagtgactaatacataagagctaacatttaat

SEQ ID NO: 666 - DNA, 20407 bp, Human
  misc_feature (1)...(20407): n = A,T,C or G
gaaggactgcatttatttgccttgatccagcctgggagaagtcaggatagactttgggctgcttggccctggaggcagcttgagctgggactggggtggggggctcctgaggggctgcctaggacactgcagcttttgtgccttctccctgctgccaacacccccacacacactgctgcagccactctaaagccctttgtctttcattgcttagtcaccccctttgtcctcatctcaaataggggagtggaaaggggcagtagagttctctggtgatagctcctcttgcccctgccccttctggtctcccaccctttgtccgactcctctagtcccagccccgttggcttagaaccagggtcaggcaagtggtgggtcaagaggtgggtctggcagtcacaagggggtgggtgatccaggaagtgataggcaccagggcaggtattaccgacctgagcaggaagggagggggaaaggaagtattctgacggatatgatatgcgggggacaggaggtgacaaagcagagtgaataggggaatagaggcaagaggaggtggtccacttctgggaaaggaaagagactgctgactgcactctccttcctggggatttcctggggaaacaagcagccagaggatggggtgagcagaaattgcccctacttctgaacccttccttgccttgagagttcatacccaagacctcttttccgagttccctcctatccaaagccaaaggaataatttgcttcctttccctaacaccacctcttcctccccagccactttccccaccccaggcaatggatttctcccagtaccctaatttccctatatgcacaatgctgtctccaccctctccctgccccagggagaattaaaaagaaaagatgactagatattccaggaaccactgggttctcagagcaaggtggggtggatggtgggagccaggtggggattctcccagattgatactgggtgaatctgggttcctgagagcaagtcttgcctatgctgggggctggctgacttgaggctgggggagggtttagggcagttgggagtgggtaggagcagggccaaaagcctgggggaagctactgggagctgggccagggaaatggggagtcaggaagtggggagggggaaccctggggggaaatggaggcggaatggctgttctgggctttggagggggtgggtagtggtaactcaggaagggggatcctgagggagagaagggacgttagaaaagaggaggtgccaccctggatccgccttctataaaaggaaaagtcgttaacccctcctgccttgtcatctgccgcctctgttatgttcattccaagcaggatcatcctacctttgggcagtcaactccctgatcactgtctccttgcctcccccaatgttctgccttttttactcttcccagctgctcagttctatcctgagccatgtcaagctacctcttttatttgttcttccctcttgatgcctccttacctgttccctaccctcttttctcaggcagctcactcagtcccctcagccctggaaaccagccactagggccaaagggcagcatgagggagccttgagaaaagagaagccatggtaggttagactataagagcaggaattctcccaggaccgtgatcctatctgtgcatgccggccaggccctttccctcactctctgcctctcctggggctctgtcccaccaaaaagggaaagagacagctgagggctgattgtggggtttgggaaaaggctatgtcatcagctggcccagtgcctattatccattcggctgctagagattcccctcccctgggcaagtcccatttttttgggaagcgatgatacacccatctgagtcccaccgacagagctcagctgagtggcttagagatcagccaatcaatcgcagaggctcaccatgcttaaaagagctggcgcggagagaggctggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcattgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaaggtaggcatctctggagtctgtgtcctgcggtgtcctcccgccatgtctgtcctactgacccctattcaccctctctccacccacttccacttctggccgttctgcttccctcccttctgcctgcctttcctttctccatgagcctcctttcttggtaaggctcaggcctctccccttcacccttctcctagccagacccaccgagggttctcagaggtgggtcacagactctgggctgggaataactgctccctctccccaccccaccccttcctggccatggcatctcctactgacacagtccccagcagtaaaggtctcctaacagccccttggccttggctcttttctctgctccaaatttgattttcatcccccactcccagctataggagtcaggtttgaggccctagggcttggtgtctggcttctgatgctgcctttaaaatcactgtggcaaactgcaaactagggcaggagtggcaagagagggagggtatcccatacctccttctggtcaatccccttcacacactgtggccggactgcgaggctgcctgaggctccatcctttcctccctcccactcctggtctcccccttcttcccttccctcctccctcctccctctctagctttaatccagaccagacgctccctccacaaccgccacgctgagctctggccctggccctagctgctgactgaatcgttcctccaaccacacagggcagacacgttgcagcccagccctctagccctggtcccataggccccagccacactcaggcctggagaaccccaaagtccctcctgacggcagtccaggctgctttcacctctggggctcccgcagccctgggatgtggcgtccccttctcctccccttcttagaaccagctgctgactcctcagagttaccacaaaagccctgagatttggcgttgggggaagggcccaaccaagacccgccaggagtcaggaatcccgtggggtgtgtggggcccagctgactatgctgagttccagacccaggaagtgagggattggagaatcgaccgacccatgggtctgagaggctatttcaggatcttcctctccctttttctctacagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggtgaggccccagtcagcaccgcaggccatgcactgcacaattctaagaagcgccactacatagactatgatgcaaatgatgttcctggagttgtgtgacatggtgccttgccccagccacactgccatgtgtggctacctaggccctgacagtgctgggtcctcagtgcccaggtccccgggaatctggatctcaacccaatggacccaggtgtcttggctgtctatgcaccttctatgatccctctccacaggacctgtgtggagtctccacttgcgacacgctgggtatggctgatgtgggcaccgtctgtgacccggctcggagctgtgccattgtggaggatgatgggctccagtcagccttcactgctgctcatgaactgggtaaagtaggggtggatgagaaaggtattagggaggagaaggtgggggagggggtagcaagttcaccacagtgttaatgggggtcccaaggtattcttcccccaggcctaggtatagggctattactcctctctgctccaggtgtagacatacatttacatttttctattaaataaattagttggtcgaaactactgtgaactcctctgtgtgtgtgtgtgtgtgtgtgtgtgtgtctgtgtgtgtgtatttggagggggagtcagagacaatgggtggggtcacagttgggaatgttggctataaggaaaagtgggtagggagggaccctgagtatattttggggaagaggagacagagaaagagacggggctacatactgggagccctgagagtaccataaaggaaaggactgggggcagggtgaggtgggtaatggatctgatcatccacagctgcagccagatttattatggagtccctcagggcatggggaagggaccctcagatcctatcagggcctttgctcccacaggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatggtaagcagatggcacttacctttccctgggtagcactcaattcctgtcctccagggcactctcacttccgctgcattctgcatggaccaaattgcctcccccaagtgtgcttcctctgcagtgtgggaaggggtgagaaatgctgctgtctttgtgtagttctcacttcctcccagaataaatagcatagctagaggaggcgaattttggctcagtagaattagaactgactttctgagggccagaactgtccaccactggaatgggctggctatgaaggaggtgattaccttgtcacgcagtgaggtatgcaagaatagcaggatgactgccactaggcagagatgttgatgagaagcaaactcaaatattctatagttggttagaataggcagaattgagttcctatccttactctgttttgttttgttttgttttgttttaaatacagatgtggtctcactgtgttgcctaggctggtctcgaactcctaggctcaagcaatcctcccacctcagccttccaaagtgctgggattacagacattaagccaccatgcctggcctcttattctgttctttaagcaggtgtagatgtgtgactgtaagttacttcacctctctgtgtttgtagttgatatgtcagataagtataatagcggtacctatctcataggtatttgccatgattaaatagtgctggtcaagcatttagccaatgctcatctcataataagcatccaataaactatagctgcccattaaagcctcttacagggctaggcacagtggcttacacctgtaatcccaatgctttgggaggctaaggtgggaggattgcttgagaccaggagtttgagattagcctggacaacatagcaagaccttatcactacaaaaaattccaaaaaattagctggacatggcacatgcctgtaatcccagctactcaggagcccaaggcaggaagtttgcttgagcccagaagtttgaggctgtagtgagccatgatcatgccactgtactgcagcctgagcgacagagcaagactctgtctcaggaaaaaaaaaaaaaagtaagtaattaaaacaaaaattataaataacaaaaatttaaatcctcttatagtcctaggattgtttttctaggctccatcaggccccagggagcctaagctttctgctggcaatcctgaatgctcccctcagcccgttgctgactttgtgccccaacccccttcccagggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatgtgagatcctagggcaggggtggggtaaagggcccgggggtgtggggactggccttaagcccaggagagagttcacttatgccccacttccgttctgtgcctttgcagattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcaggtgaggagtaggggggatgggagcccttgggaggggacagtagagcaggaaggactgtcccttgagtgcaagaccaagggggtgttgattcccctgctgctgtggggagtgcctttaacctctgggaattgtccttggccgtctgcagggaagagcagagctgtgctgtctagagttctcaggggttgggtggagggatgtggggtgatgtgaggaaggaaggaggggctctgactgttttacccctccagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtgagggtcaggacacccccaggccctgtctatggtcacacacacccgcagtgctccctctgctttctgataacaaagatcacccaaagtaaccctgttcctacagccacgccagcccagtccaggattccactcagacttatctgtacatgggtatcaggaaaacgagccccagactccagatatgtggccaataggtccctctagcctatcctatttcccgtggtttcttttcctctgactccccatcttctaatgctgcatttggtgagaatcgaatgtgtggcctttgggacaagtccttcacccctcttccatgggctcctctgtcaacttatagtggtggtttcattcagctcctggacagccagtccctcaatggacaggcctcctggagatgactgaagtccctacactccctctctgtgatagggtggtgggttgaaggctgcacaaagaaaaacaagccccagcagcattttgctcccttcgccccaacctgagaatttctacaggctggctgccctctagcgtccatttagggacagtgccatcaaggtttagggcttggtgctgggaccagacagactgcacttcccatcttggctcctctgcttgccatttgtgtggcttttggacaggttctttagcttttctaaacctcaacgttccatccctaaaaacctcaaatagtggtggtgagatttacatttgtgtttataaaacacttagcatgctgcctgattcatactcagtgctctgaaaatgctggctagatgttatatgtgataataattattattgttatgattatcacccacatggtggccggcactcacccatctacatcccctacttcatccaacttttccgacaacattgcttccctgatgggacatgggtctcgtttgatttaccaaccccttttgacttaggaggaaccttcagcattgttctttctcttttcctcaggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggttctttcaccatcattcctccctctaccttcctggacattctgggtcctagtgatgcagaggggaactcagcactgtttccactctcaaagagctcacagtctagcgggagatagacgagtaggcagctacagtgcggtttcccatgtattcatccgaagttggaacagggtgttgtgagtgcccttgtgggcatcagggaaggcttccttggaggtgacctctgagctgagtctcagaaggagggtaggaattagacaggtaccaaggaagtggggcttggaagggcaactcaataagggggcagtgggtgtaaaggtccagagataagaggcagtagggcacatgtgcatgtagctctgatccagaccgaacagctcacataggattgggtgacagccatctacacacatgtacacacatacagtcacataagcacagctcagaaggctgaggggattcaggtgatcctgagctccccatctactccttccacacaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccggctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactcagcatctagtaagtgctcaacaaatagcagctgctgttacttactgttatcaaatttctgtccacatccactctccatatgcacttgaaggtggcaaagatccacaaccatggtgcctgcctttatcctcagggtccgttcctttggttggcagacccctatcctgggttctgagggaccaacagagaaaggaaaattccatccctcacctctggaagttcccaatcacaggaaggaaacatagtaagcacgtggctacaaatacaattgacaagaacatgaaggtgcaggataacaagaacaaataacaagaacaactgcatcaacacaaatgagtgcttagtaataagggtgatagttgaggggtctgggtttcacaaaagtagaaagagcactggagtgggagccagcgggtctggattcaatttggggctcggcgtcttattagctgggtggtgttgggtaagtcactgatgctgagccttagattgctcatatgggactaacagtatctactcccacagagttgttctgggaacaaatgctagaatattttcaaaatagtaaaggttatagtcatggccatgtgagaggttacccctatgactacctgaagatggaacggagtatccagaatcctgccagtgtaaacccagcagaatgcctagaagatgtgagattagaataaaatttcataaaacaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctgatgcctgaggagagggagggaataaaacatctgcattttcccctctgggcaaggcgcctttgcttgagaaagaattttgggctggatgagatggttcacacctgtaatcccagtactttggcaggaggattgcttgaggccaggaggttgggaccaacctgggcaacatagaaagattccatctctaccaaaaaaaaaaaagattgaaaaattagccgggcgtggtggcacctgtagtcccagctacttgggaggctaaaataggaggactgcttgagcccacgatttcgaggctatggtgagctacaatcatgccactatactccagcctgggtgagagaccaaaacaccaactcaaaaaaaaaaaaaaaaaaaaaaaagggccaggcatggtggctcacacctgtaatctcagcactttgggaggctgaggttcaaaaccagccaggccaacatggtgaaaccccatctctactaaaaaaaaaatacaaaaaattagccaggtgtggtggcaagcgcctatagtcccagctactcatgaggctgaggcaggaggatcgcttgaacctgggaggtggaggttgcagtgagccgaaattgcgccattgcactccagtctgggcgatagagtgagatccatctcaaaaaaaaaaaaaaaaaaaaaaaagaacttgggcagtcctctatgtgtcatggatggaacagggatgggcaagggtggtaggtagaccctgcaagaatttggagttttgagaggcagacgcaggactgctagggattggggaaggtactggatgtggggttgtgggagaaactataggtaaagaagaccctgaggttgaggtggaagagtgaagaatgggggaaccaaaggcacttcactctgccatagcagcccctagctgggatgccaaatactgcttggaatgtgaagctgggactatggggttgaggcaggccatggaggttgtagtggttatatgtgctatgcttactggatctgggctttgctaatcaagttctgtaccaggcagtgccttatacagcaccctgtactctacaccagccagcacagcgcctgcttcctctgcagcaatgagaaaagactgcccacactctcttctctccagtaaacacggttctccctgctaggcttggccccctggcccttcctgtggtcctcctactaaccaggctgaagaagatggagacaagacaatagtgatctttactcgtttcatctagtttgcaaaatgagaccacagatagtatgtttatggaccttgatactatgagttgatggtacaatgagcagagttctgtgataagtagatgtaaggtacaaatacaaacaatatatacgactgtcctaaaggggttcacactgcattctgggcaggggaggttgtatactgctcccactccaccttccccgcaaacagaagcaatgggacagtaaaagggactagaagataagagcctaatgagccctgaactgaatggactatgagggttatggagggctaccttgggctgggccctggagaacaggtcatcatgatagcccttctcactttcctttaatgttcatggagatacacttttttttttgagatagggtctccctttgttgaccaggcaggagtacagtggtgtgatcttggctcactgcagccttgaactctcaggctcaagcaaccctcccacctcaacctcctgagtacctaggactacaggcacgagctaccacacccagctaatttacttttttttttggttgagacgaggtcttatcatattgcccaggctggtcttgaactcctggcctcaagggatcttcccacctcgatctcccaaagtgttgggatgaccagtgtgaaccaccatgcctggccttttcttttgagacagtctcgctctgtggctcaggttggagtgcagtggcaccatcataacttactacagccttgaactcctgggctcgagtaatcctcccacctcagcctcctaagtagcttggactacaggtgtagattcacttttaaatcacttttctgcctgttattttaagagaaagcccttcgctcaccaagtagggttctcactggcataagtaagtttttctgaaaatgagactgagcttaggggccacctctgtgattgggtaagtaagcaggagctagagtgaaagaggggcagagagagctagctcatcgaagagaagtgatgggcatctcagccctcaatcccaggcaaggcctgacccttttctggaatggtctctgccttaccacacctccaagacccagattgtaggtaggctttacctaataggagtccaacaagttcttgctagggatgggattgttggggggcacatatctccctgtaagagccacagtgagctctgtttcccatctgcctacttattgccctcgtgggcctgagctggggtgtagatatataaggaggaacagaaacagtaataacaggaagtaaggaggcactgaaacaattcaagtatctggtcctggagatgaaaagaggaaatggaaaaagaaaaggcattgaatgacaagggattagaaccctgtccctagagaagttcaagaagagtttggacaaccattttatgagatggcaagtgttgtgcatgagtatgtgtttgaggtgggggaggaagttgaagcaataagttgggccaatttcctaaagtcccttctgcccctgagattctctgcttctgtggttcaaacagaggaaatctggacatttgtccagccactatttttgtaatggaggtgggacagccagggttcctggagtgtgctgtggaatcggcatttacacttctcttccatctctagtctcatttctgtaatcttcatacagtattacagtattttgttttctaaaataccagattggcagtaagtgacaaaactagcatctcattggtcagggctttgtgggggaggaagggagaagaaagtggatttcaatgtattaatattttattggctgagaggatgtttctgaaccaattgagtaccttccccattgactgttgctggggccaagccaaaatcattggcaccacgagaaaccagatgacagctggaggaaaccacgagtgctaaaaatgctcagaaagaggggggtcagggaaggcgggggagcaacaacactgaacaacttccccaggcaggatcttacatggggacagacccagggtacttaagtagcattaggaaggaaagggaggggaggaagtagattaagtatccctcacagtcttggcacaacaaacaggcaccatacacccacaccaacagtgacacattgacataacacacatccaacttcacagagacacactagcacattctctcttttttttaaaatttattttattattattatactttaagttttagggtacatgtgcacaatgtgcaggttagttacatatgtatacatgtgccatgctggtgtgctgcacccattaactcatcatttagcattaggtatatctcctaatgctatccctcccccctccccccctgcctttctttttcttcttttttttcttaagacagattctcattctgtcacccaggctagagtgcaatggcgtgatctcggctcactgcaacctccacctcccaggttcaagtgattctcctgcctcagcctgccaagtagctgggattacaggtatgcaccaccatgcccagctaattttttgtatttttagtatagagacggggttttccatgttgcccaggctggtcttgaactcccgggctcaagtgatctgcctgcctcggcctcccaaagtgctgggattacaggtgtgagccagggtgcctggccaacacattctgttgataatatagatgcaaataagtagtagggagcggaaaatgtaagaattttcacctgaaaatggatctgaagagtaaaagatattaattgacctaatcgtgcattgagaattgactgtttatcccatttatttgttcaataaataagccaatgggttgtaaacattgtaaacattccacagcatgtggaaaggacatggatttttggagtcaaattgaatctaagccttgctacttacttacctgtaatgatgcaaccttaattacttgatctctgtaaacctcagtttccttacctacaaaacgtttgtactattacctgccttatagagaggtccagacttaagaatatgatgatgtaaatgtttggcactgtgtctggcttttagtaagtggtcaataaaggccagttctcctttccttatatctcttcctttgtctgctccctgacttctaacccctgcattcacgtgagaaaacagttatatcaaggaactgtctaggtcagatctaagggccattttgtaaatttgtgcaaaaagttctggcttacattgaagggatgataaaaggaaagacatggtcctaatcctcagagttcacaatactggtggctgagacagtcaagtaggacaaaaatttcagacttctgtgataggtgccatgatcaaggaggggcacctagcacagaatatgaggccacagaagtgtttctggaggaggtgcctgtctctccttctagaagtgagcagtaaggctgggcacagtgacccatacctgtagtcccagcactttgggaggccaaggtgggaggatcacttgaggccagaagttcaagaccagcctgggggacatgatgaaacctggtctctacaaaaaatacaaaaaaaggcagggtgcagtggctcatgcctgtaatcccagcactttgggaggccaaggcaggtggatcatgaggtcagagttcaagatcagcctggtttgagaatctggtctctggttcgagaccagaccaggagttcgagaccagcctagtagatagaagatgaaaccccatagctactaaaaatacaaaatttagccagcacggtggtgggcacctgtaatcccagctacttgggaggctgaggcagaagaattgcttgaacctgggagacagaggtggcagtgagccaagatcatgccactgcactctagcctgggcatcagagcaagactccatctcaaaaaaaaaaaaaaaattagccaggtgtgcttgtgcacgcctgtagtcctagctactcagggaatggggtgggggctgaggtgggaggatcacttaaactcaggaggtggaggctgcagtgagctgtgattgtgccactgcactccagcctgggtgacagaatgagaacttgtttccaaaaaaaaaaaagaaagctgtaagactgcagggaacccatggatggtgggagggtgtcaggggggcatgatttctgtttgctaggtcaggttcaggttcttctatgttatacaaaaccaaagtgaggtaaagaggtaaagagaacagaccagaaaaccagaaactggaggataatatggtaagagaaagagctgagtgggagagagatctggaacaacagtgtaggctgaggggagttggaagggatagttttgggaagaaataacatccaagtagaaaatgttgaatggaagagggagaggaatatttttttttttgcaacagagtctccctctgttttccaggctggagtgcagtggcgccatctccacctcccaggtttaagcaattctcttgtctcagcctcccgagtagctggaattacaagcgtgtgctgccacacccggctaatttttgtatttttagtagagacagggtttcaccatgttggtcaggctggtctcgaactcctgacctcaggtgatccacctgcctcggcctcccaaagcgctgggattacaggcatgagtctctgcgctcggccgagacagaggattttaaagacattgggctgtccattaaaatgtgctcctaatccactgcccctttcccctgtctctgatatttccttgagaaattaagtagagatttaaattagtttttgattactaaactgggtttcttctattgtgttatgtgccatgactgggccagtgtgggccccaggatttattcagaatattgaaagacaggatgttgtggtggaaaccagcatgttaaaatttaagttttcagaaacataacagttctaggtgatgactaagtccagggtgtggccagggtgagacagagcagaagggaaggttcttgaaaacagggagcttacaaattaatgtaaaggaatggccagaagatagtagataggcctttgtggtggctcacaggaggctcacttgaggccaggaattcaagaccagcctgggcaacagagtgagactccgtctccacaaaaaactaaattagctaggtacacacctgtagtcctagctacttgagaggttgaggcaggaggatcaccttaacccaggagttcaaggctgcagtgggctataatcatgccattgcactccagcctgggtgacagagtgagtctctgactctaaaaaagaagatggttagatacagaaggagacagaaagtgaaggctgggcgcggtggctcaagcctgtaatcccaccactttgggaggccgaggtgggcagatcacctgaggttagcagtttgagaccaccctgaccaacatggagaaaccccgtctctactaaaaatacaaaattagccgggcgtggtagcacatgcctgtaatcccagctacttgggaggctgaggcaggagagttacttgaacccaggaggcggaggttgcggtgagctgcagatcatgctgttgcactccagcctgggcaacaagagagaaactccatcccaaaaaaaaaaaagaaagtgagcgtcagtcctgtaagacagaacgcgatggaggaacagaggctcaaaggaagggtcctctgggagaaccacattttctctctttctctctttctttcttctttgagacagaatctggctctatcactcaggctggagtagtgcagtggtgcaatcagctcactgcagccttgaactcctgggttcaagtgatcctcccacctcagccctgtgagtagctggaactacagctgtgagccaccatgcccagctaatttttgtatttttcttggaagggaattttgccatattgcccaggctgatcttaaactcctgaactcaactgatccacctaactgggcctcccaaagtgttgggattacaggcgtgagccatgatgccaggccaagaaccacatttcaatgatctgtttaagtctgtcttttccactacacagtgatattcttaaaaaatcaaggctttttgagttatactatatcagaagctaaaaataataataaaaaataataaaagtaaaacaaacaaaaaatcaagtttgggaggccatagcgggaggatcacttcaacccaggagtttgagaccagcctgggcaacatagtgagactgtctcttcaaaaaaaaaaaattataataaaaaaaatcaaggctttgtcttggcttctatttgtgctcaaaagttttccatagttctaatgatcacaaaaccccttaaggctagagttcattttacagatgaaatccagagtgtattgctcagtacacagccaatgggtttcaaagttggtattgtatttaaacccagcattatctcattttgagccttcacaggcacctcaaactcattatgtctaaagtttgtcatctctaccccttccccaaaatgtgcttcttcctaagttttgtttctcattaaatggcaccacccagtggtccaaattagaaatctgggtgtcctcttggagtccaattccctaacttggcacatccagtcaatcttcaagtcctgtttgcctcctgaaagtt

SEQ ID NO: 667 - DNA, 51905 bp, Human
attacaggtgtgagccaccgcacctagcctacaagaacaaatattacatgattttactcacatatgagtagacaaatactagagtagacaaatttacagagagaaagtagaagggtggctgccaggaacttgggaaaagagggaaatggggagttactgtttaataatacagagtttcagttttgcaagatggaaaatgttctgtggacggatgggaggtactgagggttgtacaaccgtgtgaaatacagttaatgccagcgaactgtacacttaaaaatggttaaaatggcaactttcacgtaatgtgtatatatatctatagatctatagatatctagatatctgtagatctatagatctatagatagattttttttgtttgagacggagtctcgctctgtcacccaggctggaatgcagtggaccgatctcggctcactgcaagctctgcctcccaggttcacgccattcttctgcctcagcctcccgagtagctgggactacgggcgaccgccaccacgcccggctaattttttgtatttttagtagagaaagggtttcaccgtgttagccaggatggtctcgatctcctgacctcgtgatccgcctgcctcggcctcccaaagtgctgggattacaggcatgagccaccacgcccgcccatgtaatgtgtattttatagtttaaaaaaaaaacttataaaatagtgtggtactcagacacagatcattggaacaaaaatccagaaacagacccacacatatatggtcacaaggcgaaggtaattcaatgtataagagtcttttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagagtcttttcaacaaacggtaatggaacgactgtatatcccaataggaaaatgttgacacttacttgacaacataagcaaaaattaatgatattagatcatatcatagacttacacgttaaagactatgtaaaacatatatgagaacacagaatatcttcaagaacttgaggtaggcagagatttcctagcacaggaaaagcacaaaccattaaaatataaaactgaccaattgacttaatcagaattaaaaacttctttgccaaaaacgtcaaaacaatgaaacgacaggcccagattgggaaaaagacttcgcaatcatttatgtaacaaaagattttcattcagagcatacatatatctaacaaaacatttgtatccagaactgttaaacacgaaggaccagatttaaaaacgggcagaagactggaactgaaacttcacaaaagatgcagaatggtcagtaagcacaggacaaaaacggtgccagtgacgctggtgccaaagcgggaaggaacgcattcttcagcctaaaagacctaacagtaggacacggacataaccactcccggccaaaaagaacacagagcaacacaacgtcttggctaacgaaaactcaaagcctcaattcactcagttccttcacagcgctcggaaacagagaagtctcgcggtatcggaaaatgcgcggcgctcacagccacacctgacgagatggagggcgcaggcgcatccacggctttcagattgggcgactgacttcaaaggggggggcaaacagggaacgcgcaggtataggagcgctggctggaggctcctcgagagctccccagacacgcccccgtgcgtacgcccccgctgccgccaccttcggttgaccacccccatctagactgtactctcgcggtatttgtcccgactctcgcggggtttagcgtggcattgggaggcccggcctgggggaggagacggcgttccgttagcggcgttggggtttggctgcagtggcagtgctttctcttctgctcacggggacccgctcaggctggaggccagccaggtgaagagctcgcccgcatgcgtgcgcgctgcgtgggagccgcgaggcccggggcgggagggggcctcgtcttggcctcctgcgctgtcgcgacgggccggcgtgaggcaccgtggcgcggacttcgtctcagccccgccctcgcccctgccctcgcccccgccctcgcccctgccctgaccgcttttctccccctctctcccagctcttgccgccacctcggtcgcgatgggggcgcaggaccggccgcagtgccacttcgacatcgagatcaaccgggagccgggtgagctggaaactggggagcgctgctggggccgaggcctgccttggcgaaggggaggggtctaccctcagcaaccctcccccggcctttttgggagcgggtaggaggcgcaggcaactttccgttttctcttgagagaaaatcagtgggagaggaaggtggcctgggcacacccctaactcgcagtccgggcctcttcctgccaaaccccacacaccccgctgcatctccggactgagtcctcgtagccagcctggcgccaagaaaaggaggtgcagttctttgaggactttttctctcccagtgtctccgtgaggcagacactcccgatccgatttccggttatcttgcttggtgctatgaagtttcaactagtaggaaatattgtgtgtttcctaatcacgatatatcactaatatgttaattttgcctctatttttccttaagaatctttagctagaatttcgtggttcctgggaaaatggcttagtgaagatcttttgtgataaaccagagcattttgtaccagcagaattgcagcatgcatgcacttagcattaatgtttgtctttagggaatccagacatttgttagtgtattttttttaaatgaaacatttccttctaaagcatagttatttcattctaagtagcagagcgtgcagggtttcaaactgttttcttagctttttttgttatccgtgacaaaagttttaattggagacatatatatatgtgttgtctttgtgcaacatcttgttctgcatattcttatgagagcctgctactgttctagggtctggagatagagcagcgcataaaacaaaggcctcttccttttatagtttatattctattggggggaagacagacaactaggaaaaaaataacagtgacttgtagttgggatactattttaataagttggtcagacaaggccattttgagaagatgagatttaagcaggtatcagaaggagatgaagtgagccgtatttaagaagagcattcgtggtagagggaaacagcacagccctgaggtgaggagtagtatacagtcaggcgccaaatgacatttctatctttaacaatggtcttatatataatacctttttttggtaactttttaatgtttagctgtgtttagatatacaaatacttcattgtgttaaagttgcctacggtattcagtggagtaacatcctgtacaggtttgtagcctaggagcaaatagactatatagcttaggtgtgtagtaggccgtaccatctaggtgtgtttaaatacattccatgatgttcacacaatgacgaaattgcctaattacacatttctcagaatccgtcctggttattaaacaatggaggactgtacttgcatgtttgagggacagcagggtgcccagtgtggctggagtagaagaggaaagagaatagtaagaaatggcctgtaggactgactcagtgaggtaggaagatattaaagggtttcgagcaaagggatgagataatcctggaaatttggttgccttctctctctttttaatgtttttagccttgattgatctttttttttttttttaaataagtgttactagaaagccttgatggaccttaatctttattttgtagtgaatccatgctttagataacagggttattttctattaagaattaaaaatagctcacgcctgtaatcccagcactttgggaggcagacgcgggtgtatcattttgaggtcaggagttcgagaccagcctggcctacatggcgaaaccccatctctacaaaaaataaaaaaattagctgggcatggtggctctcttagtttttgcctgtagtcccagctatttgggaggctgagactgaaggactgcttgagcctgggaagcagaggttgcagtgagtagagattataccactgcatgtcagcctgggtgacggagtgagaccctgtctcaaaaaaaaaaaaaaagaaaagaaaagaaaaatagtagattgctgaagagtagaagtatgaccaagcatggtggctcataccagtaatcccagtacttagggaggcccaggcaggaggattgcttgaacccaggagtttgagaccagcctgggcaatatagcaagaccctgtctacaaaaaacaatttttttttaattagccaggcatggtggtgctcacctgtacttggaagggtgaggtgggaggatggcttgagctcaggagtttaaggctgccatgagctatgattgcaccactgcactccagcttggtcaacagagcaagatcttgtttctaaaaaaaaaaaaaaaaaaaaaaaaacagcttaagaaaaagtacaaataaaaatttctgtagttaagtactcctttcctagtaaatgttcagatcctagatttgcacataacctgtgttgtgaaaaatctccagaatatgtttgacaaatgttcaatgaacctcattcctcaacatccaaggcaattcattgtgatagatgtgtagatgtgattagcactcttgagaacgccgaatcatataaaacaaggaaatgcaatgcttacattgttctaggtttaatcatttgatagttggaaatttcatatggttcagtcttgtgaaataactagcactttttgagtatattaactaaatagtggattttacacaactttttttttttttttttttttgaggcgaagtctcactttttcacccaggctggagtgcagtggtgccatctcggctcagtgcaacctccgcctcccaggttcaagcgattctcctgcctcagcctccctagtagctgggattacaggcatgtgccaccacccctggctaatttttttgtatttttattagagacagggtttcatcatgttggccaggctggtctgaactcctgacctcaagtgatccgcccacctcggcctccgaaagtgctagaattacaggtgtgagccacggtgcctagcctgtggtttttattaaagaaattggtgcattttatctaagttgtcaagtttatgtgcttagagttgtttgtcacagcctcttttaatatctgtggggtctgtagtggtgtctcttttcattcctgatattgataattcttccttttgtctttttcctttgtcagtctgacgagaggtttattcattatacattttcagagaaccagattttgatctgattgaattttgtttctatttttgttttcaatttcattgttctctttctttctaatgcttgcttcaatttttattttgttctttttctagtttcttaatgttgaagcatagattgttgatttgataccttttttttttgagacagtctcaaatgacttttaatttaattccattatggctagagaacacacatgatttccgttctttgtgcacttgaatgtacattctgcacttgaatgtacatttttgtgtagtgtgttctataaatgtcaaatccagttggctattagtgttggtcaattcttttatatctttgctgattttctacttgtttattgattaccaggagaagagtattgaagtctgcaactataacaactgtaattgtggatttatctatttctctcctttttttttttttttttttttttttgagactgagtcttgctctgtcgcccaggctggaatgctggagtgcagtggcatgatcttggctcaccacaccctctgccttcctggttcaagtgattctcgtgcctctgcctccccagtagctgggactacaggtgtgagctaccatgcctggctaattttttgtatttttagtagagacagggtttcttcatgatgcccaggctggtcttgaactcctgggcccaagcaatccacctgcctcggcctctcgaagtgctgggattacaggcatgagccatcatgcccggccgtatttctcttttaagttctcttagtttttgcatcattcattttgaggctcttaggtgggtacatacatatttaggattgttgtcttcttagtgaactcttttattattatgtaatgacaccttatattcctagtaactttcctggctctgaagtttcctttgcctcagatatgaatatagttacttccgttttattagtgtttacatggtatatcattttcaatccttttacttttaacctttctgtataatatttaaagtggatttcttctggatagcaaatagatgggtcttgtcccactctgacaatgtcttttagtcagtatgtttaactgtatacatttaatataattagttatgtttagatttgctttactgcttaagattcataaaaacagactggaaaatgtgtttttagcaaacattgtaaagtatttagaagtgataccaagaaattagtcttaagaggcgacaaaggattcaggcaaatgtttgagtactacttgtgtccttggtcaagccgtttaacaacctctttgtgaaatggaactactatacagttttgttcttaatttggttccaaagctaacaggacaggaaaatttgcttatattcaaaattaaactaaactttagactcacattcaaaatagctcatacttcgagtgaggtatatgggatctggtttgttctgagggaataggagaaatgcatctccgctctcaaggtcaccctgggtcataagctcatgagtagagtgactagatgcaatggcctgaaatttaaatgacttgcactgtatatgctcattaacctgttatattattaacctaataataggactccagtgtaatagtgcttacataacaagattgttgagaagagtaattaaataatgccatcttatagattgtattagagtaacatgaacttactctaatagggtggattaaggagcacaattttaattaggcacactactgtttggtataacaatcggataagcaggtggggaagagtggcgtgggagagaacagttggatagctctgctgctctgagtcattcttgtttgtcctaactgatttgaaggccactgtgctaatgacagtgctgggaatggaggcagaaatgaggtttggtcagttgtagggtttcctcaatgatgtttagattttataacgtcctcttatagctaaaatttattattgatactcctaaagaaaaaaatatttttactgcaactggaaactcccttgtcccccccagttcccatttttatatggaaatagttatttttatatgtgattttcgataatgcagtgtttcttaaaattctatcactgttcttgtagagcagtctgtatttgttaagtatatatagcacagtatctgattttttttttaagttgctttaagtattgcatgtgcaggagtatggacactaagtcaagttaaggggctttcatatttaggtattgtgcaggtagacctttgattttggtcccttttgttcccagagattgtatcttaaagtccgagagacagtgctgtaaagtgaaatcctgaattcttgctttcactccctatgtatgtatacttgtacaaagaattgaagcctgattcttaattcagcaatgtttattttattaaacaccaattaatctttatgtaatcactttttaacattttttaatattttgtctttacttttattttaaatttttatttttttcttggccaggcacagtggctcatgcttgtaatcccagcactttgggaggccaaggcaggaggattgcttgagcataggagttagaaacctaccagcctgggcaacatagtgagacactatccctaaaaaaaaaaatttcgtttggctttttttttagagacagagtatcactgcgttgctcatgctggagtactgtggctattcacaggcatgatcatagtgtggtgtagcctcaaattcctggtctcaaatgatcctcccacctcagccttctgatacgtaatcacttttggtgactgtagtttaccctcatatgaagataccttgtattagttaggctaaatgataagattggttctaacataaaggttaaataacagtacttacaacaatataaaagttttgcttttctgtcacacagcactcagaatcagcagatcagggctgtccatgtgagggatccaggctctttttgtgtcgatactgtgttacttttgacatggggtgggtgcgtgcggctcttaacagaaagattcaagtttaatagatacagaagaattgatggaatcagaagaatcatcattttgcaacccccatggtaataactggttcagaaagtagtcatcagtggccaaaccataggtgaaaagttgtgctgtgtgcaaagtatccaacagattatttatttaaaatggaggaaaattcctttacaactaagatgtggctaatatctcagttataaaggtactttaatgggtccgactgacatgctttctaatggggtgcaaaaaaaaaaagatggagactgttttagattaaaagaggccaacaaatgaaaaccaaatgggtatataatgcttgaatgagattcctggattttaaaaaatagatgtatatttgtcagtaaactagaaggaactcaaatgctaatcagttgaggattggttgagtaaaatttgatatagccaaacaacagaattccattcagccattaaaaagaatgaaaagggggaaaaaacatgtaaagggcattgtaggggtagttgggtaaatttgaatatggattattatgaggagttttttcccacagtaacagattcttcaaagccaactaagtgtccaacaattcaatttgattctggacactatctacctggagttagtgtcatattccacaagttaagagaaatcagttccacaagactgctcccactgcgggcatgccaatcgcaagtcctgagtcgctcttttttttttttttttttttttttttttttttttttttttttgagtttccttcttgtcacccaggctggagtgcaatggcgcgatctcagctcactgcaacctccgcctcccgggttcaagagattctcgtgcctcagcctcccaagtagctgcgattacaggtgcccaccgccacacctggctacttcttgtattttttattagatacagggtttcactatgttggtcaggctggtcctaaactcctgacctcaggtaatccacccacctcggcctccgtgagccactgcgcctggcttctgagtcactcttacttctgaccaaccagctgtaaattagggattcctacaaccccctgctcagcttcagtaatttgctagagcagctcacagaacttaggaagccagtttgcttactattactggtttattataaaggatatatctcaggaacaaccaaacagaagagatgcctagggcaaggtattgtaggtgcagagggtggggagatgcatgggccttctggacatgtcgccctccctcattgtgttcaccagtctggaagctctctctaaaccctgccatttagggggttttgtggctaaaaatatatgtatgtatgatcaattatttcatcacgtatgattgcatatgtgtgatcaattattaactgaatctccagcccctcttctctctctgaaggttggaaagtgaggctgaaagttacagacctctaaccaaggcatggtttttctggcaaccagccctatcctgaagctatctgggggtctgccaagagtctcttctttggatgcgaatgctaagggatttaagtgttctctgtcaagaatctgagagaaatatcaaatagtaggctgggtgtggtggctcatggcggtaatcccagcactttgggaggccgaggcaggcagatcacttgaggtcaggagttccagacaagcctggccaacgtggtgaaaccctgaccactaaaaagaagtacaaaaattagccgggcatggtggcgagcacctgtaatcacagctactcaggaggctaaggcaggagaattgcttgaacctgggaggtggagggtgcagtgagcagagatcataccactgcactcctgcctgggcaatagagcaagactcatatatcaaaaaaaaaaaaagaagaaagatcaaatagaacaaaagatgctcctatcagtcctatcacttagaaaattacaagttttaggagcactgtgctagaaactggggacagaggtcaaatgtaggaactggggacagaggtcaaatgtaatgtttcatgttatgccacagctatggagtagatgataatcactattaaatttctttggtgtagtaatggttttggatttaagtagcagaatatctttattctttaggaatataagctgaagtattaataattaggggtgaagtgtcacagtgtctttaactttcagtttgttccagaagattgtgtgtttagagagggataaatatggcaaaacatctttgtagatttgaaaatttcaaaacaaaagttcaagaaggggaattgcacatttattctttcagacaaccttcaggatcattttgtcaagttccctcagaaatctcactggtatttttgaaggttgcaattaagttattataggttactctagggaatattgggcacatttgcaattttgagtcttgtctaagaacaaggtatctctccctttattcatgttggcattatgcctctcaaagttggagttttgtttttatagatcctatactcttatggttatgtaggtagaatgtttcttgttgtttttgagaatgtgatttttactgtatttttttctactagttcttgtttgtcataatataaatatcaacaacttcagtatctgttggtatttcagttggttcttttgggctttctaggtgtatagctaatgtttcaaatggtgataaatatgctcttttttacttgtaaatctctcatattgtcctcttatctacttacattgactagaatttcctttttttttgagacagagtttcgctcttgttgcccaggctggagtgcaaaatggtgcaatctcggctcactgcaacctctgcctcctgcgttcaagcgattctcctgcctcagcctcccgagtagctgggattacaggagtgagccaccacacccgctaattttgtatttttagtagagacggggtttctccatgttggtcaggctggtctcgaactcccgacctcaggtgatccgcgccccccaccgcctcccaaagtgctgggattataggcgtgagctaccacgcctagcctacattgactagaatttctgaaagagcattaaacagtagtgatgctaacaactacttttgacttgtttcctgcttcactggaattaatgctacaggagtgtttcaccattaacgataatgctgattgttgatttgaaaaatatctgagaatatgtgtgtcatataaaggaatgaatgttgaatttcttttttttaatttatatttttcttttttaaaatttattttgttgtttctgtagtagatatgaatgttgaatttcaccgtgcacttttggtttctatcgtgggattttttttttctatcatgggatttttataggatttttccttcacttcaataaactatattagtagatttcctaatgttgaatagtgtctcttttaaaatgagattggcatatggggttttaaatttgttttatatcatctctcccaggctttggtttcgattttattttgtttcaaaaaaattaagcttttcatcttttgctgtgctctagaacagttgatatagtgttacactttaatgttacttgaagattagaagtaattcatctatatctaaagaattaatagcagcactcttttggatagttagcagcattttagtttctttattgggcctgttttttatctgtatactatcttataattcttttttctaaattttggtattcttccttttatcttcctaagtgattaatttatctttagttttattcattaatgaaaatatttatgactatatgcagtgatcaggataaataagtggtatttaacactttttgcattgtcagacctggcagctctaacatctgacctcatttcctgacatcctggccctttgattctctgatctgcactaatatcctcatcataactacatgagccagtaaatatgttctcttttgagtttttgcttgtactatctgcaggaaacctttagctgggtgtttatggacatgtcatggaaaaagcttcatgtggctaaataattaagttgtttcggccttatattttatgtttttctggctatttcctttgttttatatcttttactaggttgctgcccctcccaccaaagaagcttgaaagatgtaaaatattgttagttctacttgtgaatacctgtttaagtatgcttaaacccttggctgggcatggtggcctgtaatcccagcactctgggaggtcgaggcgggcaaatcacaaggttaggagttcaagacaagcctggccaacatggtgaaaccccatctctactaaaaatacaaaaaattagctgggcatagtggtaggtgtctataatcctagctactcgggaggctgaggcaggagaattgcttgaacccaggaggcggagattgcagtgagccaagatcgtgccactgcactccagcctgggtgacagagtgagactctgtctcaaaaaaaaaaaaaaaaatgtatgcctaaacccttatttcctctctgcttcagaaaagtctacctattgattcccactatgaagtatgaggatgcgtattttctttcaccagtccaaatccttgttggtttttattgattctccactgccttcctccaactgaaattatttttaccctgggcaacatagtgagaccttgtctcaacaaaaaatacaaaaattagccaagcatggtggcatgctcctatgttcccatctattcaggaggctgaggcaggaggattgcttgagcccaagaggttgaggatgcagtgagcagaggttgtgccgttgcactacaacctggggaacagagcgagactctgtctcttaaaaaataaaatacattatttttatatcacaggcatgagaaaagttcatgatatgttagtaaagcaaggtgcagtacagtgtgcataatctaccattttttaaaggaagaaaaataagaatttatcaatatttgcttgtgtatgaaaagaaactggaaaaatacacagaaaattaatgaaagtgagtacctgttgatagggttgggaaacaaggcttctcatcctgtacctttttccactgatttttgagtcatgagaacattacctattcaaaagaaagaacattttcagatggtacataaaaaaaattttgccattacataactttgtttcctaatactgataacatttaaaaccataattaacactgtttgcattgtcatacctggcagctctaacatccggcctcatttccttttattttaaaaccataattatagtgatttaggtttaattttgtaatgtaatatattcagtgcccaatgccactcttcctactagttctcattcattaattttttgacttatatctcagggatatgtattcaaatagatatttcaggataaaatgtatttcctttgctaggtatagaattcttgtttcacagcctattccttaaaaatggtagactgtgctcagttgtctccagtttgtaatataaggtgtctgaagctggtcttctttcttttttctttgtgaacgatatgattctactgcctggatactaggaggcttttttttccatttatgtctccaaaactaaatagctttattaattgatatcttggtgttgctccacttacatattttttcctggtatgtagtgaataattttaatctgtatatttgggtgttccttcatttatgaaagtattttgtaaatctgtctttgaataattttgttttgagtattattattattaaatatttattgagcacctaactgtaccaggcactacgtaagtctctggggatatagtggtaagtaaagcagtcatggtccctatctctctgcggtcacacacaacagtcagacctaggttatatataagtgcccttagttcatactaatgatagctcatattgtgtagcagctgcatttccatgtgtcattcctagccaagatgtgagcttcttgaaacttaggcactacgttcttcttgaaactcaggcacaacagtatatagtactgttggattccctgacatatgggtaagatctcagtaaataatatttgagtaaatggcccgatgttatgctgctcctgtttcttaatcttcttcctagattttgctcttggcctacctagtgtgatctgttcttaacctttgctcttttcctcaccccttgcttgtaattaattgttctatgggctattctttgccttctgtagtttatcaacctctgcaacatttttctaattgatgctcacttttccaactaccatatcgtctatgtacataatacatgtctcctttttaaaccattgaatctgcaattccagcgcaactatttctgaaaacaaggaacagtattgaaagatgatgtttgattttattccatctgtgtacttggtgattttattcctttcacctagtggccaaatcagaatctacaccatgacatagacttttcctgtctgtagtcaaagcttaacatgtgttgatattacctgattaatcttaatattgttcccctgtcttatttttaaggatctgcatgttggtattttcggattaaatttagaaactagtcctgctttgtgtcatttttgtccttagccatgtataaaagcaacatactaatgtttacactaacagtagattttagtcttattatagagctgtgtatctattggcataacattaattctgtggacgaaaactatgtataagaatattatcaatagtattgactgattcttgaactcctggtttcaagtgatcctccagcctctgcctcccaaagcactggtattacagtgcccagccggtatcaactgattctaaaagattactaaattccactaaattataaatagtatttgttgagtaacaaatttttcttagatattatttatttagtcagcagcagtttccaaagaggcatcatcagcaggtgttcttaactctttacagagatggggttactgtcacacttatttttctcatcagtttgggagccagagagacttacgcaaattcattccaagtctgtcctttattgtaactacagcttaatttttttatcttcaatatgttttgtaatcatagtttatgcttgccatcaccgaaaatatttactaactaaactagtgaaccacattgacttttttttttttttaaagaccatacctttagaatattgtctattttgagtttcagaatagaagtatcatcacatggtagcctgttttctataaaatcatacaattcaataaaaaatatttgttgaaaacctgttaatcttgctaatgagcttcagttcaagttagtatttgctgatctgtatcctgtagtgttcaatctcaggatttaatttgaagggaattaatactaggttacctctttataggtataaatcataatgctgttttgtttttttgaccttggtttttgtttttaaacccttcaaattgcatatatactagcattttaacttaagaaagtctcaactaatgtctgaatatccatagttcagcctttgccatgctttgcaaacctaattaggttaatgtgtttttttcaggattttaaaattatttttcttatgtgccaggtttaatcttgcaccttgttattgaggcaaaaacaattcagttttgttgtatttttcctcttgctcttaacaacataatgccatagaggagataaaacctctactctatcctttgtgccatgaggttcggagggcaaaagacttttttttttgctccaggctagaagagggtaagatattagaggtgagatttgttttttctttgttttttttttaagatggaatcttactgtgtcgcgcaggctggagtgcagtgatgcaacctcagctcactgcaacctccacctcccaggttcaagcgattcttttgcctcagcctcccgagtagctaggattacaggcgcctgccaccacacctggctaatttttgtatttttagtagagatggggtttcatcatgttggccaggctgatcttgaactcctgacctcaggtgatctgcctgccttggcctcccaaagtgctgggattacaggcgtgagccaccatgcctggccgagatttttttttttttttttaaaccactctagttagctatccctctccgaatattggataggaatgtaatcacattttaactgttttcaagtgtgtgttgtactactggagggtacacaatttccaattatctgttaaggagaaactaaaaacatttgaaactttgaacagctttcattttgaggcattacaagattttgaaaaaaacaaaacaaaaaacaccctaatgttgaagttactgtggccctaagaaaagccctatgttttgattatttcgattatgtcttctatcctgaaaagtagccatcttacagggattgcaaagatctaagtctgttctggtatgcaaagcgggatgattttgaacttgacaccagctaagccatttcccagagatttatgaggactgatcaaaatacatttattatactggtaaaatgtttctatataaatacagtgatagttactattactgatattatagggtttttttttaattctgaaatgactttagatacactgctccctgcttgaaaatcttgagtcctcctttttgcttgctttccgtctttttcttcattcccttaggttttaagaacagctacaaagttttgaaattgctttatagtttggctcttttaaagctataggctaagaatgttgacacaggaaggtcttccatcctgctttacccattaacgatgtctataatgcagtatcattgtttcctcctcacaggaactgaccgatatggccaggaatacaatacagtcttagtgatacagagtcattttgtgtctgttctgaacatgatttatgcttggtccacagttaatttttatttattctgtaagtccttttgaataaataaaaaggtttacaatggaaaagatcttgtagaataaaggggaaaggaactgaagagtaattaattgcaaatcagaattacgtttcttattttattgatacgctttcaacaggtccataaagtcacaattatttttatagtaatagattatgatttgccttttgtgctctcattctcttgtgaatatacagtcaggttttccagagatcatatattaatatgtgatgatatcactgccctgacacctaatggaatgtgtgcttgtgtattcttgtgttttaaacatttctgagttttaacatttaatatggtatatagcaatagatatgaactacataaacaaaagctcagtaatgagtttaaaagagccctgagaccagagtttgagaaccatttttctctggcatagttaaattgaagttgctgacttttccttgtaatctcgtgtttgttgtagggaagcataacctcttctctttctgctctctcaggggataggatggggagtattattttaagagtcttgctctgtcacctaggctagagtgcagtggcacaatcaaagctcactgcatgatcatagctcattgcagccttgaaatcctgggctcaagtgaacctcctacgtcagcctccccaataactacaggcatgtgccaccatcccccgctaatttttaaaattttttgtagagacaggggtcgttctgtgttgcccaggctggtctcaaactcctgacctcaggcaaccctccctgcctcagcctcccaaagtgctgggattataggtgtgagccaccatgcccagcttaaaatgtgaattttaagtgtgattggtgcaattcaggaaggtggctcttaacagttcttgcttaaaggaagaaagctgaaaataaagagacagagatgtttcttaacaatactggccagaattactgtcttttgatgtactctcatcactggaagggcccaagcataaatcaaacaactattgagagtatttttaaagaagatttatagttcagatagggaactatactacgaggaatctaataatacaaagttcctttaaaacacacttaaaatcctataattttggggctggaaccaatttggctgcatgtaaattttaacaataacaaataaaatggtgttcttgttcataggtatcacccagttaaatgctttcccattacatcttttaaaaaattaaaatgaattacaaaaatagactttctaatttgttagccctgtttctttctcccatttaaatgtgatatatttaacttgcttactatttttttcctatgtattttatttcagttggtcgcattatgtttcagctcttctcagacatatgtccaaaaacatgcaaaaacttcctttgcttgtgctcaggtaagtgaattattatttccaatgagaagctgtggcttacagttttaccttgctgaacagaatagatattttcctggaagaataatggactcgtgaaattagttttgtgaattaaaaaaaaaaaagagttacttatactgacttttatatgaaatcagggaagcatttcttaaggggaagagattagaaaggaatgatctcaaaaatgaaaaagagagtaagaatctacgttatataatggaatcttctctatacattttaatttataaaataatagcacacattcaaaactgatttggtagaattttatgaatttcactactttgaaaaaatttagtattccaaattttacaataaattttaaataaatagaaaaaatggggagggaaacatctataatgttactttaaaattagaacaaactggccgggtgcggtggctcaagcctgtaatcccagcactttgggaggccgaggcaggtggatcacctgaggtcaggagttcaagactagcctcgccaacatggtgaaaccccgtctctactaaaaatacaaaaattagccgggcgtagtggcaggcgcctgtaatcccagctactcaggaggctgaggcaagagaatcacttgaacccgggaggcggagcttgcaatgagccaagattgcgccattgcactccagcctgggggacaagagccagactttgtctcaaaaaaaaaaaaaaaaaaattagaacacactgaaattttaaattcttacttggatacacatatgcaatttttgcactaactccttgattttgttatttatttatttgggacggagtctgactcttgtctcaaaaacaggctggagtgcggtagtgtgatctcagctcactgcaacctccacctcccagattcaagtgattctcctgcctcagcctcctgagtagctgggactacaggcctgtgccaccacacctggctaatttttgtatttttttttttagaggcagaatttcaccctgttggccaagctgatttcaaactcctgacctcaagtgatctgcctcggcctcccaaaatgttgggattacaggcgtgtgccattgcgcctgacctcattctttgactagagtgataagtgtgtctagtattatgtcctatagcatgtagagtctgtaccacacaattttacatttacatgctgctttgtattatttattttggtttgcgtgcatgtgtgtatgttaaattatcatgtcatctatttcttatatctcttccagtgcctagcacacaggaaagatttgacacaggattaattggtttgttctttccatggaaggatgtataaataattaaacttcatttcttttttttttttttttttccaggagagaaaggccttgggaaaacaactgggaagaagttatgttataaaggttctacgttccatcgtgtggttaaaaactttatgattcagggtggggacttcagtgaaggtagagctaaaagttgtgttcctaataactccatctatcagtttttaaagtatttcattattacttttagttctaaatattgtgtcagttacagtatgatataaaatgtggtcagtgaatacttgttggatgagtgaatattataggtccagaatgtatgaaaaagcaaagtaccacgtaagacattttattttgtttttatgcagtttattttattaatattatagttacttagtgaattcctttacaatgaatgccaaagtactgtctgattgcttttgttctggaatgtttttggtgttattactgtttgaaataagtaggttgtgaagatgacttttttgatggtatttcttgtaatgggacttgacatatattttacagatgaagttaattgaggactctgagaattttgattattgcagcagttataacattccaaggtttccttcagcgaattgaagctatcaaaaatgatttctgtgttagtatatttttaatgttcattatggcttaaagtaggtgattatttgcaggtaatggaaaaggtggagaatcaatttatggtggatattttaaaggtaaggcttaatattttacggtcttttgtttcagttctgatattaaagcaagtttgatcatatacttttaatgagaagaggtttacttatagttcactttttgcatgaaactaatgctgcatgaaaatactttatttgcatgaatttggggataaattatattgtaatatataatttttaattgacaagattaattaaggctaactttatggttaaacatgactttcagcatggaggttaggcaactatatacatgaaaactcctatcttcctgcctaaaactgtcaacatattcttttgtttatagagaatgtggtcttttgcaaaatgaaaaggtaagagaacgaagctcagtaacacaaactccaattctgttcccttgcacccttcctaataaatttatggacagtctgggtcaggttgtggctggatttctatattgcttgaagacttggaaaattctgtgtattatttcatacatgcttctgtatcttttttcatttcccaatgggttattaatttcacatcagagaaaagagtctagttgtggggttttttttcccctaaaccaagcaatttctttgaataaaagttgaaatttcgtttttcaaaggtttgtatgttttcttttgtatattagaactatgactgtgtttattctcataatagtagcatctgcataaatctaactattgcacttgccccaaaaagccttagaaaagtcagttgcagagatttgtaatgaaatctaatattactaggttttaacgctataatagcttcagtgttataatagtcttttatatttcctttgggggaaaatggattactactctttttcagaagcctgttcccaaggtaatcactttttaaagttttctgtgtttctgtttgttctgaagaagatttgtttgtatgaatgttaaaaggacatataagttagttttcaaggatattcctgctggaattaaaataactctaagtgatctttatcacagatttttttttcctttgaactagtaggaaacagctatttagctggttctgttatgtagcaatttaaaactaatgctgtaggccactttgtggttgttccttgtggcagatacttttgtaccttaaaattgtattttgctatttaaatttttgtttcacagggctttcttccttagataattttgtgatacaattgagtatacacatacttaatttagatatgttcctgtaacttaatataacataatttttttgtcttacagtctagcttcaattaagttgaataataaatttaccgtataaaaattaaacacctaaaaagattattgaacttcttccatgtatagcacattaggcaagctaattggaaatttggaggaagtaagctagagatttttctaaaattttattagttttccctgaaagttaataatttaaatatcatttagccaaagtatgttactactaaaagtgactgttctaaggctgtttgtgtgaagtattaaatatatgttcttttcctcaaggctttaattagtatcttttggcctttttatgcttttgttatttgattagcttaaatttttcttttctgagtgttcagtcaagttatctgtactgaccagaagaggaatttcatcttttgctttctatttattacttgaacattactttaaagtgacttataattggagactgacaaatttgtgttttcttcaaacagatgaaaactttattctcaaacatgacagagcgttccttttatcaatggcaaatcgagggaaacataccaatggttcccagtttttcatgtgagtaggcataattcagagatgagcttttcttaaacagagaagcgctgttcataagaaagatggtatagttaaaccaagtttaatgctaaaattctgtcagctttatttttattattaatttctaatatcatagtaacttataaggtctaacaactgcctcagcattcagcatatatcctgaattggaagaatgggacttaaaaaatttaaaacttatacattgttttcaaaatatgccgtcatcttcagaaaagatgacggcatatttaagcccctgtcaaattcgagtgctgactttaccaaaactagattggaacataaactattgatgaacatgtaaaaattgttcatagacgagtattcagttactgtaccccctcaacagggaaagcagtttgagtaaaccattgcatggttgttttttcctcttactgttgctctttgaggcaattttgagagaggtactattattttctgatgttgtatagagataggtgacctgctgttgagcgagcattttaaaaaactcattttatgaggtctccatgcataattgaaataacccaatgttgctgtcatttccaccaaaatttatgagattgtcactcaggaaacttaagaatactaaatttgcttttgaaaaagcaaatatatttacatggatgtgcattgcacaaccaaaaacttacctttttattatctgaaaattctaaataaatcctttggcatacttttagttatattcttatctaaggctgcttcaaaacctatttttatcataattctatcatataaaatgtgaaagataactgtccagcatgagggttattgcttttgattggaagtgaatctcagttgtcctatgtatgttggagaaatatttcattaataatttattgaaaacattttctttgtcatctttctgaatgaaagagtatgaatggcgcttccctgtctttaaaggagtatattactgacatacaaaactcaaatgttaaatttgtctgaaaaatatatttctacatgatctgataaagttcagataaggggcattctgttcctaagaatgtcctaaaaatggaaagctgataaaagattatgcttagaattatacaggtaaaagacctacaacagttgttctcttgttttgatcccataggttatttgttattactcttctttaacagagtgattttctattcttaaccttcttaagagccaatacagagtagaaagaaatattttcagaaagcctttttaatagtaacttaatgtaaaaattgtttatcctttggttgaggtttcccatttccatttttaagcttatctgaactgtgaacatgaaaaacgtaatgattcattggtcaagaagctaccatttgagggctctaaagtttcttttagatttccttttttatatcagtacaattaaaatttgatttatcaagtagcagcagcttcttgatattgttacatacattagcttgttcataaaatgttagagttaaaactcattaaaaatgctatcgttaaacataaactaattaaaattcagtatacgagattctcccttcaaaaacatcttatttttattttatttagtacttgcttcagtgttttctaggaatatctagtaaaggcctttactgttttccacatggcctaattttatattggactacaatttttgagaaggaatgccaaatacaaaattttgaatcaataaattacaattataatttttatacttattttcaaagttaatttactttagatggcagtaaaatcactgaacttctgattgaaagaaaattttttagtttgaaatttccttctggaaaggggtttgcagtccctttggaaaggagtaagcaatcctggaagtaattgagtatttaatcctcctatattttttctgaagatttttgtgtcagtatactttctttatgctggctagaaagatcagttctcaagagttgcaggataaaatcaaattaactttcatgtttcagaactaaaacatatccttgcatttatgggaaggataggtaaaaatggagatggtggctgataaaataaaaatctttgaaactatgtttttacaagcccaaagccttttggagttgaaagtattaaaaaaaagtatgatatgctatcttcaggttatgtatatgatcacagataatagctctgatggtcacagagcttgctgatggcttccaaaggatggctcctgccttttaccttgttaccacagctcctcatagggcactttgagtggcagttctggaatctgaaaaagaaaggatagtgtaagaatggtggtaaaataaaaagaactgtctttatagttcctgctttataggctcaataaggatttttaatacatccttgcaaaattgtttttgtagtttttgttacaaatctgttactttgcaattcctaaggagtagatttggtgctgttagtatgggtatttgcaagacatccctcaaggattcttatgttttgtgcattaactactgtcttcattacttacacatctaaaaactcccccttccttaggcatatgtcatttttattcaacataattttgcatatattgctttctttggctggaacaattatatacatgatgaaaatcagattttcttctataaatctatttgtaatttttacagtaactttatttctagtactgtatttgtcataatgattttgctctcgggggtctatatagaagaaaacttgattctttttggaatagtactgctcaagaaatgtggaagaagtgatatatggcactatacccatgaatcactaaagaaacagtggttttattttgaacatttttgaagaaattcaaagatttgggactaaagttaccaagttaatttggtatttattttgtcctttgtattcttattttttaggttaaagaataggaagaaaccacaataaaagctggaattataaagtcatagagtggaaagggatttagagattatctagtccaaccttttcattctgtagattatgctaaattcttgaaaagtcatgtaaagtccaggttatagaaattttatttacaatctggaagaaactgatagctagaaaaagaatgctgcatacttattcatattattaatgcctttactataaatttaagcttatttaagctcaaaattttattaaccactctgctctgaatttattttagttaaggattagaagcatcaaacattttgctggaaaacaaaatgacatttggggaaacattctttccccttttgctgttactgatagcttattaattctggctgtaatttttttgtctttatatacattaatcaaaaagacaaagatgttgtataaaatagtcatgaaaaagattgagtaaatagtttatagctttgtagtaacttctgggataggacactaatatagctgtcaggaaaccttgattttagtttcctatgtaccttcagttcgtttttcttaaacattggtataaaaatatggatgtaaaaggaagaaggtattttgtagggtagttgtaagttcctgaatgtgtggaatgatttatgtgcaaacattgtcttgcctaatggaaatagtcataattgcctagttttcattagtctgaaaaatgtcttaaagaagtattgggctcatcttaaatcaagagcaacagaagtctcttcatcagctgctgttagaacatgagtctgcgcagccatagagtagggatctgcagaccctgcaagaacagttcctgtcactggccactgtcagtggtcattaataattataacaatgtaagaaaacaagataatatagaagagtcaaactttgaactttaaacaaaacatgtttgctacattttaacagtcataaatagggcaatgggggggcggggcataagttttagaatatgttttatgtcatttaagaatctgacttgcaagtacctgaatgggagagaagtgctgattattacaaagtagtggagcaaggagagttgaggagtagttggttttaaggggtttgtaaagctgtgttgatgttttgggtaataaaactagattcggggtagaaatgctttttctacccacgtattcataaatttatgtaagaagaaatgctagtaagtgttaataacctgagaagctctagctttttccttcctttttttggggtaataccttcatatgttaatttcagattttttcatgagcaaagatgttcgtgaaacttagccataaaccatattctctgaatatcaagtgtcatccctaacattcaggcttaataacttaatgtttatgtgacttacgtgctagcaatgtggaagaaattttttatctagtaatgtttggtgtgtattatcttaacattagtgctgaattttagaaagcacttctattttggtgacttttggaacacatgggtagagcattgtcaagtggcttggttagtttccattacccttatacaagtgttgtcattctgtacaatttggtgcctcttccctgacagtgtgatagtttcaggagttgaagggaaagcattgcatgttaaaagctaaagtggacagaagttatctttatttccctcttctgtactactttacacctacagtcacttattttttttttttgcaacattcattgaaaactccacattatttcaaacattatgttcttttttgacttattcatgttgtcaatgcctttatgataattttaagcttatttttaaatatttcaagatttattacattcaaaactcttataaagcattttgttcatggtataatagtattttgatctgagtagtaatagatttatttgtttaaatatagataaaaattggtcagtgtgtgttctccaaaaaaaaatcttgataatggggaaaatcagagattagacaggaaaagaagatattgtggctaagatttgactgcacttacgctttcatctctcttgcctttttattctctgagaaggtccctaaaattgtagttaatgctgctttattattatgttcagtgacttaacttcaatgtgtatctaatatcactgaacagtaactagggtccgaacatttgctcattaactcctgaaagtagtctgttgtgatacgtcaccaaacaaaggtttcaaatgtagaagcatgaaaggttctttaattatttgatgtgaattagttaaaagttccttgaaattttattttggatgatcttaactcacttttttctaatgaaatttttgctttcaactggtagtaactggtcctgggcattcagatttttatatttatgtatgtatgcaagatacactattctcttttgagaaaatgttgtcttagctaatttctgggatttgtgaaaggaaatgtaatatgttaatagctattattggcactctatgttacaatattaaggatctaaatagattcccacttagccacgatgcttttcttaagcataattcatctctacgtaaatatcccatatgaaagaaaatttagagccctccatttaaaaaagctttcttgctctgcataaaacttgaaaataattaatttcaaagttatattgatattaaaacatagattcagtcttgtcttaaaagtgtattacaatttatttcttgccatttttgtgtaaaatttacagaaagagtgttacaccgtgcgctccaaaggtaatgtctcattactctaaggctctctctctctttgcctttatctctttaattctgttgttatgtgcattgaaacattttaagaaaaaaaaaaactttctgctttatctgtatagcagcagtacatgtaaaacaagtgcattttatttttcatggttaatcctgggaactatattttaacttcagtggcttgtttccaccaagttcctgtacatcttctggtgggggagtggggttattagtttatagtatggttttagttctcatttcagtgtggaattagtcatttctgtataagggcaaaaggttctctgataatggtataaaactatagattgtttttggagtagcagtgacacttgtcaatttctaagatttataaggcttaaataccttgcacacatgttttttaaagtagattcaggggtcgggaaaactgaaaaatcactgtctttaagtacaagagaaaaatggaaatgcataaatattgaaaggttttacaatttgaaatgttctttgtggttttttcttttttaggtatgttttcataagcatatataaatttaaacatttttgatagcctctggccttaacttactgagcatgtgtcaccattgcacagctctttaaacagccgcttttaagatcaatgcaatttttcttttaattgaagattttgaaagattaagagttagtgagatgagctctctgcctcttttagtagaattgaatagtctggattgtggatattatttctctccgcccttttgtaaccctctttggctaatgtcctctgttcatccacgtattagccaagtgccagtaaccctgctttacattgggatttctactcctggaatgtaggttgagaaccccagagggcttctttttgttaaatacttttagtattcttaatatgtaatctaatccaattaaagtgcagacttatatttctgtatcttgagttgcagatgcaagtaatggactttaatcattcatatcaggtttaggcactatgggcaggctgagttgtccttgaaatagtcattcgtgtcttcatttgttttctgcactactgctataaaggaccaagtttgcctattcttggcagttttcatttgaattaaaaactaaacttgaatgtcataaagatagctattccatcctcaaattgagtctcaagtagtatgttgctgcatcgctacactactctggaatgttttattccaccattttctccaaaggtttgccataaagtggtttttacagcctttctatcagccaagatggcaaattgaattgggctctttatgttttaagaaaaatttgcaggctttccccaatactgcaggatctgtgagtcatgggaggaacggatcaaagaaggagaaggaatgtatctaatcaggaaaccatacatcgtttttacttctaaatatttggggctgatcccttacactgtagaaaaatttacttttttaaaagcccttttggctgggtgtggtggctcatgcctataatcccagcactttgagaggctgaggcaggtggatcacctgaggtcaggagtttgagaccagcttggccaacatggtgaaaccccgtctctactaaaattacagaaattagatgggcctggtggcgcatgcctataatcccagctactcaggaggctgaggcaggagaatcacttgaatccgggaggcagaggttgcattgagccgagatcgtgccatcgcactctagcctgggcaacagagtgagactccatctcaaaataaacaaacaaataaaaataaaagcactctttacatctttcatataatagagtcactagcttctgtaccaatttcttgtctttagtgtactttggtaaagttttataattaaagcacatttctatcttgaagttaccatccaaggtggtttctggatgctagtttaatgatttaaacactagtggctcactaattcactagatagtttttgttctgttttctttttgctgcctgtttttatttttataattacattggcatgaatttccacttttcaatcttctaaggaatatttgagatttttgcttttaaaacttaatatttcctttaaaattctggaacttcttaagttgacattttaatttttttaaattaaattctgtagtgctcttacagaaccgaatattcttaatgtaagtataagcattacaaatccttgtagaataaatatttttagcattgttacgaaggttaaaaactgggttttgttcacttacatgtcttaaaattgccttaaaatgaatacagaaatttatatggcagcttctagtacagttgactgctttaacatggcctgacatctagtgatatttttctctctttcaaatttctgttttctagctcttaaatatctgtttctcattcttataaatcaagatgcttgtagtatataattctgagactaattatctgcttttgaattttttccactgcaattcatataatgtgaagatctgtgaaaatgctatgggaaaactagcttgggttcaaaatatcttaaccaaatataccctgtaggcttcccaagagtgactgtctgacagttggtgactgtagaagaagctggttgggtgttttctgggccaaggaaatttaaaatgtctgcaatgttatccatcattactttttgctgtcagaagggatggcagattgaagcttttctccctatcgcattttcagagttgccgtgtcagagcttcaccttgggtgaaggaagatgggcaggaattctggaaacagaactcctgagacctacctctgcctgcctaaaaatgtggactgactcagtatgagaaataacaagaaaacatttaagtgtttggggcaaatgttaatcactttctttccatagggcaaataggaggtgcttttcttatttaattacgctgataaattttgagggtttttttttttaagtgttttgttttgttgttttggagttgagagtaactttaatttttatgtgtattcatgctgtgtatttatggctacaagtcaaactgatttcatatgtatgcatacatatagtctaatagagatgattgtaattcattataatcttgagttttttaaattagtaagatggctactattgctgttttggggtttttaaggttagatatatatcatgtttaactttttcccctatctttttatctttacttctttgttctctacatgctgtgtttaaacctttctgctctcttcacctgaacacatcgtgtttgacatcatctttgtgttgatgtttattacatagtaccacaaagcctgctccacacctggatgggtaagagttacattcttactacattggggaagtgtttgggtggccagccataaagagagattggaccatggttgagccctcaagggagcgctcttgatgtctggcttaatctcatagcaaaagctattccttaggatcacagaatatacttgttttgagaccccatggctctcatgtgactgaaggagtcaatctgtgctcatggatgggcttctcagcaatataattctttttattttttatttttctcttcagttttccaaaatgggtcggatagtaagcagtacaatatcatgtgtccctgtaaggaaggttcccaagtaccaagcgaaatctgaatgttaccagactctttaccctaaaatggttaagaaccattgttttaaaggcagaaaactgaggcccagtttgcataatcgtttccttttatgaagcagatttcaagttctcattccattctagttgcttcatacaacaaacagtttggttttattttcaggtctgtggacatgtcattgattacagttaattgtcttgattactgtttatagcttaattatcaaaccagttgtttcttgaatttgtattatgacagggtgcatgtagtctttggactggttatttctggttttgaagtaatcgaacaaattgaaaatctgaagaccgatgctgcaagcagaccatatgcagatgtgcgagttattgactgtggagtacttgccacaaaatcaataaaagatggtaagaacttttttgacagtagatgaagctaagatgcaggtaaagcattgctgaagactgtaactagatttgattagtggaactagtggtatagcaatagcccttggtgcccctgaatcataccctacatgtttaatcttttagcatatcttgtcagatcttactttttcttatttccttgccaccagccttatccacaccaccagtattttgtgtctggattattgccgtagcgtcgtaactgtttaccttgcctccgttctataatcttttgtcagcagcaatagcctcctaactggtctcattgcttatatcctaggcccgctgtggtctgtccttaacagcaaccagagtgatccctttgaaccatagtttgcattcatgtcacgcctgcacagaaccctccaaggactcccatcttcaatcatccaaagcagaagtctttatggtggtctctaaggccctggctggtctggctctctgctgtctctctaaactcttttcccttattcattgccttccaggcacattgaccttttttcagacatgccaaccactcagggattttgtgctgcctattctctttgtctggaacaccctttgttaagatatctgcatgacactgtcccttgctcttaagtctctgttcaaatgttatgttaaactacccctagtcttcctattccctttacactgctttgtttttctgtcttagcacttaatcatttgtcatattatgcaattctttttttttttttttttttttttttgagacaagagtcttgctctgtcacccaggctggagtgcagtggcactatctcggctcactgcaacctctgcctcctgggttcaggtgattctcctgcctcagcctctggagtagctgggattatagggatgcaccaccatgcctggctaatttttgttatttttagtagagacatggtttcaccatgttggccaggctggtcttgtactcctgacctcaagtgatttgctcaccttggcctcccacagtgttaggattacagatatgagtcactgcaccgggcctatttcttgttacttgacccaacaagaatataggcttcataaagacaagggacttactaccttacaatcttgccagtaattttattataaacttgaaaaaaactgtctacatttcattttttgtttgctgtatgtaaagcatattttatgatattcagtaatcacattttttactctgaaaggtaggcactgaatttagtactaatgtttttattaatgtttcttaaaagtttttgagaaaaaaaggaagaaaccaactcattcagaaggctcggattcctcttccaattcctcctcttcttcagaatcatcttcagaaagtgaacttgaacatgagagaagcagaaggaggaaacataagaggaggccaaaagttaaacgttctaaaaagaggcgaaaggaagcaagcagttcagaagagccaaggaataaacatgcaatgaacccaaaagggtacgtgtaaaacaccaatgtactcttacctaaaaacaaacactctggaatgggaaaagtatgtataattctataaactcaattttattacctgttattgaaaaaggatagcactttttaaactttaaattgaaatctggcaaatctaggagtaggtagcataggcatttcatttcaaagatttgtgtgttttcagttttcgggtgaaaatagtcctaagaactctttttttaagagatagggtcttgctctgttatccaggctggaatacagtggcacaattatagctcactgcatcctccacctcctgggctcaagagatctttctgcatcagcctcctgagtagctaggactacgggcgtataccactatgcttggctaatttttaaattttttgtagagacagggtcttccgctatgttgaccaggctggtctctgactcctgtcctcaagcaatcctcccacctaagacccctaaagtactgggattacaggtgtgagccacaatgcctggcctcctggaactcttaaaataaaaaagttaggatcatttaacaattttcctatcaaaattctagtctttgggtttttcactgggttgatattgttctctttgtgaaaatcatataactcttttgagtgagacttgtaagctatcgttaattatgctgttgttttagtaactaattttatgtgcttttattatgaaatgcaaacattatacattttaatcagtgacttggtttgttctaagtcactctgagaggagtgataccaatgaaaaaaggtcagttgattccagtgctaaaagggaaaaacctgtggtccgcccagaagagattcctccagtgcctgagaaccgatttttactgagaagagatatgcctgttgttactgcagaacctgaaccgtaagtaggatgactaaactatttatttttatttctccgataacactgttccgtcagctcattgcattccacactcatgtatggaacatgatccatgtttgaagcacattgaaagatagtatgggagtattagattaatgaatgatacgtaggaaatatgggggataccagattattgagtgatatgtaccctacctttcagaattcacattctagcagggagaggaggttgggcaagttggtcagggaagcccttattggggatctggaaagattttattcctgatcttcttgcctttgccttttattagaggggtgaggttttagttatcagaatagagagttagttgaattctttggatccatttgagtgatgaagcatgggttccaatttgaatagtgcataattaattgcatgatgattggagatacaatttagtatcataaataagttacttttgttaacttgttcaacaattacttcctgcattggaaaagtgaatgtgtcgctttagatttggtctgagaaaatagtatttaatgtattttgtgtgttagactcaagtttagaattattgaaagaaaatgtttcatgaacagaaatatcataatggctggtgttattgataagttccctatgaagagttattttgaaagctgaaaagtataagagtccttatttataattagctctctgcataaagttatcatttagttcattaaatattttttaaagcctgatattgtcttgttttaaaaagctattgcaaaatggcatgtatctttgaattaatagcttaacataatgtgttttcattattaaaaattctagcttctttgcttatttttaattttcatcacaatcttcttttcctaggaagattcctgatgttgcacccattgtaagtgatcagaaaccatctgtatcaaagtctggacggaagattaaaggaaggggcacaattgtatgtgtgataagactttttttgatattatgtatctaataaaaaatttttacctattttcaaagtcctagcgttaattttagatataatacaaaatctgttcaaggaactaattgtattttccatggttatgggaaggtattgctgttagatcaaagtatactgctgtgtttgaatgggtttaattgagtatgaaaggaggaacatgtgaaaccatcagtgagtatgctgagaaatcattaagactttaaaaaggaaaattttatgtggattacaggtgaatctcagccttgcccatctcttttaatgccttgtttgaaataacttcacctgaacctaaaataaaagttaaaaactaaaaaaaaaaaaaaaaagaactttagaccatccttttggtaacttcaatcattacctttgatgggatgatctgagattgggtcttttacttaactctgtcacatagcagactgtcgtggagaggcattttttaaaatactattgtttttgtttttaaagcgctatcacacacctccaagatcaagatcctgttctgagtcagatgatgatgacagcagtgaaactcctcctcactggaaagaggaaatgcagagattaagagcatatagaccacctagtggagaaaaatggagtaaaggagataagtaagaactttgagtataagcacaatcctgtgtctgttatattttaaatgttaaagggattggatacaattctggacttttcattaaagattcagtgaaagattcacagtcagactgtgaccaaaggaaatacatttgggactacttgatgaaagtagtactgttaactagttgggcttttaaatcaaaatcctgttttccttaacaaaaactataagcctgtgtcttttaatgacctcttagtcaattttagaaataattaggacttagaggccgggcgtggtggctcacacttgtcatcccagcactttgggaggccgaggcaggcggatcacgaggtcaggagattgggaccacagtgaaaccccatctctactaaaaatacaaaaaattagccgggcgtggtggcgggtgcctgtagtcccagctacttagagaggctgaggcaggagaatggtgtgaacccgggaggtggagcttgcagtgagctgagatcgtgccactgcactccagcctgggtgacagagcgagactccgtctcaaaaaaaaaaaaaaataattaggacttagaaattatatagcagattctttcctagccagccaggtcactgatgagttcattggtaaataggaaaacctgcactcggtgttcatgttgactgttgatcgcagagacttgcttttttagaagtgtacacatctcttaccttcagtgatgtcccacagttgaatatttattttaggaaggggataggccccagaatagctagtgaaaaatatactaatgggaccctgtgtaatcttccatggtagtattctctttttctctggggacatcctgcagagtggtttggaattgtgaaaaggaggaaaaggaatgcatctgctgtgtagaagcggctcagacacagtggtgctgaggactttcagttctgagccttgacattaacactcagattgtaacctgtatctgtttttgtgtactttttcctcaatttctgttttaagtagtttacagtcttaggggaaatctggattacctgtctgaggtggagaaaaaacaagcttcatgctagtttcaagcagctatcctgcatcttcagaaaatcaacaaattgtttgagaccttggtttgactcaccctcaaaaactgtcctagaggcagagggttgtgagcagataacagccaggaactcttgtgatttgagttcagcagtgttcttgtgattagttggtttgcttttcaaaaacattttcctaacaaatgtaaggttctttgcttagcttaaaaaaaaaatccttttgtaagtgaatttgttagtagttcttagtgtgtgtctctgaaagtataacaagaccaggcctataactctgattcacgcttcctgcgtgtgcttaaagtgttaatggggtcaagaactttgttgttaacaaagctgtgtcttaaggtgtagaaaacatgcttataaatcaccgcatgaatattatgtcctttctataggttaagtgacccctgttcaagccgatgggatgaaagaagcttgtctcagagatccagatcatggtcctataatggatattattcagaccttagtacagcaagacactctggccaccataaaaaacgcagaaaagaaaaaaaggttaagcataaaaagaaagggaaaaagcagaaacactgcagaagacacaaacaaacaaagaagagaaggattcttataccgtctgacatagaatcctcaaaatcttccactcgaagaatgaaatcctcttgtgatagagaaaggagttctcgttcttcctcattgtcatctcatcactcatcaaagagagactggtctaaatctgataaggatgtccagagctctttaacccattccagcagagactcatacagatcaaaatctcactcacagtcttattctagaggaagctcaagatcaaggactgcgtcaaagtcctcatcacattctcgaagtagatcaaagtccagatctagttccaagtctgggcaccgaaagagagcatcaaaatcaccaagaaaaacagcttctcagttaagtgaaaataaaccagttaaaacagaacctttaagagcaaccatggcacaaaatgaaaatgtagtagtacaaccagttgtagcagaaaatattcctgtaataccactgagtgacagtccccccccttcaagatggaagcctggacagaaaccttggaagccctcttatgagcgaattcaggaaatgaaagctaaaacaacccatttgctacccatccaaagcacttacagtttagcaaatattaaagagactggtagctcatcatcctaccataaaagagaaaaaaattcggaaagtgatcagagcacttattcaaaatacagtgatagaagttcagaaagctcaccaaggtcaaggagcagatcttctaggagtagatcttattccagatcatatacaagatcacgtagtctagctagttcacattcaaggtctaggtctccatcatctagatctcattcacgaaataaatacagtgatcattcacagtgtagtagatcatcttcatatacttctattagcagtgatgatggaaggcgagctaagaggagacttagatccagtgggaaaaaaaatagcgtttcacataaaaagcatagcagcagctctgaaaagacacttcacagtaaatatgtcaaaggtagagacaggtcttcatgtgtgagaaagtatagcgagagcagatcatctttagattattcttcagacagtgagcagtcaagtgttcaggccacacagtcagcccaggaaaaagagaagcagggccaaatggaaagaacacataataaacaagaaaaaaacagaggtgaagaaaaatccaagtctgaacgggaatgccctcattcaaaaaaaagaactttgaaagagaatctttctgatcaccttagaaatggcagtaagcccaaaaggaagaattatgctggtagtaaatgggactctgagtcaaattcagaacgagatgtcactaaaaacagtaaaaatgactcccatccatcctctgacaaggaagaaggtgaggccacatccgattctgaatcagaggttagtgaaattcacatcaaagtcaaacccacaaccaagtcgtccacaaatacttcactgcctgatgataatggtgcttggaaatcaagcaaacagcgcacatcaacttctgactctgaggggtcctgttccaattcggaaaacaataggggaaagccacaaaagcacaaacatgggtcaaaggaaaatcttaaaagagaacacaccaaaaaagtgaaagagaaattgaaagggaaaaaagacaaaaagcataaggctccaaaacgaaagcaagcatttcactggcagcctccactagaatttggtgaagaggaggaggaggagattgatgacaagcaagttactcaggaatcaaaagagaaaaaagtttctgaaaacaatgaaaccataaaagataatattctaaaaactgagaaatccagtgaagaggacctttcaggtaaacatgatacagtgactgtttcatcagatcttgatcagtttactaaagatgatagtaaactcagtatttctcccacagctttaaatactgaggaaaatgtggcctgtttacaaaacattcagcacgttgaagaaagtgttcccaatggagtggaagatgtgcttcaaacagatgacaacatggagatctgcactcctgataggagttccccagcaaaagtagaggagacttcccctctaggaaatgcacggcttgataccccagatataaacattgttttgaagcaggatatggcaacggaacatcctcaagcagaggtagtaaaacaggaaagcagcatgtccgaaagtaaagtgttgggtgaagtggggaaacaggacagcagctctgctagcttggctagtgctggagaaagtaccgggaagaaggaggtggctgagaagagccagatcaacctcattgataagaaatggaagcccctgcaaggtgtggggaacctggcagcacctaatgctgccacatccagtgctgtggaagttaaggtgttgaccactgtgcctgaaatgaaaccacaaggcttgagaatagaaattaaaagcaaaaataaagttcggcctgggtctctctttgatgaagtaagaaagacagcacgcttaaaccgtagaccaagaaatcaggagagttcaagtgatgagcagacgcctagtcgggatgatgatagccagtccaggagtccaagtagatctcgaagtaaatctgaaaccaaatcaagacacagaacaaggtctgtctcctatagtcactcaagaagtcgatcgagaagttccacatcatcttatcggtgagcaatattctctttcctttcttctcccaaggagagtctgttattgtttagcttggaagaatatcagaattagggacagaatcactatttccaaatatctgaaaggaataagaagtcttgttttgtgtgattcagagagtagattgaaaacttagggagagggaatttcaggaggagaaatttgggctgggtttacaaaactctattactatcagtttaaagctctctgtcactagaaatgagttcccatgataggtggtaaattctccatctttaaaggtgtgaggctgcttcttgccagtcaagtgatgccttagaagggaatcctgaattgacagaatatatagaatttgcagatcattaatctaaccttccattttacacatgtggaagttgagggccagagagacaaagttacctgcccaagacatgcatcttagtttagatggggcatagggataaaaatgatcatctttagatttttgttgttgtttgaaaagcaataaaagaatttaaaacacctttttctcatctttgtcactctgcaccttcatgaaaaggttttttgttattgttataaattgcatcataacttgtcagcatagaatggataacagagatgagaattaaaaactaaaaatatttgtgatggtaataggaagttagtaagcagttgtgttgcattctttttcttgtaaatattttatggttttacctgtttcttaattattcatatcccttattttattgtgcttgatattcatcatttgaactgaaaataccataagaatctttgacgtttgtttcctttctagttattcatcagtctttcttcccttgcctacccagacttcctaaaaaaggaaccgccacgtgccatctatactcggtctcccattttctcctcggctgtgtgcttgctgccttctgtgccttcccctccccgcatctcttagtttactgactaagactttcaggtacttctgatggccagtaccatggcgtattttcagcctcacttctggagccctctgctagctctcctttctcccactcaggccatttcgtccctgtgttctaggcttctcttcttcctcatggccttttctctctgagttcctgttgatagatgcagttgcctattgagcgactccagcttcctgtctgcttatgatctgccttaaccatttacacagagacagctctgagctattcgtgatgctggccactcttctcatttaccttcccacctctgccttggagtgggtggtatttcagtttgtaatgaagacagcaaggcgtagaaaggctaagggacttgttctaggctatgcagctaacaggtagtagactgagatggataagcctgggtgctgccctgcctccctgttttggttacctgcctgggcctgacacccccattaggctgtgaactccttgaagtcaggaactgtgtgttactcatcgttcagtcacctcacagggtctggctttattatttttggttgaataaatgactacaatcttattagaacataacgtattcattttcttgcagatatactggaagcaggtcatgtcttccaaaacatagtgcatactgaataaaacctatggtgatattacataatgtcacctgtacacagaggtattgttctgttcctgaatgacaggcctaaagtaggggagaagggtggggagccaagtgaatgcagaggggcagaattgtactgcttacatttttgcttgttttattaagtattagacataaaaaatgataaaagtataaaaagctatataatacatactcatgtacctgccatctagcttaaaaaatagatctttgggccgggtgtggtggctcacgcctgtaatcccagtactttgggaggccgaggtgggcagatcacaaggtcaggagttcaacaccagcctaaccaacatggtgaaaccctgtctctactaaaaatacaaaaattagccgggcgtggtagtgcgtgtctgtaatcccagctactcaggaggctgaggcaggagaattgcttgaacctgggaagcagaggttgcagtgagccaagatcgcgccactgcactccagcctgggcgacagagcaagactcctcaaaaaaaaaaaaaaaatagagctttgatgtaccagtgccacccctaggtgcatgcctatgtcccaaagttaaccattattctaaactttggttataattttgttgtctttctttatagctttaccccaagtgtttctatctttatacaatgttatgtttgcactttttattaagtaaaatacttttatatatatagatgttctacatttgccttcttcattcaacattgtgttctagagatatatccttgctgaaacatgtagctgtagttcattttcttcagaatatttcgttatatatctctaccttaatgtttttttaacccattctaccattagtggagatttggtttattttcttctcagtgttattggtgttataaatcaggcttctatgaacatacttgtgccaatcttttcttgtttttctttattttcttctgtttgattttaaccatggttgttttgagagttcctcattagctgacactgtcatatccactgtgaggagtttgtgagaggcctttcttcttgttgtgttttcccctttctgccctaccagtaattaattttaatatcatgatgagtcaacataattatatattttttcaattgctttaattgtagatcaagaagctactctagaagtcggagcagaggatggtacagcagaggccgaaccagaagccggagcagttcctaccggagttacaaaagtcacaggtgagcttgtgatctcaccctgtgatgtggtctccatcatgtccactttttaaggctacataggcagagggggtagttgttgagaagaatcatgtcattactgaatatactactggcctattttctcatgtagttttttctatgtaagagctgtggaattcttgactattcctctgttgggatcttatcagagtgaggcaagaggagcagtagaaatatttaagaagccttgacccctacctccacctcccccacatgcatcttccttaacctaagttttacatctgcattcacctcttgacatgggttagagattgggataggaagattgtagagaggggaccaagaggaagaagtatatatatggtgggaagggtggccccagatttctagttctcctagcttctttccctcttttgcatctgaggtattttctactgctgtcacttcactttacttacaaaggtcctacctgtacagacctttcccctaactccacccagtttagagcctccctagtgactatatgcatctcagagaagaactgcataaaacttgatcttatgaaatccaataggctttttaaaaaatccaatatacttttgatatgaaaacaaaacaaatgtagctgtgggatttcactgtattttcaccttgatgggcaaataaatgtctagatatttggtatagcctgtcctgccctgatctataagatgatggtccttcatgtgattaatattaggacgtccagcaggagcagatccaggagcagctcatatgatccccacagtcgatccaggtatgaacagggattgggaaaccaccagtggggcagaactgaaagatcttgttttgtaaactgtttgttcaaagtggtattttattgagtaactaaatgcatatatttgtctcctgaaaccataccttttctaaatgaggtctgttcgacaagttttatctgttggcccattgtactccagtgtcaaaaatgacaatatcaaattgtaatggcaggtgtttattgaatataattgcctacagagatccaccaggttcaaactaactcgttaactttgtgatatttttcaatgcagaaaagaaattaacatttttctctttaattatggtaagtctcatttggggcaattgttaaatgtttccagtacttgttttggaaatatatcctcatgctgtcacctagtgcccatgttctaagctagaacactcctgagatcctaaaaagaaataggaacatatgagtatctgagtgggaaaatttagtgtttgttgttgccgttaaagcaggtcctacacctacgatagctactatagcaggagtcggagtcgaagtagaagccagagaagtgacagttaccaccgaggcagaagttataatcggcggtccaggtgggtctctctcctttatcgtcctttatcgcactgtaggccacggtgggcacttgatgtgggagggtgatgggctgctagtggaagagaaagtggtataatcttccaaggacagaaatacttcttcctttaaatctgaacaacccacaagcagccactaaaagtggcttttatattaagagttgccaggtaatatttgttggttattattaatgtttgaatctaaaatgggtttctaaatattcacatatcttggacagacctttcttttggaaagaaagaaggccacccaaaccatggccacttgcttaaatagaaccacttgctagcagtagccagtttctcattttttttaaataaaaaaatacataatataatttgcttcagcagcaggattgaggtttatatgttgtcaattatttagtaaaatacattttttatgtattatatgtattatgtttaacatattttggcttctgcaaaagtctttatgttaacttttgtactgtccttttctggtggcttctggtcttgccttcccctgtccattgcaactgcaatgatgcttgtaaatatcagtctgatctggatactcccttgcttgaaactcttcaaggactccctgctgctttcatgatcaggtccagcctcctcagcaccaactccagctcacactctttctggcttccctcctttaaagtgttgggacttttccttctgcctggagacacacgtgtcctcttcaccatctccccttttgccacttgaaatggccagttcccatctaccctgcagatctccactgtccctgggcagccctccctgatgcctaatcctaggatacagtccctcccatgtgcctctaagacagccctttgctcctactgtggctccccttgctcctaaattacttgtcttgctgactattctattctgtccttgaaccccagagaactatacttggttttgtgtctttgtgtgtgtgtgtgtgtgtgttcccagcatcttgcaaaatgcctggctcacagtgaatgtttttcaaaataactgaatgggacccatgaccaggtcctcttgactcaatatcccagtggtcctgttcatgcccagggccacccccacccctcattggaccccattttggtttccattccttgagtgaaactatttgtgcaccttttccccattacttttctcaggtaatctattcaaatattgatactcattttgggtaatatggggaaactattctgctcattggttttttgtttttgtggtcccagcatttgcatgaatgaatttcacacaaatttcctaagatgtgatgtttctttattttatcttaatcttgacattactacaacttgtcatttaaaacagcttcaaaaagtccatagtgtgagtcgggcacggtggctcacgcctgtaatcccagcactttgggaggctgaggcaggtggatcgtctgaggtcaggagttgaagaccagcctggccaacatagtgaaaccccgtctctactaaataaaaaaaattagctgggcgtggtggcgggcacctgtaattgcagctactagggaggctgaggcaggagaatcacttgaacccgggaggtggaggttgcagtgagttgagagcatgccgttgcactccaacctgggcaaaaagagtgaaactccatctcaaaaagaaaaagaaaagtccatggtgttgccatagtcagtaccctacctctgtgttatgctgcatcaatagtgcatcagttatatgagtggcttgaaaacactattgatgttttcaagccactcatataaaaaacaagctataagaggaattcaaagattttacagttacaagatttttatatattttgttttgttattacaggagttgtagatcttatggctctgacagtgaaagtgaccgaagttactctcatcaccggagccccagtgagagcagcagatacagttgaaaacgtccggatacaaattatatcttatttgtaaatatctggcaacttagcttaagaaatgtaatgacagtctgttgttctatttcaatatcagaggtgaatttcaaaaatagacacttcttaattgttactggttcatttacatgtggggagaagaatttaaaatacagatatgtctcctaaaaatatttttatgccacattttacagtagccaactatggaaatgaatttcattttcttgaatcaagaaatcgtgaaatttatctatgtataatttgcaatattattttaagtctatttcactctatcttacgtatcccttagaatacagattctttttgcctgtttttccagttttagcatatatgctgccaagcatagaactgtgaaggagaactgttaaaggcggccaaatatttatatactgattacatagagtcttgtacatatgtgctctaaaaacaaaccacccagaattgatactgttggtaaccaggagtataaggcagtggctctggggttcttaattcattcctaacttctttgatacttcacaggattaggaaagtggtcatcatacatcccacacagtctgtattacttcaggcttgtgggcaaggttaggaagaatcaatcagccttaactataaatacctgcactgtctctgaggacttactattttatgttctttttaatcaataccgatcagaagtttaggttataaaaacaattctacttcatgctttggtgcttggtaatttttggtgcgtctttaagcattactcttatatatcatatattaaaataccataaaaatgaaattcagacaaaatcactggcaccaaaaatggtttattctgagctgtcttcactttgactatttggggggcttctctcaagtacagatgtgggttggggtcccctggagcaggcaggattggcagtaagagatattggccactcaagtctactgtgtgtgtgtgcctctggaagagtgaagaatggacttcaaaagtaacatcaaaaatctaactgccaccatcctggagacattttgcagggctttcctttcaagtctttcaagtacaggatattaccacaacagcagctgaactgttgtaaccagcatgtttttcctatttccactgtgacctgcagctgactcaaagccttgcgtgacctgacccaggtgcaagagacaggggaagagggatagagggtatagcataaattacatattttcatggctttgggtggttcctccaaaaataattggacctgtaaaaactagtgtgtgtgtgtgtgtgtgtgtgtgtgtgtgtgtggttttttttttttaatctttactttgaatttgttccccaagtgtacttaatcaccttagtgccagtttaatccagttatgcagaagaaattcatattggttgcctgatgtagagctcagcaccaccctaccacaggccttgtctggtgtatttgggaagtggaaaagagccctcagttggagggagctgacaacccttggtggagggagggtgcccttgaatgtattaaaactatcacccaaagaaggtatgaaaacagggtaaggtggtcagttgtttgccaggtcaatagacagaaagtacattagaaaacaggacttaggccaaacaaacaatactggatactgaatacaaaacagtatgatttatattaaaggtttccaaaggttgcctgcaaaggagaatattactactagtcagcaggaaaaaaatgcattcagaacccaagcagaaactgccaaatgtaattaggttaagaaaagttacccttgggcagtgtattagttttctattgctgtgtgacaaattaccccaaatttagcagtttaaaaaacaatacccatagcagttctgtagctcatgagtctggcacagtgtggctggattctctgctcagggtcttaaaggctgaaataagggttggcaggacaacattccttcatggaggctctggggaagaatctgcttctaagttcattcaggttgttggcggaattcagttctttgctggctctcagctggaggcccctctctcacctcaaggctgcctgcattccttcttatgtggtcccctccagcttcaaaccagccttcctgctctttctcatgcttcatatctctctcccgtcctcctgttttaggggcatatgattagctcaagcccacagatatattttaaggttgattgtgcgatagaacataattgcaggagtactgtctcatctcatcatattcacgggttctggagattagctcattgaaagggggaggggcattttcaaattctgcctaccacaggcaataactgcccatctcagctgtaggtggaatttttacccagaaaagataggccctagaagcctcatttcttttctccatggaaaaggacagccctctgctgcagcgttcaacttgtgtgtttactgacagagtgaactacagaaatagcttttcttcctaaaggggattgttctacattttgaagttattttttaataaaattgaattatgttgtgtattgtgcttcttaataggaaatgcattattggactgtttttgtaacatcctgtttattgcaaatagctagtatcgttcaaaaactgtataaaatacttttgtacatattagcaatgtctaatttgtatacacttcagttaaatttccctaaaacttgaaaggggaccttgtagaaattaaaatatatacttagtctaagtctgagtctgttcatgttttatctttctgctgacccagccagtgaagacacctcatatcctttggcagctccttttcttctcctagctgagtgttagtggtgggtgtaggaggtggagctagagagaatgtcaggcagagattttaacctacacaggtaagcattaatgatgtttggtcttcctcccctggaaaatccagatttcctctacactttgttgtcatctagttaaaatgacctgcataaagatgtctttgctgagggaggaatatgtcacatcccatgtgtgagtttctacctagagacagtccatttacctacagcctctacatttccctccctaacggcagcgcactaggcagtgcagcacatgtcactcactcccagagaaaacattcatggtgatatttttagtatacacataagaatttgcaggggaagtacaattaacttttgtctcctcagaactgaaaggaatgtctattttcttagtgaatacaacataacttattgtagttaacttctcactgcagatactcagtttttaaactgagttaacagtggactccttagttgggcaactcctgaaatttgtcaaatctggatgcattcctttaaaatgtaaagaaaatgcaggatcaagttctgatagtggtaaacttgatagttgggcagtattggggggaaaatgtgccaaggactttggtcttgactcttctgaattagctgggcattaaataggcgggaaggtaattcaaggaaaatgcccctcttgcaagagattatggacactaactgggcatcactgtttagaagagacgggaggtggccaggcatggtggctcacgcctgtaatcccagcactttgggaggccaaggcgggtggatcacttgaggtcaggagtttgagaccagcctggccaacatggtgaaatcccgtctccactggaaaaaaaaaaagaggctctactcagtttttcaaggcaaatgctgagccttgaaggagtgttgcaaactaatgtggtcaggtgaaaggatgtggaagccatgcctcacaaggtgaaacggactgggttcagatttccggagaactctggtttttggaacagagaatcaagtctgctgttccccacagtgaggcaagagcctgcaggcccatgagggccttgtggtagaatgagctgggaagacagcagggagaagttctttgatgcagtaaaggcccctcaggagtccagaggtgtcaggggaggacgctgggtaccctgaaagaacacctgttcatctcaggacagactgggaagcttgtcggggcctggtaagtgcaaggcaaggagagcctgccctggccacatacacacagggctaggaggctttagtggtctgttttctttcaaagtttcagtacaaggtagagatagtgctcccttgctgctgcctccactcctcactgtgaatcagaaggccccaggtaggcctgctgcctcttggagaccccagacccaccacttactatagcccatcaaactccagctccctagactgagctgagcttcacagcctgcagaacccaggctagcttggagagggttgcatctcttcagcccagagccttgaggacatcagggtaaaaggagtggccacctatatttctagtgctttaggaggcctaggcaggaggattgcttgaggccaagagttcaagaccagtctggacaacatagcaagactattaagacaaaaacagaacaaaaagcagctgggcatgctgatgcacacctgtagtcccagctactcag

SEQ ID NO: 668 - DNA, 47677 bp, Human
cggtgggcctcagggcccagttctgttctctggggacaatctctagtagattatctattgacctgaagacgcgcttcacctttgggcagatcctgcaagggtcagggagcaggcaacaagtgagcctgggtagaagtcagggctgtgctgtcctaacccttgacatttctgatcattgtattctatgtatggggtaagatcttcacaaagattagacactggatccaagggcagctttctcaacttaatatcatacaagattcaatgatgcttcagaatcaggctgccatgtggggcctgaggtagttttgcagataacatccctttcaaataggaaaacagattacattaataagcagagactgtcacagtcaagtatgtgaattacttggacctctgttcatttgcctctctccctctgcttctggtctgctcaccaggcagtgaaaagagactcttaggcccccgtgactctctcagagatatgctgatggagcaggaggaggaggaggagttggagtttttaatggctccagtgagatggaaaggagtaacctgaagtcatctgggccagcccagcgtctctgtaccaagttcaacctggtctcactcactgtcaagttggaaaggtgattttagtcagcccaaacagctggattccagctctgcagggggttggcagggccaggaagagcccttgtttcctttttcccacactgtgcactgttctagactacgataagccttggatgaaatgccgtttttactctcacatattcaaacgggcacatggcaaatttgagcttccctgtgttaacctttttgccctttcagcacaaaaacagagtgaggttttagggatccctgacttacatgtaagttcacatgcctacttagccaccagcctctggtagacacctacaggaccccagctcttatgaagctgactccaccaaaccacgctggcccacacggaccaaaccggcttccctccccactatcaaaaagcaaatcaactgcagtgcgctacaccacagaacctaaactttgcagggtgaggacgcccaaacttcccagagctgtggaactctacttacaaggtagccttctgagagatagatccaactgagtcgcatctctagcccacaccttgccagagcctcactggcgcactatttaacaggaaatggaattcattgtggcaggtctcacttagacccgcctcagagagttctgttatgaaagtagcagagacatctaatacagccaattcacccgtaacagccccagggagggcctcaaggccagcgttagagcccaacttcagtgcagctccttctcctcattaagacaatcccctgggccctggagtgcagggacctttgtcagcagctgatgcagacagcaaccactgagatggcaagcacacctttcacctgtagcagcttacactggaggtgagctccaaagtgcttccagggctgctcttaaagaaaaatgggaccacctgggtgcttccagcttctagttacactgcaccaatgtccaaggccaagccctctcaagagtacaacttatggtcaaagcagatatatggataaccagggaaaacaattggagagatgtgtctggaactcatgtgagtaacaatcaagttgacaggccccggtagtcacttcggagagctgagactctgtgaaggccatcatccctgcctggcttccaaggtaagtgtgtaggggaatatatatgtacacatatatatagtagtgaggctatatagacatagcaaagcagacacagaaaggaaagaaggactgggttgcattccagagtcaaagatatttttaaggtctcagttggaaaactaaaggactgaccaatcagcaccttcactgatcccatgacaaaaccacacaaacattcccttagggccagatcacgtgtatttgagagggaaagggagacaggcaaatggcatgacacacagggtttcctagctgggagagcctctagctgcttactgataaccttcacattctacttggccttcacagaaagttggctaaagctggtattacctgaggtacgtgggccatgtggggtgggttggtatacgccggctgaacgtgagaaggatggatcgtaaagacagtctgttgtgctgctgggaaactattctgtggcgactgcgtgttggaggcaggtgtcatggagggtggagttggcgcaagccccgcgtggtaaatggctgactgctgctgtggactggccagatggagagcctgggcggcctggtgctgatggtgctgcaaagcgacaggaaagaattgagaggaaaacttctttaatgaaaagcagccaagggatacccacaaagctaagctttgcacacttgggcctatgatgagggtcactggaaagtacaggagaatgtacagggtggtaagagcaaggctggaggtgcctcccatctggacaactcctttctagggtacagaagcctgattctcagtctggcagttagaaacttctgagcatacatactaaagtcaaaaaagactactgccccagggaactgatagatatcaaagacatctttaactgcctccattagcaaacataattcaagaagctcataggaaaataacctcatcacataaaccttagaaattaaaaagtcccaagcaaataggaatttgccttatgaactttatgttaaatttgatttttcattactgcaagtttccagagcttatccaatcaccttattatcaacatgtatcttaaatgtgattttttttaattttttatttttttgagacagagtctcgctgttgtccaagctggagtgcagtggcgcgatctctgctcactgcaagctccgcctcccgggttcacgccattctccttcctcagcctcccgagaagctgggactacaggcgcccaccaccacgcccggctaatttttttgtatttttattagagacggagtttcacagtgttcgccaggatggtctcaatctcctgacctcgtgatccacccgcctcggcctcccaaagtggtgggattacaggcgtgagccactgcgcccagcctttaaatgtgattcttaaaaccaccaccccaggggcacagctgtatccatcttcacgagggtggacatgccatgtgttctgacgatgcgatacctggcacctgaagaaagcactcagatactaggataaagaagccactccatgcagacctctgagttgcccttacctgaacaggactgggtgcaggatgacttccaccatgttggctttgctgctgtccagtgggggtagctgaaggctgagggtgtggagtatgtgggtgcagggtagcgttagggtgcgcatactgctgagcaagggagcccgtggaaactaaagtgaaagaaaaaggagcatgtacacaaccgatgtctgacaacctccatcgctcctctacacttcatcaactgaactttcttgatggttacaatgcataactcacgccactaccaatttctatagatgactccatttaaaccatccattgtcttgaaaaaataagtgtagctattgcttaacagactagcatttggttcatataatacagctctacatatgatattaaaatcaaattagtttgcatttactcttaacggtcactaggttttcccaaaaaggcaacttgaaggcataggcagaaactactcaaacaagtgcattttaggtgcacactctttagctcaaggccatcatcaggctaacctcaccatgctactgccctggagcaatgtcctgagggcacagactatattgggtgtggtgggggatgggggtgcgggcactgtgtatggtatgtggcaaggccagggatctatcatcagggccgaaggaccacagtctctctcagctaatcacaggagcccttctgccactcagtttactttcccaagccctaatggaggatctcccatctttgctttatgaaataaatatagaaaagtaaactcccttctgagtgccccagccctttggaaagaaatttactagactaacttcaaaggacaacatgatgggccagtttaaatcaaaataaagataagaactgaaagccagttctttgtgaatctcagcgtgggccaaaccttggtacaaaaaccatttcttcatgtctttcagttttttgttttttgtttttttttgagatataagtctcactcactctgttgcccaggctcactgcaacctctgcctcccaggttcaagcaattctcctgcctcagcctcccgagtagctgagattacaggcatgtgccaccacgcccagctaatttttgtatttttagtagagatggggtttcgccatgctggccaggctgatctcaaactcctgacctcaaatgatccgcccacttcagcctcccaaagtgctgggattacagacgtgagccaccgtgcctggcctgttcatgtgcttcaaaaacagtaagttgagaatcagaagcagagtaggatgtgttcactgcttccagtgactatggacagcacaccgatgataaaaaactaacctccacgaggcaatgagctgagaatagagcgttctcaagacaactctagcaaggtatagttcccagccctctcttgagaaacaaatcctaaaatccctcaagataataagcccatacacagaaatgattccaaaatagttccccacattcttcatataacgtgttagcaaacacagacatatgcaggactgattggtgagagaagcaagcacagctttgggaagaggcaccctagttccagcagtctggtaggcaaggctgccgagtcaccagcatagacggctctgggtatattccacgtaaatggtgtgcagagggttaggctaggcacatggagcagttctataatcctaggtgttgtagggctaagggccaccaactctccagccctaacagttacgtctccagctgcaaagctatctcttagcaggggaaagggcaaggcaaagagccagttctaggatcacctgtgcatccactgccaatgccacagctggcattaatattccttcatatccagtttagactggatacagcagctttgtttatacactgggaaaattttccagactgtaggaattaacatatgccagaatattttaacaagaaaactgtggcaacatagtctctgaatgtttttaagagtagtgaacgtcttctgggagctagaacaaatgatgtacaaacgatgaagccttcctgagcttcacagtcccataagtctataagacagtcctttttttctaacttggtggcttattaacaggccctccatcatcatcatactcattaagtttacttccagctcctccaagttgtataggcactgacttggtctaaaagatttgatgtaaatttcgaacctgagtttgttgtacttgtaaaaatcttacgttcattttaaaaatgtatttatttgtttaatttttgacagagtctcgctctgttgcccaggctggagtgcaggggcaccatctcggctcactgcaacctccgcctcccgggttcaagcgattctcctgcctcagcctgccgagtagctggaactataggcaagcatcaccatgcctggctgatttttgtatttttagtagagacgggtttcaccatgttggccaggctggtctcgaactactggcctcaagtgatccatccgcctcggcctcccaaagtgctgggattacaggcatgagccactgcgcccggccatgtttgtttatttttgagacccagtcttgctgtcacccaggctggagtgcagtggagcgatctcggctcactgcagcctccgcctcctgggttaaagtgatactcctgcttcagcctctgagtagctgggattacctggctaatttttgtatttttagtagagacggggtttcaccatgttggccaggctggtctcaaactcctggcctcaagtgatccgtccatctcggcctcccaaagtgttgggattacaggtgtgagcaactgcacccggcctaaaaatttatttttgaataataaaaaagccacatgtagctaagtagctaatacggtggacagtgcagttttgttgttgttttgagacggagtctcgctctgttgcccagggtggagtgcagtggcgtgatatcagctcaccgcaacctctgcctcccgggttcaagcgattctcctgtgtcagcctcctgagtagctaggactacaggcgcgcctggctaacttttttgtatttttagtagagacagggtttcaccatgttggtctggctggtcttgaactcctgacctcaggtgatccacttgtcttggcctcccaaagtgctgggactacaggcgtgagccaccgcgcccagccacaaaatgttctactggatagtgatgtctacagttgtccatggtcccctactgttaaaccattagcactaacccctaccgccaccccagcctcttaaaaatgtcatttgtaacaatctaaatctgtctaaggaaaagcaattcccaaatcccaaattctgttcatggaggttcataaagatacagtacggaatctcagaggtttttgttttttttttgtaactttatttattcaagaaattttgtactaaaaagtttgaaatttcacttttaaataccttctaagcaaagtattaagaatattaaaaagtaacaataaatatagaaaataattatgcccatgaaatctcataatttaagttattcatcaactggaaaaatgtaaaaatcttaaaatcatttgaagagaaaagtaaagatgaaatatttttactatgcatttttaaaaggcatctctgcaatttaagtttaccagtatttaaagactataatacggttttctaatctatagctaatttgcatgcatagcacaaatacccaagctgagtgaatgtacataggctttgtttaaaaaaacaaaaacaaaatcctttccctacctaaataccggtaaacttgcaaggcattgattaaaaacaagacgaacaaaaaccacaaaggatgtgtaaaatatgtatcatacgttgtaaacaaaatttaaaaagagttaattagaaatatttccctttgtttttttgttctagctcaaaagatctgaaagaagtaccttaatcaggaattcttttcctccttgaatttgaaattgggagaaatggagccgggcacggtggctcacgcttgtaatcccagcattttgggaggccgaggcgggcggatcacctgaggttaggagttcgagaccagcttggccaacacggcgaaaccctgtctctactaaaaatacaaaaattagctgggcgtggtggcaggcacctgtaatcacagctactagggagagtggggaaggagaatagcttgaacccgggaggtggaggttgcagtgaaccgacatcacaccattgcactccagcttgggcaacaagagcgaaactccgtctcaaaaaataaaataaacaaataaataaataaataataataataaattgggagaaatgtgaaacttatactttaaatcaatactagtaacaaaaatacagttcggttccttgataggccagttaagtgacagtgacacaaagcagggtaggaagaaaatttaaaagccaaggaaaaaaatagcttggaagacaagagagacaaaaaaggaaccaggggccgaggtaggtgatcacgaggtcaggagttcaagaccagcctggccaagatggtgaaaccctgtctctactaaaaatacaaaaaaaattagctgggtgtggcagcaggcgcctgtaatcccagctactctggaagctgaggcagagaattgcttgaacctaggaggcggaggttgcagtgagccgagatcgcaccactgcactccagcctggacgacagagtgagactccatctcaaaagaaaaaaaaaaaaaaaggaaccaagataaggtaaagaaggaaaaaacacaggagaatcagggaaaaggagagtggagtgggaagggcagtgggttctgacccacacatattatttcactgcttttgttatatatgctcattctggctaaagatcccagagaggttaaaaataaagttaattttatttgtaatactgatttattcatcagttaaacttctatttataaaactttagtcttcataaaatcttttagattaaagataatcaaagacatatgcttctttggtccagacctagtccagaagtttcccactcagtgttccttgacataaatatttaagattctaaacatatgatcagtcaaaaatccttaataacactaaccacattccagaactagtttcctcagctgtgatctcactgaagcaaattaagtacagaaagctgtgtgtttaatttgtaactaggttttgtcattttgactttggatgcacaagtcataagagatcaccagcattgcaaaacttataaaacaaaacaaaatcttccaacttgtaaatctgatgttaaattcagaaaaagggaagtgaaggaaagttgaaaactctaaaaggggaataaaaggcaacttgaccaaaccatcataaaatggcttagaacagggggaaatgaagcagcagattaaattagcagcccaactgttagtttcttttaaaaagtactgatactcccttttaggggaagttgtgctaaggcaattaaggcttaggtgttaatgattaaggaccttagctacttaccaggaaaacaacaccaaactactaacagagacagtaagatggtgaggataactacatttgagacctcaaattgagtacataataaaatcacctactatcttttacacactacaatcacagacatagtttcccctttaatagtatatacatacagcaagactcctttttaaagagcatctattaaaggattaaatttaacatttcctagcaccaaataaattatatatacacacatacatatatatatatatacacacacacacacacacacacacatatatgtatgtatgtatgtatcagcttatttttggataccaagtcatggcataattaacaaagatttaaggtcaaatgcattttaaatgctaatatggcatttagtagagtcagacattgagtcaccccaaaataactcaaaatgtgcctaacataaaatttgaatccttaatatcctctagaacacaacatttcatacaaggtgacaatattaatggcacaaatttctaaaggatttctacaaatattagtactccttcctatttaaataccaaagtccaagactagccttatttttattttttattttgagacagagtctctctctgttgcccaggcctgagtgcagtggtacaatctcagctcactgcaacctccacctccagggttcatggaactcttgtgcctccgcctcccaagtagctgggactacaggtgcgtgccaccatgctttggtagagatagggtttcaccatgttggccaggctgttctcgaactcctggcctcaagcaatccacccacctcggcctcccaaagtactgggattacaggcgtgagccaccacgtccggcccttatttttacaaattgccctacaaataggaaaaatgtaccttaaaagttcatttccagaagaaagctctgcccagactttctccatgaaggagcaactatttctgtactttttgccaggtggggagaggggacctgtgctgtccaagataatgacctgagaggtcatgatctcttgcttaagctcaagatatcctgaggggtctgcttcctgaatattttattttttgagacagaatttcgctctgccacccaggctggagtggagtggcacgacttcggctcactgcaacctctgcctcccaagttcaagcaattctcctgtctcagcctccctagtagctgagattataggcgcatgccagcatgcatggctgatttttgtattttttagtagagatggagttttaccatgttggctaggctggtcttgaactgctgacctcagatgatccacccgcctcagcctcccaaagcactgggattacaggtgtgagccaccgtgcctggcccttcctgagtattttaaacctttagccatgcacaggactgaaaagtttttcccttagtatttcatcaatcctattcaattaaaaatcctggtaggcataaatttcatcttatcagaatataaataaacattttaagtttataccaagcttgtggcttggggtgtgtgtgtgtgtgtgtgtgtgtgtgtgtgtgtgtgtataaataaacattttaaatttataccaagcttgtggcttgggtgtgtgtgtttgtgtgtgtgtgtgtgtgtgtgtgtgtgtgtgtgtataaagctgtttaggaagtttctctaacaaggaaaatattaggcatttcccagtcacatttgcttggtatgcaaaaattgatttctgaaacaactccatttttcattaactccagccttcttaaattgggtatttccattttaaaaactgaattatttatatatataagtactttcaataatttgactggcacaaggaaaatattgttcaacaagtctactcccttaacatgtatcctttaaaaagtgttttactgtacaattaaaaattagtataaaaaacccaactcactggcaaagtagaaagaagggcttgtctccttgttgtatggtaatttgggacatgctgaatttgggaaatagaaaggtaaattagccttttgaggtgtgcattttccaaattttctggaaaggttgacatattagtaatttctttttgtattcatgcataattcattttcataagagatgacaagcactttaaacactgctacagaattttaaaagaaaggactaaaccggaagacactgttcttctgtacttaggtgtcaagttgtcatgctgacttgcttaaaagtaaaaggaataaaatcattatctaataaaaacaccaacatggcattctactgaacaaccttgatataaatcatgtaccaaaataaaactattttacaagtttaattcaatagacacacaattttgcaaaaacattactaatggaaatgtcattatcctgaaagattatctagtaatggatccaaaaatttaggatcatagcaagaatataaacatgaatattatttcttattaaaacatgtctacataaaggggtagggtatttgagtgtatttaaatacacctggaaggatacacatcaaaatgttaaaaggcagttgtcaggtggagggattatggatgcttttcattttttttttttttaacttaactatattttcttacttatctgcattaaactaccaaaaacaaatcaaaaaaggattctggatctaattcttcctaatggctctagttagtcggaaaagttgtattattactgtttctgaaaggtaaaagcatcaccataaaacaaaattagatggattagaagagtagatgtgaggctgggcgtggtggctcacatctgtaatcccagcactttgggaggcctaggcagacaaatcacaaggtcagaagttcgagatcagcctggccaagacggtgaaaccccgtctctactaaaaatacaaaaattggccggtcgtggtggcgcacacctgtagtcccacctactcgggaggctgaggcagaaaaaccgcttgaacctgggaggcagatgttgcagtgagctgagatcgcaccgctgcacttcagaatgggtgacagagtgagactacctcaaaaaaaaaaaaaaaaaaaaaaaaagagtagatgtgagaggaaaaaaaattaaagtaacttcttagaagggatggggtagaggcaatgatggaagttagattaagagacatcaaagaggccggggcagtggctcacgcctgtaatcccagcactttgggaggctgaggtgggtggatcacctgaggtcgggaattcaagaccagcctgaccaacatggtgaaaccctgtctctactaaaaacacaaaaattagccaggtgtggtggcgggcacctgtagtcccagctactcaggaggctgaggcaggagaactgcttgaacccaggaggcggagtttgcagggagctgagatcgcgccactgcactccagcctgggtggcagagggagactccttctcaaaaattaaaaaaaaaataaaaaataaataaaaaataaaaaaaaaaaaagaggctgggcacagtggctcacgcctgtaatcccagcactttgggaggctgaggcaggcggatcacgaggtcaggagatcaagaccatcctggctaacacagtgaaaccccatctctactaaacaaaatacaaaaaattagccgggcatggtggcgggcgcctgtagtcctagctactcgggaggctgaggtaggagaatggcgtgaacgcaggaggcggagcgtgcagtgagctgagatcacgccactgcactccagcctgggcgacagggagagactccatctcaaaaaaagagacatcaaagagataaggtttttgacaaaagccctttctaagatagctagaaagaggtcaaggtcaatacttttttagaataaaataattatcctattttatcatttaactgttcagtaatgttagcatatgtgtattaaacatactaaaaatttaaaaacaataatcaggatttcattttgcagtcattagtggtcctatgttttcaatgcctttggctatggctataacaattaatgaatgagaaaaggtgacataaaattgtcaccaacatctgggtgcatgttcttctgtttgcattaaatgttttaaaaacctagatatgatgtagcttaaaaagaaaagcacaattcatactcaaagtatttggttcctttgagaaaatttatgacaatatatttaatatatttataaaatataaattgttcagggaagatgagtataaaattaacacttctatgtaagtttgttgtagtttataagaatgtacttcaaattttgtttatatttgatataataaggctttgaaagtctaataattcaaataaatcactgcagatttaatgaagaacatgcttaagcagattaaattatggcttatgatggcatagaacaaaacaattctttcttatgttttcttttttttaaatagagacagggtcttgctctgtcacccaggctggattacagtggtgccatgatagctcactgtagcctcaaagtcctggactcaagtgatcctcccatctcagcttcctgtgtaggtgggactacaggcatgtgccaccatgactgggctttttttttttttttttttttttttttttggtagagatgggatctcgccatcttgcctagactggtcttgaacacctgggctaagcgatcctccacttcagcctccccaagttcttggattacaggtgtcagccaccatgcccagctcctagtgtcctttttagggtcttaagcaccacaaagggaatcttgattaactagtgacaatcacaacaagtccacagccttgctcctagcctgcctccatacagacagcaattaaataccacctgtgtaaactgcaggagagtagttcagatttggctgagtaactttttcctggcatgaaagaaccggctctaatgactagttcattccagatttcactggacattagatctagtgctttgttttgtttgcaacatttcctatttgcccacacataaatggactttggggtctaaggccccactgctcttcaaatggacatgttctaggaagtagttatgaaaatcatctgtacctcaaacacagtatttaccctataggctgtttcaaaaccaatgaacattcatccaaaagatgaagccagatgttggcagtgaatgaacacaatgaggagaaagattcggctcaacattacagtattattgctacaatgtctcaaaagcatgcatacacaaataactactctccaaatgcaatggaaattttagcttaaaagtttcagatctgattccaaggggagtatgccagaaaatggaaggaaagagatgttctttccacttgttaaatcatgatgtattcaccagaaatgtataaacaatcataatgaacttttaacctaagcctttagcaaacaggaaaattgttaaaatatatacaagttgcataaaagccagcatgataaatcaatcgtgcctttgcacgcatattcagtccccgttaagacaactaaagacaagtcaaatgacggggtcataaccaaaataataaaccaagttagtttgtcagtatcttttacaattaaattacggatgggcctcttgaaaaaaatgttttccaaaatgtagcaatcacacaattttttatttaaaatgcgtaatccacaatacaaaattgaaagtgataatgtggaaaattaagactggacttaactgttttataaaactaaacacctttgatcatatacaaattcctatcagcagtgagcctttgtggcagacaagaacctccaggaagaaagcataagctgtgggttacaggtgacaggaaggatgattgctgctgcccaagtcctattctcattaacctacggaatgttaaaacttttattcttcaaaaaggacagaggtggtatgaaaagtagtaatgtctcaagaagaaggtttgccagaaatctgtaaattctttttttttttttttttttttggagatggagtctcactctgtcgctcaggctagagtgtagtggcgcgatctcggctcactgcaacctctgcctcccgggttcaagcaattctgttgcctcagcctccgaagtagccgggactacaggcacatgccaccacacccggccaattttttggatttttagtagagatggggtttcaccatgttggccaggctggtctcgatctcctgacctcatgatccgccagccttggcctcccaaagtgctgggattacaggcgtgagccactgcgcccagcctataaattcttaaataactcaattttgcctaaacatactcgttcaggacatctaaacttaaaaaataaaaattttatattcttagtatttcaaaaagttcaaagaggctttaaaaatgaaatgcccatgtagttacatgtaaccataatctcattctcatagcagtacacttttcaactgtatgaataaaccaaaattatcccctactccaaacaaccaaaaacgcaaataggaaaactaaacgacactacggtagttctcagaaatattcagaacaaaacatcttaatgaaatcagtactatttaaaaacatattctgaaaaacatttgaagcaatccattaattctgtatcataagatatacaaatggacattttattttaaattatcaacagtgaaaaatctattattttggtactttagacagctgctaagttgatctacacaaatttctctgtttagtcacaaaacgaagatgggtttttttgcttattattctcacatataaatactgcttagttttacataaaatacttctcattttcatttcagcattctgttcacattggttatatttaaagtgtgactcatgtctaaaatatatctaatatgacataatattcaaccattaaaatacagcatgatgtagaaacatagtattatcattataacaaacagcaaaaaaaatatgtaatgccagtgaccctcagatcaagtagtgaagcaaaatgttttcatgctggagaacacctttatgcttttattattataaaattctcttgcatgtcgtaggcaggatataccaaagcataatattgatgaggaagaggagaaaggtacctttctccacaaagatgctttgccattatatacatcattacattttagttaaagcaggaaagagatctgaagaccaggtacagaagtagaaactatttgccaaaagttataaagcaagtcaggcaaagaaatgggttcatcttttccttcagattcttgaccctcaatgtcataaaaggtcaggttattcttagatagagtatgttttcagaaacttaaattaagaagagtcacacacactggaagagacaaacaaagtgcttcctaccatacatcgcatgcgtctgctcatgagccccgtactgagttgctgaagaagatactaaaccaggctgggcgtgtgttggtggtgccatcattctagcattaccctgtattacaggactatagacatgaggatgctgtgttcaaacaaaaaataaagaaagcacattaacactgcaaatagagccaagcagactttagttaagatttttaactccatggtttccagatttccagaaacagctgtaaactctcaaatctttcttggctgtttcctctgaacctcttacaatcatcagtaaccttcgaatatatattgaaaagggtccccaagtccttagctatctaccctaccatcacacaaaagcaaaaattataaaggaaaatccctttaccatattaaaagtttttttatatggtacaaaaattaagagttaggccttaccagccttacctgagactgataatgtggcacatgctgaacaaggggctgatttgggaactgctgaggactgtaggcaacatattgcgtggagtaagctggtggggtggctgcaatcggtgggcccgctgctgacgctgggtgcatcatggcactctgatgatgctggtcttgccgctgttggggcatatttggtactgcagaaaaaaaagcagactgcctattaaacagtatctccacagcataatacatgtgttcacatggtctaggaggctctgaatgatttgaccctgaatctgcgtctctgatgccatctcataccactcccacttctgccactctgggttattttcctatcatgcatgctagtcctcagcctcaaacaccagttcccaaatcccagctgggataattctgcttcatccttcaggtgtcagcttgaaagcaacttcctcagagggactttctctcatggccctcagacttgatcaagtccctgtaacagactctcacagcattatgaaatcgcttctcatatggtattttctgggacgggcactgcattcattttgagaaaaacaaaggcatgaccaaagagccaaaacagatccaacactaactttctatcttccttaatttccaaccactgaatccttgtaacacttcccattctttctcaaacccagtataacacagcaccatgtagcatataccaggtttctaaataatagttcttttaaaagattactttatgtcttatcttaatccacacaggtggtctgcatgtaagggcctcgccctgttacaactctagttaagaattcagctcaactgtcatctcccatgtgaggtttttttccagttcctccagcacgagctagctacttcccatgtgcctctttcctcacacatttcttacagcactattgtctgtgacctgtttctggtgtggcattaaccaagccacttcaggaaaataattgtggaatgactgcttacaactaggtataaggcacaaagaatatagaacttgttcataaaatcctaagaactgattatataattaactgcaaatttgtggctaaacattcactaactgttgctgaaatttgggagagctagttacatattattttatctatgtaggaaagcaaacctgaacatttttttatattttatcttggatgcacgtatttaaaaaccacctccttctggtaaacaaaaaagccactgaaaactacttatcacttttatcaaatgaaagtttgcccgattatgctaactgagcttaaactattcactattattactttgttacttattaccttcctgtatatttaaaaaataattaaaaagctagtcaagtatactatggtgctattatttagatatcatgtgtttgtctccactaattctcatgttaaaacatgatccccaggccaggcgcagtggctcacgcttataatccctacactttaggaggccagggcgagcggactgcttgagctcatgagtttgggaccaccctgggcaacatggggagacactgcctccacaaaaaatacaaaaatattagccagctgcggtgctgtgcatctatggtcccagctactcaggaggctgaggtgggaggaacttttcagccagggaggcagatgccgcggtaagccgtaactgcaccactgcactccagcctcggcgaagaagtgagaccctgtctcaaaaaaggggagggtaggggacaggaggggaagaaaagaaaccaagcccttgactctgcctgttatttgaaaaatgctaaaaatatttttatccaatacctcaaaggattggaatttagtaaaggagcagggtaaaaactaacatataaacagcaatagccttcatatatggtacttcataagtaattacttagaagatgcaatggaagagaagtccctgggttacactaacattaaaaaagaacctacctaaggcatacactgaaaaaaatgtacaaaaccttaaagataaactttatttttatttatttattttctttgagacagagtgtcgctcggttgcccaagctggagtgcagtggtgcaatcttgactcactgcactctctgcctcctgggttcaagcgattctcctacctcagcctccagagtagctgggactacaggtgcacaccacacccagctaatactttttttaaaatatttttagtagagacggggtttcaccatgttggccaggctggtctcgaactccagacctcaggtgatctgcccacctctgcctcccaaagaggtgggattacaggcgtcagccactgcatccagccaaggataaactttaatatgctattgaaggtatactttgttcttgaacaggaagactcaacatcatgaagacatcaatcatttcttctcaagttaatttataagtttattgtgattctggcctgccatggtggctcatgcctgtagtcccaccactttgtgaggctgacacaggcagactgcttgagctcaggagttcgacaccagcctgggcaacatggtgaaaccctgtctctgcaaaatatacaaaaattaagccaggcacggtggtgcttgcctgtagtcccagctacttgggaggctgaggtggggggattgccttagctcgggaagttgaggctgcagtatgcccagatcatcccactgcactccagcctaggtaacagagccagaccttgtctccaaaaaattaaaaaaaaaaaaaaaattccagaagtttatactgatagtaagaaccaacgacaaaaaaaccacctcactggttacctttggaggataacagaaaaccaactcattattttgaagactgccttaaaaagggaaatgattaacattttaaattacttttcctaagaaagctatacctcagggtaaccaaacagctggatatgggaaagtttttctttatagaaatattccaggcaataattgaagaagggatgaaaggaaaagaatgtcaccattttacaacccctaaggaaataactgatcttgggctagacaattatcatcaatggctgctaaaaaacacaccaaaaaaattaaggcgctaaagggacatattatctcctggatagataaaacatctaggaactcactgactactcctatcaggaaaaagactgattacatgactcctcactgaaagtacacacatctgtgaaacattggggaaaaaaaaaaaaaacccaatctgatcaagccttcattatttactatcagtttacaaagattacaggggacagaagtctactttaaatatcaacacagggatacagtcagcaaaattcagatcgtgggaaaaaaatacaagacaagctggatatgaacaagacaaaaactaagggaaaaactgtaattaaaactgtgagggctgagtgcagtggctcatgcctgtaatcctggcaccttgggagtcaaggcaggcagactgcttgagctcaggaattcgaaaccctgtctctacaaaaaatacaaaaattagccaggtatggtggcgcgcacctttagtcccagctacttgggaggttgaggtgggaggaccacctaagcccaattggtagagactgcactgagctgaaatcatgccactgcactccagcttgggtgacagagttagacactgtctcaaaaaacaaacaaacaaaaaaacctatgacttggctgggtgtgatggctcatccagcacctcctaaagtgctggcctgtaatcctagcactttaggaggctgaggtagaaagataacttaagccctggaatttaggactagcctgggcaagatagaaagatggtgagactctgtctcaaaaaaaaacaaaaaacaaacaaaaaaacaaagaagaagaaagacaagacaagaaaagaaaagctggcaaggtggcatgtgcctgtagtcacagttacttgagaggctgaggagggaggatcctttgagaccaggaattcgcagcagcagtgagctatgattgcactactgcactccaagcctgggcaacaaagccagaccccatctcaaaaacaaaaaacaaaaccaaaaccaacttaaagatacacactaaaatgttggtggataaactgatgcaatgtctagaatttgcttcagaataatccagtggactcaaagcttttaagagacaatgggtagggatgaaacatgactggcctaggttattaatgtctcaatacattcgtaataaaaagttaccgcaaggctgagagcgatggctcacacctgtaatcccagcactttgggaggccgaggcgggtggatcatttgaggtcaggagttcaagaccgggctggccaacatggtgaaaccccatctctattaaaaatacaaggccgggcgcagtggctcacacctgtaatcccagcactttgggaggccgaggcgggcggatcacgaggtcaggagatcgataccatcctggctaacacggtgaaaccctgtctctactaaaaatacaaaaaaattagccgggtgtggtggcgggcgaatgtagtcccagctactcaggaggctgaggcaggagaatggcatgaacccaagaggcggagcttgcagtgagccgagatcgcatcactgcactccagcctgggcaacagagcgagactctgtctcaaaaaaaaaaggctgggctacttgggaggctgaggcaggagaattgcttgaaccccagagggggaggttgcagtgagttgagattgtgccactgtactccagcctaggtgacagagccaagattccatctcaaaaaaaaaaaaaaaaagttaccacaatatgaaacaattaaaaaaaaaaaaagacttcaacatataaacaaatccaaattgcaagcctgacttggaccctaattggaacaaattattgtaaaaagatttatcttttctgtttcttttttttttttttttttttaagagggaatcttgctctgtcacccaggctggagtacaggtgcgcaatctcaactcaactacaacttccgcctcctgggttcaagcaattcttctgcctcagtctcccaagtagctagaattacaggtgcctgccaccgggcccagccaagatatattttaaagatcagttggttttaaaaaggcaactgatttttttagtagtaagttaattatagagttcatatggaaaaataaacagaaaattcaaggtaatctgaaaaaaaaaatcaatgttggcagtgagtggatgagaaggtagtcctattagattagtgaagcagagtgaaaaatccagaaacaaattcaaccacaaaaagacacttgttatatgataaaatggcatttcatatcagtttgtatgaccataatggaattacattattatctatccatctatgcgcacgcatacacacacactttaaatacagggtctccttctgtcacccaggctggagtacagtggtacaatcacagctcactgctgctttaaactactgggctcaagcaattctccttcctcagcctctcaagtagttaggactacaggtgtgtgccaccacacccagcaaatttttaaattgttttgtagatatggggttttcctacatcacccaggttggtcttgaactcctggcctcaagcgatcctcctgccttggcctcccaaagctctgaggttacaggtatgagccactgttcctggtcaatatgatatacttagtagatgataagtatttgaacataatccaacaaccattcatgattaaaaagaaaacaaacccacctctgcaaattaggaactgaagtaacacctaactgtatgcttaatagtgaaagacaatgtctcacccctaaaaatgggagcatggcaaaatctcatgcctttttcagtaatgcaccagtacaataagacaaaaaaaaaaaacccaaaaacaccaacatggtgattagatcatgattgtatgtttaagtcttaaagggctgccagaaacagtgggtttaccaacacatcaagacacaaggtcaatattcaaaaatcaagtgcatctctatttacgaataaacaaacgttgaaagtttttaaaatataactcacaacagcacaaaacagatgaaatattaagggataaatttaagaaagcaggcacaaaactgatacaaagaaaactagaaaacactggtgaaacttaagacttaaataaatggagcagtatatgatgacctcaatgaagattccatattgttaagatatttctcccagaactgatataaagattcagtgcacaatcccaagctgattctaaaatttatttgcaaattcaaagaacgcagaataagagtaattttgacgagaataaaactgggagactcatatgaacttaaaggttggttacaaagtaacagcaataaagagagaattggcataaggatatatacaaagatcaatacaacaaaacagttcacaaatagacacacatacaatacagtcaactgaattcaataaagctactatggctgggcgcagtggctcatgcctgtaatcccagaactttgggaggctgagatgagcagatcacctgaggtcaggagttcgagactagcctggccaacatggtgagaccctgtctctactaaaaaaaaaaaaaaaaaaaatacaaattagctgggtgtagtggcgggcacctgtaatcctagctactcgagaggctgaggcagaatcgcttgaccctgggaagtggaggttgcagtgagccaaggtcacactactgcactccagcctgggtaacaagatcgagactcttgtttcaagaacagaaaaaaaataaagccaccaatggaaaacagaggctggtgccagagaaaccgagtaaatatttatggtggagaaaatgaagctagacctttacatcacaccctacacaaaacctaacctgaaatcaaccatatacctaaccataaaaacattcataacctagggtacgtaaaagatttcttattatgatacaaaaaagcatgaaccttaagagaaaagcttgataaataaggcttcattaaaattaacaatactggctcttcaaaaaaaaccgcagactgggagaaaatattcacaatattctgagaaaggacttgtaaccagaatatataaataacttaaaataatttactaaaagtagtaactttattttcacagtaagaaaagaaacatgacttttttttcttttttttgtgagacagggtctggctctattgcccaggctggagtgcagtagtgcaatctcagctcactgcaacctcgatcacccctccatcgccctccaaacccccgcaacctcgctcaagcgattgtcccacctcagccccccaagtagctgggaccataggaatgcgcttctgtgcctggctaatttttcttttttcttttttttttttgcaaagacagggttttgtcatgttcctcaggctggtctcaaactgttggctcaaatgatccatccaggttggcctcccaaagtgctggaattacaggcgtgagccagtgcacccaggcagaaacattgagacaaaaagaaattattaggacaggcgcagtggctcacacctgtaatctcagcactttgggaggccgaggcaggtagatcacctgaggtcaggagttagagaccagcatgaccaacatggtgaaaccccacctacactaaaaatacaaaattagccaggcatggtggcgcatgcctgtaatcccagctacttgggaggctaaggcgtaagaattgcttgaacctgggaggcggaggttgcagtgagccaagatggcaccactgcgttccagcctgggcaatagagtgagattccatcaaataaataaataaataaataaaatggaaaaaagatttgaaccatttactaaaaaaaggttgacagctgaaaacaaacacacacatgatgaggtgctcctggatcagtcatcatcagagaaatgtacatttaagatcacaatgagataccataagacacccattagacctgttgaaattaaaaagataacacaataccaagtgttggcaaggatgcagaacacatggaacctacacatgtacctgatcagttggaatgtaaaatgacacaatcactttagaagattgctagtttcttattaattgaaatatgtatttaccaggcagtgtgtggtggctcacatctgtaatcccaacactttgggaggctggggcgggtggatcacttgtggtcaggagttcgagaccagcctggccaacgtggtgaaaccccgtctctactaaaaatacaaaaaaattagccaggcatggtggtgcgcgcctgtaatcccagctacttgggaggctgaggcgggagaattgcttgaacccgggacagggaggttgccatgagctgaaatcacgccactgaactccagcctgggcaacagagtgagacttcatctcaaaaaaaataaataaataaaaaataaaataaattttttaaaaaaatgaaatatgcacttaccatacctcagcaattccaattctaggtatttaactaaaagaaataaaaacacaaacacttgtacacaaatgctcacagcagcttcattcataatagccaaaagctggcaataactcaaatgcccatcgactagtaatgggtaaattaactgtggtataatcataaaatgaaatgctacccagcaataaaaaggaataagctggctgggcacggtgactcacacctgtaatcccagcactttgggaggccaaggcaggtggatcatttggggtcaggagtttgagaccagcctggccaacatggtgaaatcccgtctctgctaaaaaaaaaaaaaaaaaaaaaaaaagagagagagacaaaaattagccaggtgtggtggcacgtgcctgtaatcccagctacttgggaggctgaggcagtggaattgcagaccaattctgggacacagaacaagactccatctcaaaaacaaacaaacaaacaaaaaggaataagctgatactaacatgaaattcaaattactacactgtttaggacacacatatgaaattatataccaagcttgtccaacttgcgtcctgggacggctttgaatgtggcccaacacaaattcataaactttcttaaaacattataagttttgctatttttttttgttttgttcatcagctatcattagtgttactgtattttatgtgtggcccaacacaattcttcttccaatatgacccagggaagccaaaagattgaacacctctgttacacgctgtttgattccatttattaaaaaaaaaaaaaaaatctaggggctggctgaggtggctcacatctgtaatcctagcactctgggaggctgaggtgagctcaagagttcgagaccaacctgggcaatataatgagacgtctccaaaaaaagatttttttacgtaaaaaaagaaaaaaaaaaacctaatcaaaaaaaaaaaaagaaaaagaaatctaaagaggataaatctaatctatagtaaaagaaggcagattactggttaactggagctagtggtaataaagtacagttggacagagaagaggaacaggcacaatgttttccatcttcactgatgaagcaagtagttacatgagcaaatatatttgtcaaaactcattaaaatgtaaacataaaaagatgagcattttcttgtatgtaaattacagactaataaaactggttaaaacattttggatagtcatttagaacaagataaattggattcacattttatactttaagataaattctaaaattagccaggcataatggtacaggctggtctcaaactcctgagctcaagtgatcctcccacctcagcctctcagcctcccagggtgccaggagacaggcagatcacgagatcaggagttcgagaccagcctgaccaacacggtaaaaccccgtctctactaaaaatacaaaaattagctgggtgtggtggcgcacccctgtaattccagctactcaggaggctgaggcaggggaatcgcttgaatctgagaggcggaggttgcagtgaagctaagttagcgccactccatcagagcgacactccatctcaaaaataaataaacaaacaaacaatttaagaggaaagaatagtcttttcaacaaatgaggtggggacaacggatatccacaagcaaaaggaaaaacctggaccactactctcatctcatacacaaaaattaactcaaaagagattgtagacttaaatgttaagagctaaactataaaaatcataggagttttataggcgtttcataggagtaaatctctgtggccttgagttaggcaatgctttgtctgatatgacatcaggagcaacagcaacaaaagaaaaaacaaacagataaattgaacttcatcaaaattaaaaactgtgttacaaagaacaccatcaagcaagtaaaaagataacctatagtcagggcatggtggttcgcgtctaaaatctcagcactttgggaaggtgaggcaggcggatcatttgaggtcaggagttcaagaccagcctggccaacatggtgaaattccatctctactaaaaatacaaaaatgggccgagcgcggtggtgcacgcctataaccccagctactctggaggctgacgcagggggatcgcttgagctcaggaattcgagaccagcctgggaagcacggagaagctccatctctacaaaaaatataaaaattagcctggtgtggtggcgtatgcctgcagccccagctatctgggagggtgaggcaggagaattgcttgaacccaggaagcgaaggctgcagtgagccgagattgtgccactgtgctccagcctgggcacgatctcaaaacaatacaaaaaaacaaaaaaccacaatgacacttcataaccactagaatggacataacccaaaccaaagacatatcggttatttatgaggatgtggagaaactggaacacttgtacattactggtagaaatacaaaatgatgcagctgctttggaaaagtttggcagttccatcacagcatttctactttaggagaaatgaaaatctaaggccacatgaaaaaaaattttattttttattttttgagactcactctttcactcaggctggggtgcagtggtgtgatctcagctcactgcagcctccgcctcccaggttcaagcgattctgatgctcctgcctcagcctcctgaatagctgggattataggtgcacgctaccatgccagtgtaatttttgtatttttagtagagatgggatttcaccatgttggccaggctggtctcaaactcctgacctcaagtcatctgcccacctcagcctcccagactgctgggattataggcatgagccactgctcccagcctcatatgaaaatttgtacatgaaaatccacaaaagcattactcattgccagaaaaaggaaataatccaaatgttcatcaactgatgataggtaaaagtggtatattcaggccaggagcagtggctcacacctgtaatcccagcactttgggaggccgagggaggtggatcacttgaggccaggagttcaagaccagcccggccaacatggcaaagccctttctctactattttttttttttttttttttttgagacggagtctcgctctgtcacccaggctggagtgcagtggcaccatctcagctcactgccagctctgcctcccaggttcatgccattctcctgcctcagcctcccgagtagctgggactataggcacctgccaccacgctcagctaattgtttgtatttttagtagagacacggtttcactgtattagccaggatggtcttgatctcctgacctcgtgatctgcccacctcggcctcccaaagtgctggattacaggcgtgagccaccgtgcccagactctgagtatatcatttctattaaaaagacagtacctcctgaagttagaatgtgactctcccatcagatagccaaactgtcatgcttgctcttactacagtaaccttttatattttaatgacaacaaaaagttcccattgcattgttttaagtaatcattgaaaacagctacacctgctggtgatacatgaacaccttaacactacattaaaatggcagtaaaaaaaaaaacccactttcttctcagaatttctaaaggccctcaaaataagattaaactctataatttgattacattatttcaggcagagttctttcaacaggttcatatgttccaaggctaaaaaaaaaaaaaatagcatactgagaaaacgaaaattaagagttttagttaacatctatgaaatcacaattaggtcaaacatggagaaaattggctgggcgcaggcactttgggaagcagagccaggcagatcgcttgagcccaggagtttgagaccagcctaggcaacatggcaaaacccatctctacaaaaaatacaaaaattagctaggtgtggtggtgtgcacctgtagcccccgctatccaggggactgagaagggaggatcgcttgagcccaggaggtcaaggctgcattgagccatgatagcgccactgcgttccagcctcagcagcaaagcaagaccctgtatcaaacacatacacacacacacacacacacacacacacacacacacacacacacaaaacacccaaaaaaacacattgaggaaatcttattaattcaggaaaaatgaaaactttatgtcagaaaggcaattattgggcactgagaaatgtcttttctgtataaattattctactttctatagtttctcaactgatagcagttaatcactctaaattaactggttggcaaaaaaaaaaccctttagcattttccaacattaaaagaactctttttttttttttttttttttggacggagtctcgctctgtcacccaggcacgcaccaccatgcccagctgatctttgtatttttagtagagacgggttttcaccatgttggccaggatggttttgtactcctgacctcaagtgatctgcccacctcggcttcccagagtgttgggcttacagatgtgagccaccacacctggccaaaagatttccttttaagaaaaatgtgggattttttctacgaaggctctttaaccacacaagcacagaatactagtttatgcaactacattatacgacaactccctaattttaatgcagaaacatccatcttatttttctttttgaggcagggtttcgctctttcacccaagctggagcccagtggtgcagtcacagttccctgcagcctggaccttctggtttcaattgatcctcccacctcagtctcccaagtagctaggactacaggagcacaccatgacggctggctaagatttctattttttttttgcagagataggtttttgccatgttgcccaggctggtcttaaaactcccggtcatgtgatctgcccacctcagcctctcaaagtgctggaattacacgtgagccaccaagcctagccgaaacatccttctaataggatcttaacattggttgaagttagttgcccctctgcttcaaaagaaattctggctttggggaaataactgtaggtatatataaagcaaggttagcaatctagtaaattaatctagcaaaccctcttcttcaaatttaagttcagatttaaatcagatttcagatcaaaaagctttggaattaacttttttttttttttttgagatagggtctcactatattgcccatgctgctctcgaactcatgggttcaagtcatcctccagctgggatatcaggcatggagccactgtgtccagccaattagtctggtttttttgtttgtttgttttttgtttgtttgtttgttttgagatggagtctcactctgttgcccaggctgaagtgcagtggcacgatcttggctcactgcaacccctgcctcccgggttcaagcaattctcctgcctcagccccacctagtagctgggattacaggcggcaggtgccaccatgtccggctaatttttgtattttagtagagatggggtttcgccatgttggccaggctggtctcaaactactgacctcaggtgatacacccacctcggcctcccaaagtgctgggattacaggcataagccaccatgcccagccagtatttatgtttgagacggggtctcactctgtcgcccaggctggagggcagtggcataatcacagctcactgcagcctctacttcctgggctcaagtgatcctctcgcctcagtcccccaaacagctggggctacaggcatatgccaccatgcccagctaatttttttgaattttagtagagacaaagtctctgttgtccaggctgatcttgggctcctgagctcaagcaatcctcctgccttggcctcccaaagtgctaaaattacaggtgtgagccatcacaccaggcctccaattactctttttgaagaggatactatataatcacaactgatgggcattttttctcccctgtttttcttcataaaatccatgtgaatatctatgtaatgttgttcatcaaaagccaatgcatagcctcatcaaaaagtcagagctaaactacaactatttattcattataaacttagttactcaattcatgcagcatgcaaactacaagcaaacacaggcaggattattctcacctttacctgctctatatgtcttggcttgattcactggcatgggcgtcataggtattgggtataaaggcttgagagaattaaaaaaaaaattaacattaggcacctatgataataacaaggtattctgtcactcttagttttatattgctagagagctaggcatgagaaggtttcctgattctccattagtcattaaaaaattagatcatacccacagctaaaaggaacaaaccccaaactacagtaaatctaaaccatctttttcacagaaaacattctcagatttaggtcctcatacttaacaacacactgaatctctgcatgcctgtctgtttcaaatgcatatgcataaccatcacaccctcaagtcactgaaaacctaaagagtgcttggtgtcagatacaaacaattggggaggctaagtgaacatcaaattctatgacttacttgcacgcctgggctcactgggactggatacatcatatttggtgcaaaacaaacaggctgagtataaactggagttggctgttgatgacccaccatagatgggctaggttgtgcttgaggccgaggtgaagttggggtagtagaaggctttggctacaaaaacaacaataaattcaattatctcaaggtaacagatgaactattattgcaatttaaagacggattttcccagtctttctaattttacttgctttaactatgtcccttttattgaaaacaaaaacacagcacataaattttcacatttcaataaaagaaaaaatgtttcagtaggaacttaaaactttgtcaattaaaaaatattaaaaacagtggcagctatttttaagaaactgatggaagtgtttttaaaaattaaaaataaatatatcttcttatgatctcagtcgaataataacaatagtacagtcatctcttagtatctgtgggggattggttacagtaccctgtgaagataccaaagtcttggaatgctcaagtcccttacataaaatcatgtagtattcgcatacaacctatgcatatcctcctatatactttacatcatctctagattatttataatacctaaaacaaggtaaatgctttactgtattgttttggaataatgacaaggaaacgtctgcatgtgttcagtatagattatcctaactatgtttttgatccatggttggttgaatccagtgatgcaaaaccctcaggtgcagaggacgtatctataaacctgacagcctagctagccaaccatcgtcaaattctgggtcagagaaattcaaagatttgcccaagatcacatctaattgatgacaaaacaaagacctttttttaatgtttaaaaagtattcattaatggccatgtaaaaaaaagaaagaaggttggttcagcacactaaaacaaaattcagatggcaggtatggaagaaggactattactaataatttttctttttttgggactagataacctcaaagaaagtaataaacctacctgagagaaggaacgtgggttgaactcctttgcattgggattcaatgttgatttcctaacttgcctaaaaaaaatataaaggccagtgaaatctacatggactttacgttgctctaaaatcttccatacctgacaatttaaaaaaaattgctaaatatagatttaaactgttctcactagaagatcactaatcgtttttattgaaacatatacacttatattgcccattccttaatcccttaaagaatacagccataaaagaacaattttttaaaaatctgagtaatatacaaccgttcctctcaaaggcaatcaaaaaatactttttttttttccttcacagagtcccactctgttgctcaggttggagtgcagcagtgcaatcttggctcactgcaacctctgcctcccgagtttaagccattctcttgccttagcctcctgattagctgggattacaggagactgccaccacgcccagctaattttttttaatatttatttttagtaaagatggggtttcaccattttggccacgctgaccttaagtgatctgcctgactcagcctcccaaagtgctgggattacaggtatgagctaccacgcctggccaatcaacaaacacttgagctgaaaagacagtagctacttatgaaatatccttaaaagcaattcttaacataacagtatccttttatttatttatttatttatttttgagacagagtctcgctctgtcacccaggctggagtgcagtggcatgatctcggctcactgcagcctccaccttctgggttcaagcaattctcctgcctcagcctcccgagtagctgggatacaggcacctaccaccatgcctggctaatttttgtatttttagtacagacagggtttcacatgttggccaggctggtcttcaactcctaacctcaagtaatctacctgcttggacctcccagagtgctgggattataggtatgagctaccagtcaacataccaatattctagcatgcagtaattcttatgtgagaagatattttacatgacatacctggaaaaagtcatggctgtaaaaaaaaattgcctcaaatcaagaataagcagtccccaatttatcaataagctgcattccaaaacttcagctttaactggattgtttggtacccaaacacctaagtcaatggtagttaagttctgaggttagcccctaaaagtccatttaattaatatactgaatgtgcagaattaagtctatcttaacaaatctaaacattaactaaaacacagtttctgatgaaaaatattttgaattccaagtagaagcaccgcatgcttctctccttgacagtggcagtttttcaacctagcagcacagtgagggtgactaatgagtggaatccagtaaagataggtcccctgaattgataatttttcaactcctgttcatttacagaaaaacttttcttaatttatgccttgtttttctagccctggggtacaaaaaaggggaagaacagaagagtagcacagggtgcaataacctcatttacttaagatgtcatttgtttggactagctgtttgtaaactaagggcaatgtataaagtagtctaaaagtccagatggattcttcacagttggaaggacctaaatgcctttaaaaaaaaaaaagttaattgagtaacaggatggtctaagttccaggtttactcactcagctgcgtctttcttctcttccttatcgtctttctcttgtttacatgctgggctggaagtctgaaccccttgggaagtgacctcaggtcccctcttgtgctccgtgttactaagtattgaaggggaaatgctggggctattcggcttgctgctgccactggtacagttgctgctgctattttcaatgaaagaatccttagcacttggttcaattttgtctttgatcaaatctcttgatttttctccctctctatttttgtttagtagttgatccatagattcagaagtagaacttggctgtaactaaataaaggaaacaattatacttaaatatcttaaataactttagtaatacatttttgccatgagcacaagctacgtaatattaactatacgcatgaaatgttctgaataaggcttttttcatactttaagagtaatgcttttactataaactaacaataacagagtacctatatagcacaaccacagtcaccaaagcactcaaatgtcctagcctctaaagttcaatatttactgagtgcttaccacatgtcagaaattgtgcctgctgggtgagaaaaatatgaaatagtttctatcctcttatacttgtcatttaaataagatcagacacttcacaataaaatgagtaaatgctaagagagtctatagaaaaagcaacctataaaaaagaaaggtttctcagtaaagtgtcagctagtctaaggtgtgaaagaagtttaggaaaggtgttgggatggagaatagtctaagtaaaaggaagagtatgtttaaaaatccaaagaaaagggagaagctggctctatcacataaaacaatagcaccaatgggggccgggcacggtggctcacgcctgtaatcccagcactttgggaggccaaggcaggcggatcacgaggtcaggagatcgagaccatcttggctcacacgctgaaaccccatctctactaaaaatacaaaaattagccaggcatggtggcaggcgcctatagtccctgctactcgggaggctgaggtaggagaatggtgtgaacctgggaagtggagctgcagtgagccaagatcacgccactgcactccagcctgggtgacagagcgagactccgtctcaaaaaaaaaaaaaaagatagcaccaatgagctgggcacagtagctcatcactgtaattccagccctttgggaggctgagacaagcagactgcttaagctcaggagttcaagaccagcctgggcaacatagtgataccctgtctcatttaaaaaataataataaaataaaataaaataacaaaaataaagaagtaaagaaaagcaccaatggctggaccaagggtgagacacacatgtacaagtgagtcagaaaatgatagactcgtcaaaaggaatatgacaataaaggaacttaaaagctatgttcagggctgcgtgcagtggctaacacctatcatcctagcactttgggaagccaaggcaggtggatcacttgaggtcaggagtttaagaccagactggccaacatggtgaaactccgtctctactaaagataaaaaaaaaaaattagccaggcgtgatggcacacgtgtaaatcccagctacttgggaggctgacatatgagaattgcttgaacccaggaggcggaggttgcagtgagccaagatcacaccactgcactccagcctgggtgacagagcaagactccatctaaaaattaaaaaaaaaaaaaaaaaagttttaaaaagctacgtttaggactttggcttttaattctcagggcaaatgggcagtctatacggaattttaagtagggtagagtactgggcagatttatagttcagaaaggtgaacacagcagctttgtgtgaaatgaactggagggaggctaattaggatgtggagggaccgtcatggaggctggactaagcgctgggcctagtcagcttggaaggtcattaagtaggtgaattcagaatgagacctgactgtacatattggtcagttagacattctaaacccctaagtaaaaaaaggagatggcaggggagaagagacagagcatggtggccaaacagaaccttccagtgatcatccccaacaaggagcaccaaattgaacaactatccacacaagaaagcaccttcataagaaccaaaaattaggtaagcgatcacagtacccagttttgacatcctatcaaggaaaaagacaccaaaaaagataaggaagatagtcttgaactgcccctccaacacccctgacattcccccacaatgcagtgtggggtggagaaagaatctgtgtgctcgggggagagagagagaaatgactgtgggattttgcattgaaactcagtgctgccctgtcacagtggaaagcagcataggacagaattcagccagcacccacagagggagtatttagactagccctagtcagaggggaattgtccatcccagtgattagaatctgaatttcgggctgggcactatggtctgtaatcccagcactttgggaggccgaggcggacggataacctgaggtcgggagttcaagaccagcctgaccaacatggagaaacctcatctctactaaaaaacaaaaaaattagccagaggtggtagcgcatgccggtaatcccagctactcaggaggctgaggtaggagaattatttgaacccgggaggcggaggttgtggtgagctgagattgcgtcactatactccagcctgggcaataagagcgaaactctgccaaaaaaaaccaaaagaatcttaattttggtaagccccaccaccgtgggtaaagtcctctggggtcctaaataaacttgaaaggcagtctagaccagaaggactgcaattcctggacaagtcatggtactgtgctgggctcatagtcagtggacttggggtacatgtgacccactgagacaccagctagggtggccaagggagtgcttgtgccagccttcccccaactccaggtaccacagctcacagctctgggaggagagggaagagtagggaggactttgtcttgcaatgtggatactagttcagccacagtaaaataaagcaccaagcatagttctgaagcctcaattctaggccatagctcccagatgacatttctagacatattctggaccagaagggaacccattgccttgaagggaaatacctagtcctagtaggattcaccaccagctgactaaagagcccttgtgccttgaataaaaaacaaggtgccatgtcgtattgtgccagcttcagatatgaccccgcacattcacagctgtggtgtccatggggagacccacctgcttgaggtgagagaagagtaaaaaggactttatcttgcaagtgggtgccagctcagccccagtacaataaagcagattcctaaagctcccgatcccaggccctggctcctgggcagcatttctagacacaccctgggccagaagggaacctgctgcactgaaagtaaagacccagttcttgcaggattcttcacctactgactaaagcacccttgggccttaaattaacatcagtggtggccagaaaatagctgccacaggccttgggtgagaccaagtacagttccagtgacggtggccatggcagtgcttgtgtcacccttccccaaactccaagcagctcagcacaaagagagactccatttgtttggagaaatgtaagaggacaagagactgcctggtaatacagggaattctcccagatcttccccaagactaccaaggtgatacctctacagagtcacaacattactagtcttggggtgccctctaatgcatgtatggctgcagtgagcgaagacttagatgacaacacttaattccctttgaatacttgaaaaaccttctcaagaagaatgggagccggatgcagtggctaacgcctgtaatcccaacactctgagaggccaaggcggacagatcacgaggttaggagttcgagaccagcctgaccaacatggtgaaacaccatatttactaaaaatacaaaaattagccaggcgtggtggcacgcacctgtaatcccagctactcaggaggctgaggcaggagaattgcttgaatccgggagacggaggttgcggtgagcaaagactgtgccactgcactccagcctgggcgacagagcgagactctgtctcaaaaacagaaaaaaaaaaaaaagaatgcgtacaaacaaaaccagactacaaagaacagaatacccaactcttcaatgcccagacactgatgaacatccacaagcatcaaggccatctgagaaaacatgacctcaccaaatgaactaaaaataaaggacaccagtgaccaattcccaagtgataagagatatgtgaactttcagacagaattcaagctgaatgctttgagaaagttcaacgaaatccaagataatacagagaacaaattcagaatcctataaatttaaaaaagagactgcaataattattagtaaaaagaatcaagcagaaatcccaaagtggaaaaattcaattgacaaactgaaaaatgcatcagtctctcaatagcagaaatgtatcaagcagcagaaaacattagtgagcttgaattcaggctatttgaaaataaacaaccaagttgggcacgatgactcacgcttataatcctagcactttaggatgccaaggcgggcggatcaccctgaggtcaggagctcaagaccagcctggcaaatatggcaaaaccccgtctttactaaaaatacaaaaagtagctgggcgtggtggcacatgcttgtaatcccagctacttgggaggctgaggcagaagaatcgcttgaacctgggagttggaggttgtagtgagccaagatggcaccactgcactccaggctggtaacagagcatgactctgtctcaaaaaaaaaaaaaaaaaaaaaaagttcttcaatctgcaagaaaaggatgttaacaaacaataataaatcacctgaaggtgcaaaaactcactggtaacaagtacacagaaaaatacagaatattgtaacactgtaattgtggtgtataaactactactcatattttgagcaggaagaataaaaaatgaacctttcaaaaataagaactacaattttttttttttttgtgagacagagtcttgctctgctgcccaggctggacggcagtggcgcgatctcggctaactgcaacctccgcctcccaggttcaagcgattctcctgcctcagcctcctgagtagctaggattacaggtgcgtgccaccacgcctggctaatttttgtatttttagtagagacagagtttcaccacgttggtcaggctggtctcgaactcctaaccttgtgattcgccccacctttgccttccaaagtgctgggattaggcgtgagccactaggccagggttttgttttgttttgtattgttttttgagacagtcttactctgttgcccagactggagtgcagtggcgcactctcggctcactgcaacctgggcctcctgggttcaagtgattctcctgcctcagcctccgagtagctgggattacaggcacccgccaccatgtccggctaatttttctatttttagtagagagggggttttgccatattggctaggctggtctcgaactcctgaccttaggtgatccgcccacctcagcctcccaaagtgctgggattacacacgtgaaccactgcgcctggcttataactacagttttttaagacatagtataataaagatataaataaaaacaacaaaagttaaaaagcgggcagatgaagtgtagagtttttattagttttctctttgcttgcttgtttttgcaatcaaagtttcaagttgtcattggtttaaaataatgggttataaaatgttatttgcaacccttatgtgatctcttttttttttttttttttgagacggagtctcactctgtcgcccaggctggggtgcagtggcacaatattgactcactgcaacctctgcctcctgggttcaagcaattctcctgcctcagcctcctgagtatctgagattacaggcacgtgcctccacgcctggctaagttttgtatttttagtagagatggggtttcaccatgttagccaggctggtctcaatctcctgacctcttgatccacccacctcggcctcccaaagtgctgggattacaggtgtgaaccactgcacccagctgtcatggtgatcttaaatcaaaaacacctacaacagatacacaaaaaatataaagcaggaaattaaaacataccaccagagaaaatcactttcaaaacaaggaagggagggagggaaaaaaggagcgaagaggaagtaaaaaagaagggggaagggagggagtaggactacaaaacaaccagataataagtaacaaaatggtagtagttaagtcctcactaatcagtaacaacactgaatgtaaatcgactaaactctccaatcaaaagatacagagtggctaaatggatttaaaaaaaaggctgggtgcggtggctcacgcctgtaatcccaggactttgggaggccaaggcaggcaaatcacctgaggttaggagttcaagaacagcctgacgaacatactgaaaccccatctctactgaaaatacaaaaaatttagctgggcttggtggcaggcgcctgtaatcccagctacttgggaggctgaggcaggagaatcgcttgaactcaggaggcggaggttgcagtgagctgagatagcgccattgccctccagcctgggcaacaatagcaaaactctgtctcaaaaaaaaaaaaaaaaaaaccaaagatccattgcctacaagaaacacactttacctataaaatcacacatagactaaaattgaagagctggaaaacaatattccatgcaaatggaaaccagaaaagaacaggagtagctatgcttagataaaatagattttgagacaaagtctataaaaacagacaaagaagattattgtataatgataaagggatcaattcggcaagaggttataacaagtataaatacatatgcaaccaatactggagcatccagatatataaagcaaacattattagagcaaaaaagagaaacagacctcagtaacagtcggaaacttcaacaccccactctcagcaatggacagatcattcagacagaaaatcaacaaagaaacattagacctaatttgctctatagaccaaataggcccaatacatatttacagaacattgtgtccaacagctatagaatacacattcttctcctcaacatatggattgctctcaaagatagaccctatgttaagccacaaaacaagtctaaagatttgacgtggcacagtggctcatgtctgtaatcccagcaccttgggaggccgaaataggtggattgcttgagctcaggagttcgaaacaaccctgggacacatcgcaaagccccatctctacaaaaaaaaaaaaaatccaaaaatatcagccatatgtgacggcatgtgcctgtagtcccagctacttggaaggctaaggtgggaggattgcttgagccaggaaggcggaggttgcaggtgagccaagatcatgacatgtactccagcctgggtaacagagtgagactctgttacaaacaaacaaacaaacaaacaaataaataaataaaaattcaaaaaagttaaaatcatatcaactatcttctctgatcacaataagataacactagaggccgggcacggtggctcatgcctgtaattccagcactttaggaggccaaggtgggtggatcatctgaggtcaggagttcgagatcagcttgaccaacatggtgaaaccccctctctactaaaaatacaaaaaaaaattagccaggagtggtggtacatgcctgtaatcccagctactcaggaggctgaggcagaagaatcacttgaactggggaggcagaggttgcagtaagccgagatcgcgccactacactccagcatgggtgacagagcgagactccatctcaaaaaaacaaaaataaaaataaaataaaataacactagataacaagaggaactttggaaagtatacaaatacatgaaaattaagcaatatgctcctgaatgaccagtgggtccatgaagaaattaagaagaaaactggaaaattccttgaaacaaatgaaaatggaaacacagcttatcaaaacctataggatacagtaaaagcaacaataagaggaatgtttacagcagtaagtgcctacatcaaaaaagtggaaaaacttcatctgccaatacatcctaaagaactagaaaagcaaggacaaaacctaaaatcagtagaagaaataaaaaaaatcaaagcagaaataaataaaattgaaatgaagaaaatacaaaagatcaataaaacagtaaattgttttgaagagataaacaaaactgacaaacctttagccagactcagaaaaaaaagagaaaacccaaataataaaatgagagatgaaaaaggagacattataattgttaccaccgaaattcaaaggatcattagagactactatgagcatctatatgctgatacattggaaaaccttgaagaaatggataaattcctagacacatacaacctaccaagactgaaccacaaagaaatccaaaacccaaatacaataacaagtaacgagaccaataacaagtaacgagatcaaagctataagaaatagtctcccagcaaagaaaagccatggacctgatggcttcactgctgaattctactaaacctttaaagaagaactaataccaatcctactcaaactattccaacacaatacaggaagagggaatacttctaaactcattctacaaggccactattaccctatacaaaaccaaaggacacatcaaaaagggaaaactagaagccagtgtctctgaagaacattatgcaaaaatcctcaatataatactagcaaaccgaattcagtaacacattaaaaagatcattcatcatgactaagtgggattcatcccagggatgcaaggatggttcgacatacgcaaatcaataaacatggtacatcttaacagaataaaagacaaagactaaaaaatatatatatatattatttatactgtgtatgatataaatatatatcacatgatataaatatataatttatatcacataaaatgccacatccccttatgattaaaacccttggccgggcgtggtggctcacgcctgtaatcccagcactttgggaggctgagacgggcagatcatgaggtcaggagttcgagaccatcctggctaacacggtgaaaccccgtctctactaaaaatacaaaaaattagccgggcgtgttagcggacacctgtagtcccagctactcgggaggctgaggcaggagaacggcatgaacccaggaggtggagcttgcagtgagccaacattgcgccactgcactccagcctgggtgacagagtgagactccatctcaaaaacaaacaaacaaaaaaaccccaaagaactgggtatagaaggaatatacctcaacaaaacagaagccatatatgacagacccataactagtaccatactgaaaagggaaaaactgaaaggctttcctctaagatctggaacaagacaaggatgcccactttcaccattgttattcaacataatactcggaagtcctaattggagcaatcagacaacagaaagaaataaaaagcatccacactggaatggaagaagtcaaattatccttgtttgcagataatatgatcttacatttggaaaaacctagactccaaaaaagaaaaacctattagaactgacaaacaaattcagtaaaattgcaggatacaaaaatcaacacacaaaaatcaggagcatttttatatttaacagcaaacaatctgaaaaattttttaaacgcaatcccatttacaatagctacaaatataataaaatacttaggaataaacttaaccaaatgagtaaaagatttctataatgacaactttaaaacactgaaattgatgacacagaaaaaacatgaaaagagattccatgtttatggattagaagaattaatattgctaaaatgttgataatactcaaagcaatctacagattcagtgcaatccctatcaaaataccaatgacattcctcacagaagtagacaaaaataattctaaaatttgtagggaaccacaaaaggcccaaaagagcaaaagccatactgagcaaaatgaacaaaacgggaggaatcattatctgacttcaaattattgtaaccaaaatggcatggtactggcataaaaaaagatatagatcaatgaaacagaacagagaactcagaaatgaatccatacgtctaagtgaactcattttccacaaagaagccatgaacatacactggggaaaggacagtctcttcaataaatggtgctgggaaaactggatatccatatgcagaagaatgaaaccagacccctgtgtcccaccatattaaaaaaaaatcaaatcaaaatggactaaagatttaaatctaagacctcaaactatgaaactactaaaagaaaacattaaactcccagggacattactctgggcaaagatttcttgagtaataccccaaaagtacaggcaaccaaagcaaagatggacaaatgggatcacatcaagttaaaaagcttctgcacagcaaaggaaaccatcaacaaagtgaagagacagcccacagaatgggagaaaatatttgcaaactactcatctgacaagggatcaataaccagaatataaaaggcactcaagcaactccatagggaaaattttagtaactcaattaaaaatgggcaaaagatctgaatagacatttctcaaaagacgacatacaggctgggcgcagcagctcacgcctgtaatcctagcactttgggaggctgaggcaggtaaatcacctgaggttaggagttcaagaccagcctgggcaacaaggagaaatcccgtctctactaaaaatacaaaaattaggcagacatggtggcaggaggcaggagaattgcttgaatccgggaggtgtagggcgcagtgagccaagatcacaccactacgctccagcctgggcaacaaagtgagactctgtctcaaaaacaaaacaaaacaaaaaaaaaaggaagacatacaaggccaggtgcagtggctcacaactataatttcagcattttgggaagccaaggtgggaggattgcttgagcccaggagttcgagaccagcctgggccaaacagcaagacctcatcgttatttatgaatggcaaacaggtatatgaaaggtattcaatactactgatcaccagaaaaatggaaattaaaactacaacaagatatcatctcaccccagttaaaatggcttttatccaaaagacaggcaataacaaatgctggtaacgatgtggataaaggggaaccttcacacactgttggtggacatgtaaattggtaaaaccactatggagaacagtatggaaattcctcaaaaaactaaaaatagagctaccatatgatccagcaattgcactgctaggtatatactcagaaaggaaatcagtttattgaaggaatatctgcactcccatgtttactacggcactatatacacaacagccaagatttggaatcaacctacgtgtccactgacagacaaatggagaaagaaaatgtggtatatatacacaatagattaccattcagccataaaaaagaatgagatcctgtcatttgcagcaatgtagatggcactggaggacattatgttaagtaaaataagccagggacagaaagataaactttgcatattcttactcgtttgcaggcactaaaaataaaaacaattgaacacatggagatagcagaatggttaccagaagttgggaagggtaatggggagaagaagggaaatgaggtgattagtgggtgcaaagaaaatttagaaagaacgaataagaactctgcaggaccggaggcagaaatgaaaaagatattaaaatgatttaaaataattttaaaggccgggcacggtggctcacgcctgcaaccccagcactttgggaggctgtggcagccggatcacaaggtcaagagatcaagaccatcccagccaacatagtgaaaccccgtctctactaaaaatacaaaaattagctgggcgtggtggcacgtgcctgtagttccagctagtcaggaggctgaggcaggagaatcacttgaaccctggaggcggaggttgcagtgagttgagactgcgccaccgcactccagcctggcgacagagtgagactccgtctaaaaataaataaataaaataagtttaaaatttaaaaagttaaataaagaatgaataagatctagtatttgacaacaaagcagggtgactacagtcagcattaatttgttgtactttttagaataactgagggagtacaattgcaacgttcattacacaaagaaatgatgaatgatgatggtgatggataccccatttaccctaatgtgattattacacattatatgcctttatctaaatatctcacagaccctatgaataatacgtctactatgtacccataaaaaaataaaaacctttaaagtagactgcaaaaccaaggaccatcaaaaagaacagaagacaaagatattagcaaaataagtgatgaggtttttaagtttgcagaccagaaaaaataaaatgctaccactggctgaagatgatttaagatggcatcctctacaaaagaaagaaaacaggaatggctgaaaaaagggggagcaagtacaagcaacaaaaacagaacctaagccacaggttaggacaacggacctaagccacagccccaggtggtgagaaacaagctaaagagaaacctacacagccaaaaaggttgccttaaaattagagagccaagatacctcttcagcctcagtataggcaaaccaatttcaatggtttcattaccaaggctcttggtgtcatggcaaacagcattatgcaactctggcgcatcgcaagctttactgcattaccaatatagctaaagagt

SEQ ID NO: 669 - DNA, 38619 bp, Human
aagcgctgggattagaggcgtgagccaccgcacccagccatcaaagatgtaaccttgaaacaaactgcagaagccttttcccttagccttaaaatggactccatgtccctcccttcttcaccgtataaactcccttcacatttatctaactgtatgcccgtgtctagttacgtgccttcttagaggttccagacgctaatcttgagacagacagaccaagcctggagattcttctgcaaaattccacatgtgacctcaaggcgtctaattaagaatccagccattgttgagatgatgccagaccacaggcttcctgtggactaggacccaagacagccaccggaacaagacaaacagacagtgtacttagcataatccttgcctgacttccacatcgttttcccgttttaaacccttgccttggccgggcgcggtggctcacgcctgtaatcccagcactttgggaggccgaggcaggcagatcacgaggtcaggagatcgagaccaacctggctaacacggtgaaaacccatctctacaaaaaacacaaaaaattagccgggtgtggtggcgtgcgcctgcagtcccagctactcgggaggctgaggcaggagaatggtgtgaacccagaaggcggagcttgcagtgagcggagatcacaccactgcactccagcctgggtgacggagactctgtctcaaataaataaataaataaataaataaataaataaataaataaataaaataaataacccttgcctttcccactccccataccccacaattcaacgtgattgctttggggataggaatccaaccacttccccttgctagctttggaaataaagtcactttctttccaccacatcttgctcttgttagactctgcaagcagccagcgactgaaccagcattcggttacatcccctgaggcggatgacacttgtgtgatcctgtaaccgatttcttgttagaatgttggcatctttcacccagtcgttttcttgtaattttatttatttgtttgaaaacagaatccttcttgcaatcctgtcattttcagtgccttttttttttttttttttttttttttttttttttttttttgagacggagtctcggtctgtcacccaggccggggtgcagtggcgcaatctccgctcactacaacctccgcctcccgggttcaagtgattctcctgtcttagccctccaagtagctgggattacaggcgccggccaccacgcctgactaatttttgtatttttagtagagacgggtttcagccatattggccaggctggtctccaactcctggcctcatgtgatccgcccacctcggcctcctaaagtgctgagattacaggcgtgagccaccgcgcctggcatcagtgcatactttttgaagtgattccaagttatcgcccgcttttttcgtgtaacatataaatacatctctgtatctagaaatatccaatgcataattcaattgtctgcgaggtatttcatcacgtattttcacgagcgtggccaatttcaaaatagttctacaaagaggaaatgcaagaatgtgggaagagcaaaagaaaagctctatgttgcaaaacccatttttgctaacgtgtccagtgggctcccgggacgacctgtttttaaattcttggtctccctgcaccgcgtccctcctttgctgcgctagctttatgacgcatcttggaagaacagggcagatttaaaaccctctcccaacaggcgtcaaacgacatggtgcaggctcgggctggggagcgggcctgcggctgcccagctgctaaaggacttcctactcgtgcaccgccgccggctccagggcaaaccccacgccatttagaaatgctggaagtttctgtctctccctccccctgctcggaggccattccccccacccccagagccccacctcctccttcactgggccctttctaactccttccccttaaaacccttttcaaaatggggttgactggaggcggaggttgcagtgagccgagatcgccccactgcactccagcctggtgactccgtctcaaaaaaaaggggaggggggcgggggagagttgaaagcttaatatgtactttgggggctattaaagcaaacatttcgactaaaggggcgaatcctcgaattgtgcgatcaagcacccgagaggagagttggggggggtcaggaggggtgggggctccagggaaagcccgggggtctgggccggggtctcgcggggcccttccggaaggatcgcggcccccgaaggtgggcgtcccgcggggctccagtctccaggacgttccgggaggctccgcgctctgggaggccggctgcgtggggtccccgcgctgcagccgcagaggccccccagggccgcggttcccggagcgggaaagtcccgcgcgggggcggtggcctcgggggcgggacggggcgggggcgggggcgcgggcggccgagccgaatcccctccaccgggacgccccgctgctgctcgggaagaggcgggccctgcgcgccctgcgctcgccatggcggtttgggcggcgacgtgagcggctccgcggaccccgagcggggccccggccgcgacctgagccgccgccgagcgcccggggccatgcgaccgacgctgctgtggtcgctgctgctgctgctcggagtcttcgccgccgccgccgcggccccgccaggtgagccgggcctgggcctccgcggcgggacgcgggcgcagccgcagcatgtgggggctgggggactcccggatcgtggggtggggggaatctgccgggtgctcagagtgggtgggaatctgcggggtgctcctggtgggtgggatatgcggagtgctcagatcaggtgggaacctgcgggtgccccaggtgggggtcttgcggggtgcccagggctagaggggcccgctgggagcccgcagcggggctgggatgggcggccaggagttccagacaggagctgggcagcagcaggaagacggggggcacccctcctggcgtcctggccgccgggacacccctctccgggagaggacactcggtgcccctccgtgaagccggtaacctcggctgcgccacctcccccacccgcgcgcccgcgccgggaaagccagcgtggccccagtctccgaatttctcggaatgaacaacagcaaattgaatccagggctccggcgggggccgcctttgctggccactggttctgcagcctggcgagactgcgcttagtccccgcctggagtgcctcccgaaggcctggctggaagctagactcagtccctttgtagtagcagcggtggagcagggaccagcgtcttggacgggtgacccagactcaattccgactttggccgagggcatgtttgacactgggtgtgaaatctagacagttcccgcggtcatagagatggggcagcagcattcaggcagggctcagaactgtccgggtcccatcagtgttggggcggaagaggaagagtgtcaactgagccaggcatttatttattttattgttgtttgagacagggtgtcgctctgtcgcccaggctggagtgcagtgggcagcatctcagctactgcagcctccgcctcccgtgctcaagcgatcctcccacgtcagcctcccaagaaggtggtattattggccacgcctggccaatttttgtattttttgtagagaggaggtctcactgtgttgcccaggctgttcttgtactcctgagctccagcaatccacccgccttggcctctgaaagcgctgggattacaggcttgaggcaccgtgcccagctgagccaggcttttaaaaccggttctgtccctacccagagagcttcttacctggcggcctccttaacctctgacaccagctgaccacgcttatgagccaaacataaaaaccaaaagaaacccaggcttggtggctcacgcctgtaatcccagcactttgggaggctgaggcagcatcatgaggtcaggagttcgagaccagcttgaccaacatggtgaaacccccgtctgtgctaaaaatacatagctgggcgtggtagcgcccgcctgtaatcccaactactcaggaggccgaggcgggagaatcacttgaacccgagagctgagatctcaccactgcactcccgcctgggcgacagagcaagactctgtctcagaaaaaaaaaaaaaaaaaaaagaaaaagaggaaaagaccttaatgacaaatgtgtggctagaacattcttgtgtatgtatctgcttttgttttgctgggttctttcccctggggagagtgatatcataggagtctcgagaatttagaagattcttcccattcgaagctataaccttgtgttgtgggtttgttttttctaccggcattccttgcaaaggcccataagttccgtatctccttgatctggggtgccttgcacttgaggaaattattaactgcttttccatgggagtcagacagatgggttcaaatcctgactctgcttccacttggcttcacgtcttgagcaatctgcatatgcctcctccctaggcctcctcctaatgagagttgatgattgtcctagtgtgggatcagcaggcgagtgacttcatgccagagaggagtgactagtggtgatctgtggactgtttgtgacttacctgtgatgagtccagaggttgaaagatgtatttagaaactatagtctgacattgccacaacatccagctacctgtccatcttgttaatgattaactttaattgtattctacaaaagttttggtctatgtgatatgttgcaaaataaaaaaattttaaaaagtgaggccaggctcggtggctcacacctgtaatcccagcactttgggaggctgaggcgggcggatcacctgaggtcaggagttcaagaccaggctggtcaacaatgatgaaaccccgtctctaccaaaaatacaaaaattagggggcgtgatggtacacacctgtgtcccagctactcaggaggctgaagccgaagaatcacttaaactcaggaggcagaggtgcagtaagctgagatcacaccactgcactccagcctgggcgacaagagcaagactctatctcaaaaaaacaaaaacaaacaaataaaaaaactggctccattgatcctttgaaaagtagtagcagctgggcacggtggctcatgcctgtaatcccattactttgggaggcagaggtgagcagatcacctgaggtcagaagttccagagaccagtgtggccaacatgttaaaaaccccttctttactaaaactacgaaaattacccgggcgtggtggttggcgcctgtaatcccagctacctgggaggctgaggcaggagaatcacttgaacctgggaggggaggttgcagtgagccgaaatcatgcaactgcactccagcctgggtgacagagcaagactctgtctcaaaaaaagaaaaaaaaagaaaagaaaagtagtgtagtgctttaaactaatctctattttgcaactatttgaacattttcacattaaacagcttaaaaacaaacctaatggatatcttcaaaagaaacactcttttagtcaaaacacaaagtgaaaatattcacaatgattatatggcaaatgggtggtagaaaggttttcacactttcccataacttaccggtgtaattttgaaattgcttttatggtcagagaaaaaaaaaagtgttggaaactttttttttttttttttgagatagtatctctctccatcgcccaggctgcagtgcagtggcatgatcacagctcactgcagtctcaacctcttgggctcaagccatccacccacctcagcctcctgagtagctgggactacacgtgcacgccatcatacctggctaatttttgtatttttttgtagagatgaggtttcaccgtgtttcccaggctggttttgaactcctggggtcaagagatccacccgcctcagcctcccaaagtgctaggattatagatgtgaaccacccagcctggctccggaaacagattttttaaagggagacatagtatctatcccttagagttctgtaagagtagaatatgtaaaatatgggacctgtggcaatttgtagccatgagctgttaagtagtggccgtttgcgctagatagaaaaatgtaaccaacagcacaagtgcagtaaatcaactgaccagttagttacctgagtgttgaggaattaaggcttctatttgtaattgtagcaggtgctgctgactttttcaggggattggatatgtactgtgccacagaattttttatcattatttgctgacttgaacagccagagcttctcatatgcttagagaccaccgagaaagacagtaagtccccagcaacttaaaaaccattgcatgtgaatgtccactgggtaagctcctgagtgttcataatctcagcaagtgaaaatatcatgtagctggaatgcttttgccacctttataaacgatcatgatagtaacatttattggtcagacgagatgccaagtgctttatatacattacctctcttaattttctcagccattctttcgaactaggttatatctctagtttacttcctggaaagtcaaacctttcttgataggaagagccaaataatctaggtcaataacttgatgtccagttgttgttgttgtttttgagacggagtctcgccctgatgcccaggtgggaatgcagtggcgctatctcggctcactgcaacctctatctcccaggttcaagcgattctcctgtctcagcctcccaagtagctgggactataggcacctgccaccatgctttgctaatttttatatttttagtagggacggggtttcaccacgttggctaggctggtctcgaactcctgacctcaagtgatccccaccgcacccccccccgccaacccccgccagcctcagcctcccaaagtgttgggattacaggcatgagctaccatgcctggcctagtatttcttgaagagaacaatttcctggttatggctgaggaatcagaaaatgcctttttatttctcatctgcaaggtgatggaggtgggatcaatgatgttcacctaattgactttcatcataatgtccccgcccccaatagaaagatcctaaagggtcagtccttaattatcaagattaaatgattaatgttaattatattttattttattatctgtgtgtgataagtgttaatcaaactatgctgttaagacccaggatatcctcctattctttttgtttgtttgtttgatatggagttttgctcttgttgcccagctggagtgcagtggcatggtcttgactcactgcaacctccacctcccgggttcaagtgattctcctgcctcagcctcccaagtaactgtgattacagtatgcaccaccgcacctggctaatttttgtatttttagtagagacagggtttcaccacgttggtcaggctggtctcgaactcctgaccttaagtgatctgcctgcctcaacctcccaaagtgctgggattacaggcatgagccaccgcacccagcccctcctattcctaaatatgcataaagtctgaaatgcctggatctgggataggtagatcaaaggtgttgggatgggtcaggaaggcagagttgttcattcacctcttcactggttgttaaatggtcctagtgtttggccctgagtgtataaaaatgattaagacaatgaatgtagagaatagtctacttagagaccttgtcagaatgtctgtattaccatgtgtactataatagatacacatacactatgtgccatgatttttcaaaagtgctagaatagaaatatttttaaatgttataggacactacttgccaggaagagttgaagaaagtccaatagaggaagaacaaactgagctgggttttgaagcatggagtttcagattaaagaaaagaagaaaaggccaggtgtggtggctcacgcctgtaatcccagcactttgggaggccgaggcaggtggatcactaggtcaggagttcgagaccagcctggccaagatggtgaaacgctgtctctactaaaaatacaaaaattagctgggcacagtggcgggtgcctgtaatcccagctactcaggaggctgaggcaggagaatcgcttgaacccaggaagtggaggttacagtgagcctagatcgtgccactacactctagcctgggtgacagaacaagactgtctcaaaaaaaaaagaggccgggctcagtggctcacacctgtaatcccagcactgtgggaggccaaggcaggcagatcaggaggtcaggagatcaagaccatcctggctaataatggtgaaacctcgtctctcctaaaagcacaaaaaaatagccaggcgtggtagcaggtgcctgtaatcccagctactcgggaggctgaggcaggagaattgcttgaacctgggaggtggaggttgcagtaagccgagatcacgccactgcgacactgcactccagcctgggggacagagtgagactctgtctcaaaagaaaaaaagaaaaagcaatatgcaaaattatgtaggtccaaaataaaataggatagagtttatggtattttagcgagtggtggtgattggtctgggataagatcttgaaggattttcagcttactcaagtctgaactctaccctccatgccaggaatcggcaaagtttttctgtaaagaactagacagtatgcactcagatggttacagaagtttgattaaatggctgatttctgaattaggtatggcgcttgagactctgcctagggagagtgctcaggtcatgcttatatgtgaaaatgtgtcgttattttttcctcttgctctcacacatgtcccttggtttcctaagtgaggttttgaaaatgaaattttgacagttgagccaaaatgccctctataagcacgtgtatttccttctttaaagaattccctctcaggaattccctctctaatgtattgtaagatttggggttcgaccattaacgcattagtccagttcaataagcttcatttttttttgttggtagcagggtccattttatgggcgaacataccagtaagttccttgccttcggggaagtttaagtttattaaaagcagttacagatatattacagatgtattatacaggaggttctcaagaggcaagaaggttcagcaagttcattgtcttaattacaataattttttttttttttttttgagacagagtctctctctgtcacccaagctggagtgcagtggtgcaatctcggctcactgcagcctccacctcccaggttcaagtaaattctctggctcagcctcccaagtagcttgaattacaggcacccaccaccatgcctggctaatttttatatttttagtaaagatggggtttcaccatcttggccaggctggtcttgaactcctgacctcatgatccacccaccttggcctcccaaagtgctgagattacaggcgtgagccactgcggccagcctacaacaatttttttttttttgagacagagtctcgctcttgtcgcccaagctggagtgcagtggcgtgatctcagctcattgcaacctccactgccgggttcaaatgattcttgtgcttcagcctcccaagtagctggaaatgcaggtgtgcaccactatgcctggctaattgttgtatttttagtagagacggggtttcaccatgttggccaggctggtttcaaactcccaaactcaggtgatccgcccacctcagcctccctaagtgctgggattacaggcgtgagccaccacgcccatccaattagaataactttttacatgttgtatttttaaaattcataactcataatctaaaatttatgctcagcacagctaactttggagacctaccaagaatggtgcaatgattcagcagctactcatggtaagacaagagtatctgggtgtaacctgtatgaaacctgcatctcacaaccactgctccttctccccagccttccagccctggtgtttcccatcgggggccatgtggcctggaacacagaggctgggctgcccaaggacaggccccctggcctacaaaaaggacagtcttatcacagatgtgcaatccttggcacttccctgtggcgtctgcagttctgagactgattttcttctataaatgtgaaaagataggggatgataggaaacccggatataaggcagaacaatgttgcttgggccatctcttacacctcagtgaaacggaaaatgaaggaaatggaaggctggcatgggaaccccgacttatacagtgatgcccttttgctgttccacgcgtcgcttggggtggaagcccttccttgtcccctcgccacccaccccggagccccttggtgcttcctttctgaactgaatgcttagactggggaactagaggtgcccggaaagggaagtcgggaagaagagactattcctgttggttcctccccagagatgggagatggtgaacaggcgtgtggagggcggaataatggtccccaaagatgtccacgccctcatcctcagagtccgtgaacctgggaatgtgctgcctgacgtacaaaagggactccgcagatgtgagtaagttaagagccctgatgtggggagattgtcttgcattgttgggccaagtggccttataccaccacagggtccccaaaagatggagcagaggcagaaggttcagtaccagggagacaagaaggatgcggccaaccttgctggaggaaggtgccctgagccaaagaatgggagtggcctctagaagctgggaaaggcaaggaaatggattctccctggaggctcgagaaggaccccagccctgctgataacttgactttagtcagtgagactgactttaaacttctgaccagcagaactataagaaaataaatttagatgtgattttttaaaatttatttatttttagagatggggggatctcgctatgttggccaggctagagtgcaatgattattcacaggcatgatcatagcacatgcactacagcctcgaactcctgggctccagtgatcctcccgcctcagccccttgagcagctgggactacaggtgcgcaccaccacgcccagctaaatctgggttgtgtggagtcactaggttagtgataatgtgttacagtgataagaagaacctaatacaggaaataaaaggagttgtcagattctttgaatgcccaaccctaagcagacactcaccctgttcctggaaagagccgggtccagctgcgttttctcatggcccaataacaagaagcagacaaactaggaagaaagagaatttattgctgtaacaggaaggtcggagataatccgaccagaccaactcaaagtgtttgattttctttgtgcttacataggtttgggttatgtgcctatgtgtggtattgcactaagtctatgagtaactaattttgtttcaactagaaagtcagaggccaaaaatgtgctttctaagtctaatcaagctgtgaggtccccgataccgtcaaggcctgtctcctaaattctatttaatgaggactgtggtaccagagcatttatttatttatttatttttgagacggagtgccgctctgtcgcccaggctggagcgcagtggtgcaatcttggcttgctgcaacctccgcctcccgggttcaagcgattctcctgcctcagcctcccaggtcgctgggactacaggtgtgtgccaccatgcctggctaatttttctatttttagtagagacagggtttcaccatgttggccaggctggcctcgaactcctgacctcaggtgatccaccacctcagcgtcccaaagtgctgggatttcaggcatgagccactgtgcccggccaggagtttatttctatcttgtctcatttacagtttggtccggagagctgccttagactctccaataaatctattcaaacagctgcctctgttatcttgacttgctccaggtttggaagaagcctgtgtaggatctgtgtttcatttctggctttgatgtctgggcgtcagtttccctggggttaattattagcttaatgtgaaggcagcattgtggaaatttctctgcatagttcggatgctattcagatctgtctgtgtgactgtcatgcaggcctctctgtgtgactgtgagggagcattgacctgccaccacccccctctggaagcatccagtccccaactggctttgggcattgctaggtcatagcagccacagcacacctggtgggcctgcctcttgccacgcagctttacctgtctgccttcggcccaggatgtcatgaggcctgctgtgtgtcaggagaagtgttgttagctggttgggtgaaggtcacccagagctcataggtgtggaggggaggggcatcctataactaaacaaatggccgcagacttggcaattcatctttcagaagaagagccagtggtcaggctgtcagctgatctctttgaggttgagcgcatttaccgaaaatgtgtggcttgaatttcctgctttgaattttggaacagcatgtttttcaaacctttcttccaccttctgggcatttcttattaatctttttggtcaaaagccttatcttgattatgttttctttctaagacaaagggctccctgtgaagtacctgcttgggaaagggaggagttgtggcagtttcttctaggtccccgaaggctccctgtgaagtacctgcttggggaagggagaggttgtggttgtttcttccaggtcaccccaaagagagggattctgatattggtggtgtttccgggggagtatattctttctctgtttattgccccctaacctttttttttttttttttttttttggagacagagtctctctctgtcgcccagactggagtgcaatggtgcgatctcagctccctgcaacctctgcctcctgggttcaagcgattctcctgcctcagcctcctgagtagctgggattacaggcgctcaccaccgcacctggctaacttttatatttttagtagagacagagttttgccatgttggccacactggtctcaaactcctgacctcgagtgatctgccttccttggcctcccacagtgctgggattataggtgtgagccactgagctcgggccgtgttgtcctctaactttaatgtgtgtgagaagcagctggaaagcttgtttaaaatgcagatttcctgggggcctcaggacctgcactttaaccagcacccctgtgattgcgatgctgggggtccttgagagacgacaactctgatggtgcccagaagtcggcgttccttgccctcccctgcagcttgggctttgcgtacctgatttaggatgtttgtgtgtttttgcgtgtgtagtgtgtgcacgtgtgcacgtatttgcggacatttaccagacacttccttggtactaaatctgaaagctaacgcgtgtcacatgatcaccacgttaatcttcgccacagccctgtgggtgtatcattattgaccccttattcctgaaaaagaaaactcaagctcagacaggtgaagtgacctgccccgagcctaatgcagttactaatggtagaactgggaccccagtccggccagactccagggcccaggacctgttcgtaacaactgggacctgcaggtggaaaggctgccccaggcgcctcttttctttttgtgctgcctgtaccagtagggccatctttgtagccaaaagtcgggggtgtggggccatgcccagggggacctggtaatgccatttctgcactttgacaaaaactgagttgtatgaatgacttagataatggacattgaaacatttttgtaattatttccctctctctcctcccttcctccctcttctttttctctgtccccctcaagaccctctttcccagctgcccgctcctcagcacccgaagattcgcctgtacaacgcagagcaggtcctgagttgggagccagtggccctgagcaatagcacgaggcctgttgtctaccaagtgcagtttaaatagtaagccggtatttctgttggatccttgctgggagctgtgggggcatcgtgcggaaccctggggccacatactagtccctgcctctgtgcagggtttgttatcaaacccgtgggaaacacatcgttcttggagcttgtaaaatctctgaggacagaggtttcacagcctcccactcatctgaaggcttaaactacactggcagtcaggactccgctgtctaaccacacgggttcttgctttggtggaaagttcattctttcgctggtttcaggagaaaggttgtaaaaataggcttccaccatggaagaacaggaggcagcttttagtcttcatcttcgggcttaaaaatcggattgatttaaccttatagaccaaatatggcctgatcagaaatttgtttggttaattacaatgaattctgagtttctcaactggttttccattttgcatattatcctggctctttcatctgtctcttgcctcttcaagcttttgcagaattggccatcacttgatttgcaatataaatacatatagaaagagggcaaagtccacatcctttgttattttttgtttacgttgttaagtaggttaattgaagagtaaggtgaagttattggctaagtcattttgtactatttggtaaaccaaatgtaaagacatgatgatgtccagtgcttgtgagatgggactggttcatatgtgttcacctgatgctgtttgcagaatcaattagcatagccctttcaaagaggaattctaccagacatttgaagtcatggaaatgtccatagtagttttccaatgtgtgtgtgtgtgtgcacgtgtgcatgtgtgtctgtttgttgttgttgttttgaaacagagtttccctctatcgcccaggctggagggcaatggcatgatctcagctcactgcaacttccacctcctgggttcaagtgattctcatgcctcctgagtagctgggactacaggcatgagctaccatggctggctaataggtatatttttagtagagatggggttttgccatgttggccaggctggtctcaaattcctggccccatcctcaagtgatttgcccgcctgggcctcccaaagtgctgggattgcaggcatgagccaccgtgcccagccttcatagtagttttatcctacacagataattcaaccccccatcaaaaaaaagagagacaaaaactataatcatgaagagatacatggaagtgtatattcatatccatcagtaggaaagtgaccaattttagcctgctaacttacgcttgaacactaaaccacagacagccaatagaaaggataattagatgtcatctggtagaaattgcaactctgtaaactttggcatgtatttgtattttttatttcttatttttgttacttaaaaaaattttttattcacttttatactgaaaagttgcaagtggtatgtatttattgtcaagaatagaaaggggccgatcatggtggctcacacctgtaaaagaatagaaaagtaggccaggcatggtggctcacgcctgtaatcccagcactttgggaggccaagacgggcggatcacgcggtgaggagatcgagaccatcctggctaacacgctgaaaccctgtctctactaaaaatacaaaaaattagctgggtgtagtggcgggcgcctgtagtcccagctacttgggaggctgaggcaggagaatggcgtgaacccgggaggcagagcttgcagtgaaccgagatcgtgccactgcactccaggctgggcgacagagcgagactccatctcaaaaaaaaaaaaaaaagaatagaaaagtaatgtggaaaaatgacaggcaattgatttgttagaggagtaggtttccaggtaacttgtttttctttttctttttctttttttttttttttttgagacaaagtctccgtcacccaggctgaaatgcagtggcacgatcttggctcactggacctccgcctcccaggttcaagcaattcttatacctcagccttctgtgtagctgggattacaagtgtgcaccaccccacccggttcagataacttcttttttttttttctgagacaaggtctcactctgccccccaggctggagtgcagtggcatgatcatggctcaatgcagccacaatttcctggctcaagagatcctcctacttcagcctcccaagtagctgggactatgggcgcacactgctgtacccagctaatttttaattttttgaagagatggggttttgccatgttgcccaggctggcctcgaactcctgggctcaagtgatccacccacctcaacctcccaaagtgctgggattacagacatgagccatcacactggcgtttcttatttgtttttaaatgtccgttgtaacagtatttgcttaatagaaacaggtgctaaactgaggtttgagagttatctctaaatcacattgatctgttcctccagtagttataaattacgaacattaagttacctgtaattaatggagcaatccaccagagcaggctacacaatttgcaagacccagtgcaaaatgaaaatgtgagaccctttatttaaaaagtattaagaatttcaagatggcaaccgcagagcatcaaatgaagtgcctttctgagaacgggcttgatgtgagcgcacaggtcacatgtcaggaagttggccctaccctcagcattcagcaaacattacaccctagagctaaacaagaagcttgttgtgagagtcacggctgatgtattgacttaggcttgatgctgatttatgggctccttggccttgaacaaggaagtacgtttactgattttcagaggagatgcttctaaaaatgggataaaacgttattgcattaaaaaaaaaaacctttgatagagtttcatttgataaactaacctgtttcactttgtcttcttttcaaaaagcattttatagatattttctcagggataaaggttggttttattttttatttatttatttatttattttgagacagagtctcgctctgtcatccaggctggagtgcagtggcgtgatctcagctgactgcaactttcggctcattgcaacctgcggctcactgcagcctccgcctcgtgggttcaagcgattctcctgcctcagactcctgagtagctgggattacaggcacccaccactacgcccggctgatttttatatttttagtagagacagcttttcaccatgttggccaggctggtctcgaactcctgacctcaggtgatccgcccacctagcctcccaaagtgctggaattataggtgtaagccatcacgcccagcctagaggttggttttagtaaaagaaacataggttagggtacatgtgaatattcctgttagaaaaaggtgaaatcggggatgatttctttttctttttcagtttgtagatttgataatggaagagggcctttgcatttgtttttagatactttgttttagatacaaacatgtgtttgggactttttattagttttgaggcttgtgagacttaaatttccaccgtgtttctctacaataaagcattgctatgattaaaaatgaagatgcctttgttttttgacagagtatcaagaccaaaattacatggagcacttgatgggagaatttcaagtctaaatcatgggtagcagacagtggctgcaggctatttggctcccagtgtttaattttttttttcttcaatttgttgccaacattaagaaatctggacttttcacttagaaaaaaataataataaataacaggaaaaaaaaccaatcctgatgtcagttttccttgaaaatgcagacagtcgggcagcaaggccccttccagatcacgcctcctggtctactgccagcccctctctcagacctgcccagccctgtcttctcaaacatttgtttttcattttcttctgattttaatagcaatccatgttctttatagaaaatctggacaatctagaaaagtagaagaaaataaaataacctgttgttctacactctaagaataatcactattctcattttattttactttttattttatcttatttatttatttatttgagacagagtcttactctgttgcccaggctggactgcagtggcgtgatctcagctcactgaaacctccgccgcctgggttcaagtgattgtcctgcctcagccttccaagtagctgggattacaggcgcccgccaccatgcctggctaatttttttgtatttttagtagagatgcagtttcaccatgttagctaggctggtttcgaactcctcacctgaagtgatctgcccgcctcagcctcccaaagtgctgggattacaggtgtgagccactgcacccagccattattctcattttagacttttttttctaaattcgttctcttgtttgaaaattgtgtgtgtgtgtgtgtgtgtgtaaaccaaaccagactggggtcacacttctggggtctatttccttttttattttaacttgatgtagttaaatgtgagcattttttcatgtaattatttctgtgtggacattgtatgtttcattatgtgacatatcacatgtgttgtatttaacttttccccagtcatgggcgtagacagttggcagcttgtgcctgtcctaagtcatgacctcgtacatgaatcatatctggttattttcttacacttctagaagagaggttgctgggtcaaaggggatggacttacttaatgtttttgtgagtgacctcacaaaggctggacatagctcttgagtcccagggacaggctgagccccggcagtggcaggggtttgggggagcaggccctgcactgcatttgaggaagagccgtgcatgttgctcttggaggaggaggagcggggcggttagagggtctttaggtatctgtctaccttgaaaaagaaatcactcacctcttccagagcacgcccctcacccccgacctgagaggagaggctcgtggtttgcgatccctctccccattagggtctgtcaccctggggctgagtagtaggtatctatggcgggtgtcttcatggaagccctggccacgcatcttgaagtggctttcatcttgtcccttgcaacttaagcggaagatgcatcttggagagggtcggaggtacagttagaagcatgtgtggtacgtgaaagccggtggtcgtggggatacagagcggtctccagtctcgtctcctgtctcccatggccttgctttctgggccatagttgctgttgtagggggatactgtccgctgcccctactcaggctcccagcagccacctccttggcctttctgaagtctgtcacctaaggcaaagaggtcagagctggggactagagtcccacgtgggagtgtggcattgggactctgggaaaggcactgtcattcacaaggatgtgtggccatgtatttggcaaggttttcatatgggtgagacaaatcctctttgaatgggcagctatgggtggaaagaaactccgcaccagcaggaagcaggactggagtttgtattaacacagttccattcccaaaacataggctacagagactgagtttgaagtattaaaatcagttatgggatggaatgggagaaaatatttgcaaatcatctatctgacaagggacttgtatccagaatagataacgaactcttacaattcaacaattagaagacaaataacccaattaaaaaccacagctgggcacaagggatcacacctgtaatcccagcactttgggaggccaaggcaggaggattacttgagtctaggagttcaagaccagcctgggcaacaaggagagacccccaactctacaaagaaattaaaaataaaaataacagtagcagccaagcacagtggctcacgcttgtaatttcagcactttgggaggccgaggtgggcggatcacatgaggccaggagtttgagaccagcctgaccaacatagtaaaaccccgtttctactaaaaatataaaaattaaccaggcatgatggtgcatgcctgtaatcccagcacattgggaggccaaggcaggtggatcacttgaggtcaggagtttgagaccagcctggccaacatggtgacaccccatctctactaaaaatacaaaaattacctgggtgtggtggctcacacctgtagttccagctactcgggaggctgaggcacaagaatcacttgaacccaggaggtggaggttgctgtgagccaagattgcgctactgcactccagcctgggtgacagagcaaaactccatctcaaaaaaaaaaaaaaaaaaagcgggggggaactgtatggtacatataaattgtatctcaataaacctgcgttttgaacaaaagctctggggaaactattacacatgaaacagagaattctgtgaattgaaatccttttttccttcccagcaccgacagtaaatggttcacggccgacatcatgtccataggggtgaattgtacacagatcacagcaacagagtgtgacttcactgccgccagtccctcagcaggcttcccaatggatttcaatgtcactctacgccttcgagctgagctgggagcactccattctgcctgggtgacaatgccttggtttcaacactatcggaatggtaagagaacttgagtatagaacttcctttatactttccaggttttcttcacttgcggtatcgactccacacacctctgtcctgcctgtcaccctaaatgaccagcagacaaatgggtaggacagtcaaacccacactctgaccttggaggctgatgctaagggagtgtgatttgctaaaccaggggttggccaactacagcctgcaggccaaatcgggcccaccacttgtttttgtaaataaagttttattggaacacacagttacatccatcttttattgtgtctatgactgctttcacactacaatggtagagtagttgcaatagcagctgttgagcctgcaaagtctaaatttactgtggctctttactgaaaaagtttgccaacctcatgctagaagggatgctagcatatctctctgatcacccttacttattctggtgcaacttcttttgtgttgcagaataggcaccttgaatggtgcctggcatgtagtaggtattcagtaaatatttgttgaatgactgagtgaacaaatatgtccccagatattggaaggagacagaagaaccctcagattccagttcctacatttgttcctccagtaattcatttgtcacgtagtcagccatgccagatgtttcttccgtgtctggtttatgcacacacagggcatgaaacttacatggatcttgatttagacaaactaatgtataagacaattgaaatgtgatcaccgtctagatatttgatatataatgaacaattttattgttgacttattttcagtgttataatggtgttttggttatgatttttaaaggaggaggaggtctggttaagatgttaaagtttatgttatgtgtattttaccacaataaaaaattgggggaataaaaagagttcctgctgggcgcggtggctcacgcctataatcccagcactttgggaggccgaggcaggcagatcacttgaggtcaggagttcgagaccagcctggccaacatggtgaaaccccatctctactaaaaacacaaaaattagctggatgtggtggtgcatacctgtaatcccagctacttgggaagctgaggtaggagaatcgcttgaaccggggaggcagaggttgtggtgagctgagattgcaccattgcactccagcctgggcaacaagagtgaaactccatctcaaaaaaaaaaaaaaaaaaaaaaaaagcaaaataatccaaagaacaggagggacaaggacaaagcttccaggcatagaagaaacaaaattggccataagttgacagttgattcagttgggtaattagtacatgagtgtttgttaatgatcttccctctactttttttttttttttttttttgagacggagtctctctctcttgcccaggctggagtgcagtggcgcaatcttggctcactgcaagctccacctcccaggttcacgccattctcctgcctcagcctcccgagtagctgggactacaggcgcccgccaccacacccggctaattttttgtatttttagtagagatggggtttcaccatgttagccaggatggtcttgaactcctgaccttgtgatccgcccgcctcggcctcccaaagtgctgggattacaggcgtgagccaccgcacccagcctatcttctctctactttctatgtgtttgaaattttctgtaataaaaagtttttttttgttgttgttgtttttgaggtggagtcttgcactgtcgcccaggctggcgtgcagtggtgcagtctcggctcactgcaacctctgcctcctgggttcaagtgattctccctcccgggttcaagtgagcctcccaagtagctgggactacaggtgcacgccactatgcccgtctaattttttgtatttttagtagagacgggatttcaccatgttgtccaggctggcctctaactcctgacctcgtgatccgcccatctcagcctcccaaagtgctaggattacaggcgtgagagccaccgtgcccggccaataaaaagttttttagagaggatcatgcctgtaatcttagcccattgggaggctgaggtgggaggatcgcttgagctcaggagttcaagatgagcctggggaatatagcaagaccccatctctatttttttttttttttaatcagtggtttgtgctaggtactgtgagggacagaaacagagaagacagggcaatcctgccagctcctcgtctgctgtggacaagccatttgtccttgggtgccaaaccaccctccatttgagctataaagtgtcaaataagtgggaattaggagtatgcaaacaagtaatgatggctgggcgcagtggctcacccctgcaatcccagcactttgggaagctgaggcaggcagatcatctgtggtcaggagttcaagaccagtctggccaacatggtgaaaccccatctctactaaaaatacaaaagttagccgggtatgatggcacacgactgtaatcccagctacttggaaggctgaggcaggagaatctcttgaacctgggaggtggaggttgcagtgggccaagatgacaccattgcacatcagcctgggtgacagagcgaggctctgtcatttaaaaaaaaaaaggaatgatacttaccgccactgcccagggatcaagagaaggtaacagaagcaggatgtatcgtgacagtgggtccggtgccagccagctgccgcttccggccggagtcaagcacccatgtttctgttagttactggctgggttgctgttctctgccctcgtgcttgaaaagcttgacacagtggtggtctcatgtcacatctgccactttcacctctgctggtggcgttagaatcagtaatggatatggaggtggtttaccaagcagaggagtgagatggtggttggagggggcaggctttagcatcaccctcacctgggttcatatcccaactctgccatttattggctgtgttactgtgggcaagtagtgtcacctcctggcttccgtttcctcgtctgagaaatggggataaccttatttgtttttttgttttgttttgttttttgagacagtctcgctctgtcgcccaggctggagtgcagtggagcgatctcagttcactgcagcctccgcctccaggtttaagtgattctcgtgcctcagcctccccagtagctaggattactggcatgggccaccacaccccagttaattttggttttgtttttgtgagatggagtttcactcttgtcacccgggctggagtgcagtggcccgatctcggctcactgcaacctctgcctctcaggttcaagcgattctcctgcctcagcctcctgagtagctgggattactggcatgcaccaccatgccccaccatgcccagctaatttttgtatttttagtagaaacggcatttctccatgttggccagactggtcttgaactcctgacctcaagtgatctgcccacctcagcctcccaaagtgctgggattacaggtatgagccaccatgcccatcccgtgatacccttatttggcagtgacactgatcgtgagaggcttcgtggaaaggccatttacctggagactccacacattgtcgtccagtgttccctagagccagccttcctccagtgctgtgagaggaggcagattgttctcgcctctagatgaggtttactgggttcatgtcagattccgggccaggactctcttcagaagggcaggtctgagccctgtgttttcagccgtgcagtggccagctgtggctggtgtccacactcccatgtgctaatggagatgcccaaagaatgtgtccaaagccagtccctgcaggtgcttctgcaacgcacttctgcacactctgctcacttagctgggacaagggaagctggagaacgtgtgtgctggtgtccctgggcaggctgagtggaagagcattttgtcactagcagtcaatccacaaacatcactatggctggtggtgggccaggcctgacctcacttctgccactgggagttgtctggacttagcacctccaccagaacaaatgagggggcacaactacaaactcagcagttcttttgcacagagagaagcttggccagatcatacacctaaccctcaccaacctggagtgcccaggggagagaatccagccctgctgttgtgaacacacagtgacaggattgtctccttgtgtaaaatgtgcagacattggtctcttagaacttcgaggacccaaactgtactttgatctgagtttctctggtgaattatacaatgtgcatgcttacttaataaatgcttgataacccctcattgatagcacatcatgagtcacagtcctagcctgacctgtgaattatatgaaaagcctgaacaaatagacttacatggcaacacttctcagttattgtgtttaaatatagtatgggcatggtgctcacgcctgtaatcccagcactttgggaggccaaggcaggcggatcacctgaggtcaggagtttgaaaccagcctggccaacatagtgaaaccctgtctctactaaaaatacaaaaattagccgggtatggtggcgtgtgcctgtaatcccagctacatgagaggctgaggcaggagaatcgcttgaacctggaaggcggaggttgcagtgagttgagattgcaccactgcactccagcctgggtgatatgtgcgagattccatctcaaaaatgaataaataaataaataggccaggcgcggtggctcacacctgtaatctcagcactttgggaggctgaggtgggcggatcacgaggtcaggagttcgagaacagcctggccaacatgatgataccctgtttcttctaaaaatataaaaattagccaggcatggtggcacacgcctgttgtaatcccagctacttgagaggctgatgcaagagaattgcttgagcccgggaggtggaggttgcagtgagccgagatcgcacaactgcactctagcctgggcgacagagcaaaactgtctcgaaaaaataataataaataaagagatagataaaaacgtgtgtgtatatatctacacccactatatatatatatatacatatatatatagcattatataatacattgtattatatctataatacatatgtgtatgtgtgtggttttctctttgtaattctttttcagtgactgtcgggcctccagaaaacattgaggtgaccccaggagaaggctccctcatcatcaggttctcctctccctttgacatcgctgatacctccacggcctttttttgttattatgtccattactgggaaaaaggaggaatccaacaggcaagagcatctttcttttttgtttggattttcttttctttgcagtttctggcttagcaaaagaaagaaacctttaacatgggcaagaacagggtgtctccatgtccccgtgtccccatagaggctgagccctgagcctgttttcattgtcctcttcaagacctgtttttccactcggtttgctgagacctccctccgccaggctgatctgaagggccagccatcctttgatgtcactctgtgtcccttgtgtggggttgagactttgccggtgccctgcttacgatgcctttgccacgctctgtagtttggaggaggttttagtgggcctggttctccatgaggaatccacaactacagcctgcaaggcttaactgtataaatgtttgaacagtttgtgaaaagggcacatgcgaaatcggggggaaacagagggagaaagagctttccagagagcagtaccagcaggtatgagaaggcgtggcatacgtggagaactgcaggtgcttagattggtcagaaatgcaatccacaaggggctgtggcaggtgctcacgttgacagaggtgcatgacatcagagcggcctggtcagcctcggggagtataggaaaaagcatcatggtcttgaagcatctccagtgcctaaattatcctagctgcatttaaggaggttctgttatctatgggaacttcatgatttcctaaattcaacattatgatggtttttgataataagagcttacatttattgagagcttcctttgtgtttggctctgggccagaattttagatacttcatctcatttcatcttttttttttttttttttttgagctggagtttcgctcttgatgcccagctagtttttgtatttttagtagagacagggtttttaccacgttggtcaggctggtctcagactcctgacctcaggtgatctgcccaccttggccacccaaagtgctgggattacaggcatgagccaccgtgcccggcccatttcatctttatactaatccgtttgcagagagagaatccaagtcgttaagtggcttgcctcaggtcagcagcgaatcactggcagagcagagcagagcagagatgcctagcttcagagccctgctcttgaccaccatctttttctgccacacgctttgtatctgcacttctccttcattttttttttttttttaattattgttctttttttgagacagtctcactgtcgcccaggctagagtactgtggtaccatcttggctcactgcaacctctacctccccggctcaagcagtccacccacttcagccacccgagtagctggaactacaggcctgtgccaaccacacctggctaatatttttaaatttttttttatagagatggggttttgccatgttgcccaggctggtctcgaactcctggtctcaagcgatctgcccacctcagtctccaaaagtgctgaggttacaggcatgagcccgttcccagcctcctcttcatttcattatggggaatatgaaactgggaagagtgagactcactgaaaaacagacttagcatctaggaaatagggaaaaatcatttctccatatcagagctcaagatctgggtcgattagaatagagggagcctggcagaatccagaagagagactctgcctcttccaagtctgtcctctccaactggatacggtgccggaaatgcaagagataggatgggccctctggccacgcttttctccaccctttggttgctttcttcactcgagggcaccgtgttgccatgctccctccccaagggcccgcccatacttttgtttttttaggatggagtccatccacttctctgcactgagtcagcccccagagggcgagttgccacttgtatcctagagctgggcagggctgcccagcactggagaactcagctccaggaccctggggccagccttgttgagcagcaagctctaatgaagagcacacagaacaggcttccactgcctgggacccgcttagcaccatgtcacttagcctctctgggctgcagcttcctcgtgtataaaatgaaacaactgagctataagctggagcctgtgaagaggagcagccgtgagggcccccaagtccctttcctccatttgaccagagcatctgtacttggcttccatgatcaaaaggttcaaggatgaaaatgactctgaaagccaccaatgtgatctttgttccagctgtgagtctgtgtgttagggtccccaagacccaccctagatcgctcaaaggactcccaggactcagcacagagtcacactctgatttcgttttgagacagaatttcactctgtctcccagggtagagtgcagtgccacaatctcggctcacgggttcaagagattttcctgtctcagcctccacatctgtgcctggcccatactctgattttttatagcaaaaggatgcaaagcaaaatcggcaaagggaagaggcacatggaggaaagtccgcaggtgtccaggggtaggcttccaggagcccttcctgagctgagtcacgcaggatacacttcattgctccaccagcaagctgtgactgcacatgtgaactgttgtctgccagggaggcttatgagagacccagcgcccagggctttttctgggggctggccacatacgcaccctctgtgtagcgtatgccaaaattccgactcccagaaggaaaacagatgttcctcataaagaaaacacattgtgcaaacagtgtagggacggtaagccaccttaccagtttgggaatgggagggataaacttgaaatccaaattcccaggctgggcgcggtggcttacgcctgtaatcccagcactttgggaggccgaggcaggcagatcacttgaggtcaggggttcgagacaggcctggctagcatggtgaaaacccatctctactaaaaatacaaaaattagccaggcgtggtggtgggcacctgtgatcccagttactcaggaggctgaggcaggagaattgcttgaacctgggaggcagaggttgcagtgagtcgagatcacactactgcactccagcctgggcaacggagcaagactccgtctcaaaaaacaaacaaacaaaaaacgcacacaaattcccagatgtcagctaagggttgacctggaaatcaggcccttcaaagggcattagtgttaggcctgttacgttagctcttctgcagtctgtgactctaaattttaggaattccaattgaatgctgaaataaacccaaagggaatttttgtccttaaaatcgtgtcttcctctgccctggcagtccaacaccattaaacagaagaaaagaaaatgtaaaaccatcaagtaatactattattcatagatcatacaattacttttatatttttattttttaattttaatttttcagagacaatttcactctgtcacccaggctggagtgcagtggtgcagtcatagctcactgtagcctccaattcacaggctcaagccatcctcccactttggccttccgagtagctgggacttataggcatgcaccaccatgaccagcttatttttttattattattttctgtagagacggagggagggggtctcactatgttacccaagctcaaactcctggactcaagtgatcctcccacctcagcctcccaaagtgctggaattacaggcatgagccaccatgcctggcctatttttgtattttaaaaaataacaacatgttctgtatttgaataatctgccttttttcagttaacaatttagcagccttgtcttcccatgttttcaagcatatgttataccaccatttcatgtggctgtagtggattatattgtatctcaaaattagaaaacagttctttgcaagaaaccctatactgccataatagggtatcgctgttttccactttggtatgggacaatgacagccttgccaggacaacaggagccattgcctggaagaccaggtggggaggcagcaaggcctgctcaaggcagcagagggatgcgcagaggagacacagaaccttcctagagtctagggtccagttgtctcctgatgacataaatccttaaggtcattttagctgaaactataggaggctcaagcacatttcggtcaaactagaagcaggttgggaatgaaaggaacattatttcccagaataattttttctctgttgactaacttgaggtatctagattaaccgtgagatacaaaatgttggccaggcgcggtggctcacgcctataatcccagcactttgggaggccgaggcaggtggatcacctgagatcaggagctcgagaccagcctgggcaacatggtgaaaccctgtttctactaaaaatacaaaaatgagccagacatgatggtgggtgtctataatcccaactactcaggagttggaggcaggagaattgcttgaacctgggaggcggaggttgcagtgagccgaggtcgcaccattgcggtccagcctggtgacagagcgaaactccatctcaaaaaaaaaaagaaatacaaaatgtttgttttgagatggagtcttgctcttcatccaggctggcgcaatctcagctcactgcaccctctgcctcctggtccaagtgattctcctccctcagcctcccatgtagctgggattacaggtgtgtgccaccacatccagctaatttttgtacttttagtagagactgggttttgcaatgttggccaggctggtctcttaactcctgacctcaggtgatccacccaccctggcctcccaaagtggtgggattataggcgtgagccaccccatccagcccaaaatgttaaaggagaaaaagattatcctagaaattgggatttactgaagtctagttactacaatgggcactctgagacctcacagccagaaacacagttctaaagctatcagcctctttggccacacaacacaccaattttcacacataaaatgtgtccactgccagccagtgacccactaaaaatggcatcttgttcttctttggttgtcgtgttcacagtgaatttgaggaaacatcagaaaagatgtaggcagcttggccatgttcatttacatgtgtgcttgtgatgtttttaaaacaggtcaaaggccctttcagaagcaactccatttcattggataacttaaaaccctccagagtgtactgtttacaagtccaggcacaactgctttggaacaaaagtaacatctttagagtcgggcatttaagcaacatatcttgctacgaaacaatggcagatggtaaaatataccttcttatgtcctttctgaactgggaaaagaatactcctccaatagtgaaatcggggaatgcttatgaggtcatgggtggtgggagtggggagacccagtgagaagagtgctgaactgcaggaataatgagcttgtgctgagatttgcagtagtggaggctaccagacagctaccacttgctttatttcattacaggattgactttagctattaatgtaagcataccaggtgagggtggggggtagagggacttgcccattttactaggacaggaatgctctttaagcagcatggatggaacattaactgatgtttgtgttgtgcgtaggaagatcattctgttcactttcgtgtcctctttttagcctccactgagcttcagcaagtcatcctgatctccgtgggaacattttcgttgctgtcggtgctggcaggagcctgtttcttcctggtcctgaaatatagaggcctgattaaatactggtttcacactccaccaagcatcccattacagatagaagaggtacgtgtgcacacatctctttttttttttttgagacagggtcttgctctgttgcccaggcgggagtgtcatggtacaatctctgctcactgcagcctccatctcccaggttcaagcgattctcctgcctcagcctcctgagtagctggtattacaagtgctcaccaccatggcctgctaatttttgtatttttggtagaaacagggttttgctatgttggccagactggtctcaaactcctgacctcaagtgatccacccacctcagcctcccaaagtgctgggattacaggcgggagccactgcgcccggccacgcagacatcttaatggtgacacatcagggccccactgcccctggcaacccctaagagtgcagctgtgggcaaagccgtggacacagagatttgggttacaaatggtatggggttgtttgtacacccatgttcatgttgacacgattcacaacagccaaaaggtggaagcactccggtgtcgttgaaggattaatagataaatctttaatagatggtctttccatacaatggaatatcattcagccttagaaaggaaggggattgtgacacatcctaccacacacatggaccttgaggacattatgctgagtagagtagggcagtcacaaaaggatactgtctgcttccacttaaatgaggtccccagagtcatcaaatccataaagacaggaagtagaatggtggttgcggtggtggagggagggaagtgggaagttcgtgttgaatggggccagagtttcagttctggggctgtacagagttctggagatggatggtggtcatgattgcacaatgtgaatgtgcttggcactaccgaactgtacacctaaaaagagttatgatggtacattttatgttatgtgtattttaccacaatttaattttttttttttaatggcatggggttggctaaaaaggtggcctggcctggagattggctgcagtagacccctctccgaggcagcaggtctcctctgctgtctggagaatgctccagggaagtggcctggctggaggacgtgaaggcggtggagacagtgatcaggagcttgagctttggggcccacagggtgcttaggagggccctaaggcagagtcaacacccagagctgtgagtgccaggccccgtgtacccattgcccagtgggtattgctaatatttgaaaggacttgagaaagaacagtagcgtgggtcttgtggaaagtcttattttcctgcataaccccagccccctgaggctctgtgaggccattgggccttctgaggacacggtcaggacattttggggatcagaggcgagctgagagaagaacatttaaaaagcatttgcagccgggcgcagtgacccacacctgtaatcccaggacttggggaggccagggtgggcagatcacctgaggtcaggagttcgagaccagcctggccaacatggtgaaaccctgtctctaccaaaaatacaaaaattagccgggcgtggtggtgggcgcctgtaatcccagctacatgagaggctgaggcaggagaattgcttgaacccaggaggtggaagttacagtaagccaatatcgcaccatagcactttagcttgggtggcagagcaagactccatctcaaaaaaataaaataaataaaaagcatttgcttctggaggcttcacattattcttgggtaaacctagagtaaaggtgttggaagcagaatgttactcagttacatgtgggatgaacagaggttagataaggtccaagtctgcagaaacatagcagcactttcagaaagaaccctagtcacttgttccttcatctgccatgatgtattgtaggtacacaggcagtatacagattccctactagaacctccctggttaatattgtcacaaaatcacagctcctaacaggtctcagaatcttacttgcagtaataatctctctctctcctggtagaactaccagctgagccccagtacatgaatatactatgagtcattcctctgagacatgaacagaaaacacaggcctgtcagttcacttttctaggaaagcataaagaacatccgccaaaggtctctgagttacatgggaacagtgaatcatgtttcacttataattctggggtttcacaagggtacatgttttggttttgttcctctttcagtcagtcagctacaagcttattgtcttccagtatctttcagcatttccaagagctagacactagattcttggtaacttggtgaatctatggctaagcctaaagcctgcgggagcaaaagggaaattaatcgctgggaaacacccctttatatgttaaggcctaaggccctcgctcccagattctctgcttgctgtgcgctggtgcaaggggaggggtggaggagtgcctgagaccaatgcttgtgaacttgccctctttttccccatcacagctgaacaagagcccccagtccctccttcactgaaaggttacaattttagagacgtcttaagattaataacccacaggcctacactgagggttgcaaggaagaacttgcttttcttccaatcagaaaatcagaagaaaaaaacaaaacttgcttttcctgagttttgcccttttaaactctcagcatattaacatggtcagccctgggatgagtattaaagtgattactgagatgaggggtaaggagtattcaactattagaagttgttggctgggtgaggtggctcatgcctgtaatcccagcactttgagaggccgaggtgggtggatcatgaagtcaggagatcgagaccatcctggccaacagggtgaaaccctgtctctactaaaaatacaaaaattacccaggcatggtggcatgcgcctgtagtcccagctacttgggaggctgaggcaggagaatcacttgaacccaggaggcggaggctgcagtgagctgagatccacgccactgcactccagcctggcaacagagcaagactccgtctcaaaaaaaaaaaaaaaaaaaaaaaaattagccagccgtggtggtgcacgcctgcaatcctagctacttggttgggaagctgaggcaggagaattgcttgaacccaggaggcggaagttgcagtgagccgagatcgcgccactgcactccagcctgggcgaaaaagagactgactcaacaacaataaaaaattgttgccgggtgcagtggctcacacctgcaatcccagcactttgggaggccgaggcgggcggatcacctgaggtcaggagttcgagacagcctgaccaacatgggaaaccccgtctctacttaaaatacaaaattagcagggtgtggtggtgcatgcctgtaatcccagctacttgggaggctgaggcagaggttgcagtgagatgagatcgtgtcattgcactccagcctgggcaacaacgtgaaactccgtctcaaaaaaaaaaaattgtttcattgttgaataaaaagaaaaataagttatgtcattggtggacagaatcaacttatatctgaataaaataactataccaattaaaactaaagtaggccaggcgtagtggctcacgcctataatcccagcactttgggaggccaaggtgggtggatcatttgcgatcaggagtttgagaccagcgtggccaacatagtgaaaccctgtctctactaaaaatacaaaattagccaggcaaggtggtgggcacctgtagtcccagctacttggaggattgaggcaggagaatcgcttgaacctgggaagcagaggttgcagtgagctgagatcacaccactatactccagcctaggcaagagtaagactccatctcaaaaaaaaaataaaaataaaaataaaataaaaacaaaaactaaagttaaaaggtctggtatactgaactggtaaactaattacaattttgctttccaacctcctcaagtatttaaaagacccaactcagcccatcttagaggccttggacaaggacagctcaccaaaggatgacgtctgggactctgtgtccattatctcgtttccggaaaaggagcaagaagatgttctccaaacgctttgaaccaaagcatgggcctagcccactggctccctggaagagatcaagccatcggagctgctagagttctgtctggactttccagagaccagtattcccttttgctgcctctaaaaggcctgtccctgcagacatgagagacagcaggtctcatgggggtgacaagctttttttttttttcttaaagaattttcaaaatcaaattccagaatgattttacggagatatcccaggaaaattaaggcttctcttaaacactaaaaaggcatgtaattgcttgttagcaaaatggatatgacacatctctgatacttttttcattattggttgggctgagcagtcagaagacctggtcgtcgtcttgactttggcaaatgagccggagccccttgggcaggtcacacaacctgtcccagcgagggacaccgagtggcccttcatgtacatccatggtgtgctggcttaaaatgtaattaatcttgtaaatatactcctagtaatttaagattttgtttttaaactggaaataaaagattgtatagtgcatgttttttaaagtctatgtgaagtgttttctttattgtagcctattttctgcagagtttcagctttctaaaattactcaatctaaacttgttttttcttaaataacacctgctagagctactgaggcctcatgggaactcagcaaacacttcctatggatgtcacttgatcctccaaaggttataaagaaggccagggcctagtgcagtggcccacgcctataatcccagcactttgggaggctgaggtgggtggatcacttgaggccaggagttctagacccacctgggcaacatggtgaaaccctgtctctatgaaaaatgcaaaaattatccaggcatgatgacatgcacctgtagtcccagctacttgagaggctaaagtgggaggatgctttagcctgggaggcggaggttaccatgagccgaaatgatgccactgcactccagcgtgggaggcagagcgagaccctatctcaaaaaaaaaaaaaaaaagagggctgggcatggtggctcatgcctgtaatcccagcactttgggaggtcaagatgggaggatcgcttgaggccaggagtttgagaacagcctgggcaacatagtgagaccttgttttcacaaaaaataaaaaattagctagtcgtggtggtgcacacccgtagtcccagctactcaggaggctgagaccagaggatcatttgagcctaggagttaggagttcaaggctgcagtgagcaatgattacaccactacattccagccttggcaacagagcaagagaccctgtctcaaaaatataaaagttataagggggatttgcagaaggcacattagcacttcatttatatgtgacaagtcacactgtgttgaccaaggcagggatttgtgggcaataaagagaattaactgattaatcaatagtaatgttatctactgagcacgcaagtcatctgattgtgtcagtactgtcgggctctgttgttcaaaggatatgtatttaaaatccatttataggctgggcacggtggctcacacctgtaatcccagcactttgggaggccgaggcaggcagatcacctgaggtcaggagttcgagaccagcctggccaacatggtgaaagcctgtctccactaaaagcacaaaaattagctgagtgtggtggcaggcacctataatcccagctacatgggaggcagttggggccctgtactgctggtaagaaagtggctttttttttttcttttgagacagagtctcactctgtcgcccaggctggagcgcagtggcgcgatctcagctcgctgcaacctccacctcccaggttcaagcaattctcctgcctcagcctcccgaatagctgggattacaggcgtgcaccactatgcctggctaatttttgtatttttagtagagatggggtttcaccatgttggccaggctggtctcgaactcctgacctcatgatccacccaccttggtctcccaaagggttgagatcacaggcgtgagccaccgtgtccggcaaaagtggctaactctcttaagtgttgtgtaccatgctgtctgcagtggcaagagttagaaaaacaaggcccactcccaccccatgcacacaagtctccctgtgaagcatctgttgtatgcattaggtgcaccttaagtagacaagtttggaggaagaagttgtagataggagttgtaaagacttaccttagaccgttcaggaaatcggagacagaagagcttcttctgttgggcagcaggatggtggccagcgaggagtggaggatacatctatagcaggagaacaggaaagagtttcagcccagcaggacagagggcaaatcaactctgttagggtaagtgcatctgtgccaccccatttatttatttagagacacagtctcaccctgttgcccaggctggagcgcagtggcacaatctcacttcactgcaacctctgccttccgggttcaagcgatttttgtgcctcagcctccagagtagctg

SEQ ID NO: 670 - DNA, 8654 bp, Human
aatctccacctcctgggttcaagtgattctcctgcctcagcctcccgagtagctgggattataggcatgcaccaccacatctggctaatttttgtatttttagtagagacagagtttcaccatattgggcaggctggtctcgaactcttgacctcaagtgatccacctgccccatcttcccaaagtgcttgcattacaggcatgagccactgcacctggcctgtgtgcctcagttttctcatttgtacagtaatagaaacaacaaaattctgaacatttctggtcttggaagatgcccgctgtcttcccccctgccccccagaaaaggcaggattattacttttcagttgatctatttcatctctttaaactggttaagacaatagcgaagacttggccgtgtgtggtgcctcacacctgtaatcccagcattttggaaggccgagtagggagaaccacttgagttctagatgagcctgggcaacatagcaagacccctgcctctacaattaaaaaattaaaaatggccgggcgcgttggtgcacgcctgtaatcccagcactttgggaggccgaggcgggtggatcacttgaggtcaggagtttgagatcagcctggccaacatggtgaaaccccgtctctgctaaaaaatacaaaaattagccaggcttggtggtgggcacctgtaatcccagctactcaggaggctgaggcaggagaatcgcttgaacccaggaagcaaaggttgcagtgagtcgagatcgcaccactgtactccagcctgggtgacagagtaagactctgtctaaaaagataaaaataaaaattaaaaaattaaaaattagctgggcattgtattgcaggcctgtagtcccagctactcaggaggcagaggctgaaggatcgcttgagcccaggggaatgaggttacagtgagctatgatcctgccattacaggccaacccagagagatcctatgtcaaaaatgaataaataccctggtgtggtcgctctcgcctgtgatcccaggactttgggaggctgaggcgggaagatgacttgagtccaggagtttgagaccagcctgggcaacatggcaaaaccccatctctacaaaaaaaatacaaaaaattagccgggtgtggtggcgtgggcctgtagtcccagctactcaggaggctgaggtgggagaattgcttgagtcagggatagggaggtggcagtgagcccatatcgtgccactgcactccagccagggtaacagagcaagaactcatctcaaaaataaaaaataaaaataggtggctgggcgtggtggcttacacctgtaatcccagctacttgggaggctgaggtgggagaatcacttgaacccaggaggtggaggttgcagtgagccgagatcgcatcactgcactccagcctggaagacagagcaagactttgtctcaataataataacaaaaataataatagtccaggcacagctcatgcctgtaatcccagcattttgggaggccgaggcagatggatcgcttgaggtcaggagttggagaccagcctggccaacatggcgaaccccagtctctactaaaaataaaaaataaaaaaaaaaaaattagccaggcatagtggcgcgcacctgtaatcccagctactcaggaggctgaggcaggagaatcgcttgaacccgggtgtcagaagttgcagtgagccgagatcaagtcactgcactccaacctgggtgacagagtgagactccatctcaaaaaaaaagaagaaaaaaataaaaaagaaagactcgttgcccagtgctccctctgggagaagtacatccaaggccctggccctgggagaaaggctctggcactaaccccacccttgacctttttcctgggcggtcctgaagaatgttctgtcccttctccaaggcccccagctgggacggcccaggcgcctataaagggggtccccgcttggccccggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcggccggaggcgaccgtgagtggggacgggcagggacagcgctctgggaagccgaggtggggcaggtgcacgtaggcgcagatgcacacgtgcagggaggtgggcaggtttgcatgcatgtgcccagggctcacctgccggctgcgtgcacagatcgtgggtccgcactggagtgtgtgtgaacgcgcgtgtgaaagtccccagagccgttagccaggcgtggtggctcacgcctgcaatcccagcactttgggaggctgaggcgggtggatccccagaggtcaggagttcgagaccagcctggccaaaatggtgaaaccccatctctactaaaaataatttttaaaaaaattagccggggataatgatgcacatctgtaatcccagctacttgggaggccaaggcaggagaatcgcttgaacccggaaggcagaggttgcagtgggccgatatcatgccattgcactccagcctgggcgacagagtgaaactccgtctcaaaaaaaaaaaaaaaagaaagtcctcagagcatgagtccccctgaggggccagaaacagagtgaggcaggagaggtaggctcttgcaagtacatggtgagatcctgtcttaaaatttcaatattttgatcttcatgaatttttgccttaattttgctttgtttgtttgttttttgagacagggtctcactctgacgcccaggctggagtgcagtggtgagatctcggctcactgcaggctcaacctcctgggctcaaaccatcctcctgcctcagcctctggagtggctgggatacaggtgctgccaccacacccagctaatttttttttctttttcgtagagagggagtctcactctgtttcccaggctggtctcaaactcctgagctcaagtaatcctcccaccttgaccttccaaagtgttgggattagcgatgtgagtcactgtgtccagctttaaaagtatttaaaagtattgcttttgaaaagtattgcttttcacaattatgttactttattttattattttatttttatttatttattttgagacatagcctcgctctgtcacccaaaccagagtgctgtgacgtgatctcgtctcactgcaacctctgcctcccgggttccagcaattttcctgcctcagcctccagagtagctgggactgcgggcacgcaccaccacacctggctaatttttgtattttgtttgtttgtttgagatggagtctcgctctgtcacccgggctgaagtgcagtggcacgatctcagctcactgcaacctccgcctcctgagttcaagcaattctcctgcctcagccttccaagtagctgggattacaggccactccccaggtcacccactaccatgcacagctgatttttttttttttttgtatttttagtagagacaggtgaacaggtgaaacaacaggtttcaccatgttggccagtctggtcttgttttgttttgttttgttttgttttgacattgagtctcgctctgtcccccaggctggagtgcagtggtgtgatctcggctcactgcaagctccgtctcccggcttcacgccattctcctgcctcagcctcctgagtagctgggactgcaggcgcctgccaccaagcccagctaaattttttgtatttttagtagagatggggtttcaccatgttagcaaggatggtctcaatctcctgatctcgtgatccacctgcctcggcctcccaaagggctgggattacaggcatgagccactgtgcccgggccaggctggtcttgaactcctgacctcaggtgatctgcccgcctcagcctcccaaagtgttgggattacaagcgtgagccgctgtgcctggcctttttacaaatattttaaattttattttaaaagtattgcattaaaatacttaccttgctggatgtggtggctcatgcctgtaatccctgctactcaggaggctaggagggaagatcacttgaggccaggagtttgagaccaacctgggcaatatgagactcagcctgagacagagacccttgtctcaaaaaagggaaaaatattaatattattattattatatatatatattttgagacagggtctcactctatcacccaggctggagtgcagtggcgtgatctcggctcattgcaacctctgcctcccagactcaagcaatctgcccacctcagcctcctgagtagctgtgactagctactctcaggctggtgagaccagcctggccaacgtggcgaaacctcgtctctactaaaaatacaaaaattagccgggcgttgtggcgcacacctgtagtctcagctactcaggaggctgaggcaggagaatcacttgaacccgggaggtggaggttgcagtgagccaagatcacgccactgcactccagcttggcaacagagcgagactccatctcaaaaaaaaaaagctgatgctgacatttggggatgtatatggtagtggggctgtcctgtatattgtagggtgttagataacatctctgtcttctgccccctaatgccatgaatagcctcacaccccatccaagttgtgacatctaaaactgtccccagacaagtatcccctggaaacaaaatcaccctggtttgagaaccactggtgtcaattgtaaactgcagattgggtagagggtaaacaaccctctaaattttcataagtccttttttttttcttttgagacagtcttgctctgtcactcaggctggagtgcagtggcacgatctcgggtcactgcagccttgccttcccaggctcaagcgatcctcccacctcagcctcccaagtagctgggactacaggcatgcagaattatgcccagctaatttttgtattttctgcagagatgaggttttgctgtattgccaaggctggtcatgaactcctgggctcaagcaacgcacccacctaggcttcccaaaatgctgggatgacaggtgtgagccacggtgcctggcctcaaaaaaatatcctgatggcttcgtgcctccctgtctgtaccctagtcctggccctggtgcagggatatacgacaagtttgtgcagatgtgttaacacgtgtccacatgtctctgtgtgccactccacttgcggtgttagggatccaggggaggcggtctgcaagggtgtgtcctcgtaggggtgtgtgtgtgtctgtgggtccaccacacatgcgtgggtgaccaggaagtggacccacagacacatgtacacccctgcatgtctctgtaccacgaggagtctgtgggtgggtctctgacctgctctgggtgtctcacggacccttggacctgttggggaaactgacaccatctgtagctccaagacccccgacactccctgggcagggcatggggcactcaggtggcatatggggacccacgcagctggggatgtgagtgtggacatgagttgagtggatgagaggattaaccaggtgcctggcgtacagtaggtgcttaataagtgctcgcttttttttttttttttttttttttgagatggagtttcattcttgtcacctaggctggagtgcaatggcatgatcccagctccctgcaacctccacctcctgggttcaagtgattctcccaccccagcctccccagtagctgggattacaggcgtccaccaccacgcctgactaatttttgtattttttagtagagacaggtttttaccatgttggccaggctgatctcaaactcctgacctcaagtgatccacccacctcggcctcccaaagtgctgggattacaggcgtgagccactgagccgggccagtgctcacttttttttttttttttttgagacagagtctcactctgtcacccaggctggagtgcagtggcgtgatctcggctcactgcaagctctgcctcctgggttcacgtcattctcctgcctcagcctcctgagtagctgggactacaggcgcccgccaccacacccggctaattttttggttgtttttttttttagtagagaaggggtttcactgtgttagccaggatggtctcaaactcctgacctcgtgatccgcccacctcggcctcccaaagtgctgggattacaggtgtaagccactgcacccggccagtgctcactttttatctgcatgcatgagtgtttggtgggttactcagtgggatgtgtgtggattcgtgcacatgcagcatggggtagcatgtcctctgtcgtttccgttccagctgagtttcactctgtccccaggtgagttgctacagtggctggagagacgacatctgctccatgggctggtggccgacagtaatctcacgctgggacctggcctgcagcccctgccccagacctctcaccatcaccgccaccaccgtgcagctgccaccaaccctgcacgctactgctgcctcagtggctgtacccaacaagacctgctgaccctctgtccctactgattcctccttgggtgcagcctcagagtggcctgaggcccagagggtctggtctggtgagctcctgaggccacacagcaccataaagtctcgcatctacaggcctttgattacctcctgggatgggtgctcactatctaccccagaccaatgccacctgcagcctgtggagtcaactgcagaataaatcacaccctagccctggcttggaggatccccgctttcacagatgctggacactgacagccaaatgtcctcactccaggggagccccagacgctccgctccctgcatgtgtaacaccccttcttgctgtctcttagtaaataaacgacccaaagcagcttcctgcattttctctagaaaaagggacaagcctcagtcagtccctgtgtgggcttgtcccccagcagccatggacccaccggcacttccaggagcttgataactagagaggcattgcaacgcaaagtggggaaactgaggcccagggagagggctgcttgccaaggtcagacagggaagggtaagtgcaggacttgaaccgaggtctctaccaaggcccatgggagtccttagcattgaggacttagaatggtagacattagacacaaaacaaatgtcagaaaatgatcatcacaaaacacattagtctttttttttttttttttttttgaggcagggtctcactctgtcacccaggctggagtgcagtggcacaatcatagcttactgcagcctccaactcctgggctgaagtgatcctcccacttcagcctcctaagtagctgggattacaggcacccgccaccacacccagctaatttttgcatttttagtagagacggggtttcaccatgttggccaggctggtcttgaactcctgaactcaggtgatccgcccacctcggcctcccaaagtgttgagattacaggcatgagccacgtgcctggcccagtcatcggatttagggtccaccctaatccatgataacctcatgtctgtctataaagaccctatttccaaataagcccatattctgaggtgaattctcagaatatgaattctcagaatatgaatatgaattctcagacatgaattcttgccagacactactcaatccagtggagcaggggagctgggactctcccctgatggcaatagggagccacagaggctgtgtgagcaggggcagaatgaggtcagatgtgcctgtcagaaagccctgcagccccatctcatccaggcctgatttgcaggatggtgtctcatcctcccagctccctccagtccccagagcagccatttttaaccacctttttttttttttttttttttgagactgagtctcactctgtcgcccaggctggagtgcagtggcatgatctcggctcactgcaacctccgcctcccgggttcaagcgattcttttgccctcagcctcctgagtagctgggactacaagtgcacaccaccacgcctggctaattttcatatttttagtagagatggggtttcaccatgttggccagaatggtctcaatcttctgaccttgtgatccacccacctcggcctcccaaagtgctgggattacaggtgtgagccaccacggctggcctattttttttttcttttttttgagatagattctcactctgtcgcccaggctggagtgcagtggctcagtctcagctcactgcaacctccgtctcccaggttcaagtgattctcctgcctcagcctttcaggtagctgggattacaggcatatgccaccacactctgctaatttttgtatttttagtggagacggggtttcgccttgtctaggctggtcttggtctcctgacttcaggtgatccgcccacctcggcttcccaaactgctgggattacaatcgtgagccaccatgcccagcctcattttatttttgaaacaaggtctccctctcacccaggctggagtgcagtggcatggtcctggctcactgcaacctcaacct

SEQ ID NO: 671 - DNA, 16922 bp, Human
ggggacaagccaattctcttagtagaggctttccagacagaattcttattattgagaattgagaattcacatgccacacataatttatcgttttaaagtgtacagatcagtggcttctagcataatcacaaggttgtgccaccgtcaccactatctacttgggaagattttcttcctttttttctttttttttttttttgaggcggagccttgctctgttgcccaggctggagtgcagtggcgcaatctcagctcactgcaagctccgcctcccgggttgaccccattctcctgcctcagccttctgagcagctgggactacaggtacccgccaccacgcccagctaagttttttgtatttttagtagagacggggtttcactgtgttagcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactgcactcagaccagcctaattgggaagattttgaggatatgctgtggtctgatgggttccaaggcagaggtgacagtaacctggaagagggagactgcttaggcagtggcatcctggtgggatagggtgaggagatcccagagcccacgtttactgcaaccctggggaaatgtcaccagagaaatgggggtggtgccagacaatagattgtgggagctatggtttccatggtagagtagaagcatccaccatgtgtgacattcagcagatggggcgctgtgggtggcttggagcactctggttgtaactgaggcaggcacagtgtttaggaagcctgtgcagtaatccagactgaagggaggggaaagcctagactaagactatggctgtgggattgaaatagcgttgaaggagctgactttgactcccggagatgaaggggaaagaggaaatcagaagggaccaaggatggtgaagttcttaagagaaactgaggaggaagagaggatgatgtggtgggagacgtgtagagagtccttgtagatctgtcacattgaaggggactatggtcccagaggtacagatgtcctaaaacaggctggaaaagggagtctggagagagcttggtgttgtaatgaaccatggggagccgcctcgttggccctgtgattacccaggaactgaatagagagggggccctgggagacctcagacacttagaggatataagggggtgaaaggggggacctggctttgagtcgaagggaggagaaggagattatatagctgaaacgtctaagagaatttgtgatctgagcgtttctactggggcaagtgcttctgaaaggcagaggcggctgagatctggaaacaggtctgcaaatctggtcactggtctcattgcagtaacgctgtgcgcggttgagggagtgtattggcagaaaaaccacgcgttgtctgtcccggaaggaacaagccagtgagagccggcctgatgggaggaccgccgaaaggggcttggtgaagcccgcgctccttgggggtgggaatgcggggatggggtggtcgcgatgcagggagggcgacagggtccaggtcgtgctcataagtttggagctgtactctcagctactcggggctggtccttgattttggctgcgctcgcgcacgctcccccttttctggccgccaggtcccgccttctaaatttccccaggtctccaggccgctagaattttctcttctgaacgtggccccgccctctccactcatgattggccaagttccgggcctcagttttcactggataagcggtcgctgagcggggcgcaggtgactaaatttcgacggggtcttctcaccggtttcattcagttggccactgctgagcagctgagaaggtggcgacgtaggggccatggggctgggccgggtcctgctgtttctggccgtcgccttcccttttgcacccccggcagccgccgctggtgagtggggttcctggcggtccccggcggagcgggagcggcggggcgtttccgggggtccgggtgggttgccgcgagcgctgtgcggtcagggcggggctcaggtgtgctgtctggagtgcagggagctggacgccgcctgttcccgccacacctcagccctgctttcccatctcccgtctcttttttttttttttttttttttctttctgagacggagtctctgtcgcctaggctgtagtgcagtggcgcgatattggctcactgcaagctccgcctcccgggttcacgccattctcctgcctcagcctccctagtagctgggactacaggcgcccgccaccacgcccggctaattttttgtgtttttagtagagatggggtttcaccgtgttagtcaggatggtctcgatctcctgacctcgtgatccgcccgcctcggcctcccaaagtgctgggattacaggcgtgagccaccgcgcccgacctcccgtctcctttcagtcctcctcgggatcgcgcatcacccgcattttctggtctcctcctgcacttgctctcctcgcctctcctccgtctcctctcacttttcggacaaaccagtccttctgaggcccctgggttcccgggctgctcctgtgaatggcattggaaggccgttccagcgcggccgctgaggcagccacttcccccggtgctgggggcggatctcaggtccctgaagtcctgtcctctcccggagccgatgtgttctcagctcctgggccgcagctcctggagttggggccctcctttcttgggacccggaggtggtgcttcttgctgctgtggggactgtggggggtcctgactctcaagctgaggggttggagtctgcaggctccgggcagaggattcttcctgcgacttctgtcatccccagctcattctcccctcgcctccggctccgggggtcctctcctctctcgcatcccacccctactaatgaccaatgatctaaggacaccagattccctctcacctcctccctgcccatcttacggcgccctgggtcctgttgctctcccagctccctgctaccccttcctgtgtgctgttctctgatccatttctagggtgtcctctgccttcatcccccgcccccgccactgaaggtccctcctgcctcctttatgggcctttcctgcaagcagccttcactccgtgctgcccctatgcctccccattcccaaatgtccctgactctaactttctggtgctgccttttgtccgggggggtcttccctccatcccactcccctccagacccccaaggagagccctgatgctaatggcagttgggccttaggcagggcgcagggcagcgcagatgccccctcccctccagtgcaggtgcctgctctgggccctgcctcattgtggccccttccccactccttcatcctcagcctcaccctcttgaggaccccaccctccagcccacaggtgctggaccatccctccctggtccctccgcccctctccaccttgggaccttgtgctgctcctatctcttgcccagctgccttgggccctcagcaagttctcatctttcagtgggaaagtgggagtgctggagcatatgacagtgctgagcatctttcccaagccccaccctcccccagagcaccctcccctcctgtcctcaccctaccccaagttctcccacagtcactcctgccccatgctcatgccgccctccagttcttgctctgcccatctcccctccccaacccagacctaaaacaggctgttgggccaactgttccttgaccttccttcttttcttttggttccttgaccccagtgggctctcactccccacaccgcatatctaaaatctgttttgcctgctcttggggtgccactgctccccctccagcattactccttttggcaggtccttcctcaggctgagaatctccccctctaccttggttttctctctctggccagcacccccactccttgctttgtttttaatttttaacttttgtttgggtacgtagtagatatatatgtatatatttatggggtacatgggatattttgacacaggcctacaatatgtaataatcacatcagggtaaatgggttatatcacaacaagcatttatcctttctttgtgctacaaacaatcccattatgctctttcagttatttttaaatgtacaataaattattgttggctgtactcaccctgctgtgctatctactagatcttattcattctaactatatttttgtacccattaaccatccgcactcccccactccccactacccttctcagcctctggtaatcgtcattctattgtctctccccatgaggtccattgttttaatttttggctgccacaaataagtgagaacatgcgaagtttgtctctctgggcctggggcttatttcacttcacatgatgacctccagttctttgcaaatgacatgatggctgaatagtactccacatacacgtgtgcaccacattttctttctccattcgtctgttgatggacacttaggtcgcttgcagatcttggctattttgaatagtgctgcaataaacatggaaaagtagatagctctttaatataccgatttcctttcttttgggtatatgcctaacagtgggagtgctggagcatatgacagctctattatatttttagtttttggaagaacctccacattatttcccacagtggttatactagtttacgttcccaccaacagtgtacaagggttctcttttgctacatcctcgccaggattccttattgcctgtcttctggataaaagccagtttatctggggtgggatgatatctcgtaggagttttgatttgccttcatctgatgacgaatgatgttgagcaccttttgatatacctgtttgccatttgtatgtcttcttttgagaaatgactattcagatcttttgctcatttttaagttggattattagatatttttcctatagagttgtttgagatccttatatgttttggttactaatcctttgtcagatgaatagtttgaaaatattttctcccattcttggatggtctcttcactttgtttattgtttcctttgctgtgcagaagctttttaacttgatatgatcccatttatgcatttttactttggttgcctgtgcttgtggggtattacttaaaaaatctttgccagtccaatatcttagagagtttccccaatgttttcttttatagttttcatagtttgaggtcatagatttacatctttaatcctttttgattggatttttatatgtggtgagagatagggtccagtttcattcttctgcataaggatatctagtttccccagcaccatttattgaagagactctcctttgccctgtatgtgttcttggtaactttgttagaaataacttcactgtagatatatggatttgtttctgggttctctattctgtttcattggtccgtgtgtctgtttttatgccactaccgtgctgttttgattactctagctctgtagtataatttgaagtcagataatgtgattcctctagttttgttctttttgttcagggtagctttatctattctgggttttttgtgattccatatacattttaggattgtttttctatttctgtgaagaatgtcattggtgttttgatagcaattgcattgaatttgtagattgctttgggtaggatggatattttaacaaaattgattcttccggctgggcacggtggctcactcctgtaatcccagcactttgggaggccgagtcaggtggatcacttgagatcaggagttcaagaccagcctgatcaacatggagaaaccccgcctctactaaaaatacaaaattagccaggcgtggtggcatatgcctgtaatcccagctactcaggaaagctgaggcaggagaatcgcttgaacccaggaggcagaggttgtggtgagctgagattgcaccattgcactccagcctgggcaacaggagcaaaactccatctcagaaaataaaaataaacattgattcttccagtccatgaacatggaatgccttttccattttttgtgtcctcttcaatgttttgcatcagtgctttatagtttttattggagagatctttcacttcttcagttaagtctattcctaggtattttattttatttgtagctaatgaaaatgggattcgtttcttgatttctttttcagattatttgctgttagcacatagaaatgctattgatttttgcatgttgattttgtatcctgcaactttactgaatttgttcttcagttctaatagttttttggtggagtctttaggttttccaaatatcagaccacatgatgtgcaaacaaggataatttgacttcttcttttccaattttgatgccctttatttccttctcctgtcagattgctctagctaggacttgcagtattgtgttgcataactgtagtgaaagtagtcatccttgtcttgttccagatcttaaagaaaaggctttcagttttcccccattcagtatgttactagctgtgagttgtcatatatggcttttattatattgaggtctgttccttgtatactcagtttttttagagtttttatcatgaagggatgttaaacttatcaaatgctttttcagtatcaattgaaatggtgatatggcttttgtcctttattctgttgatacgatgtattacattgattgatttgtgtatgcatacctggaatacattccacttggtcatgaagaatgatctttttaatatactgttgaatgtggtttgctagtatttcattgatgatatttgcctcaatgttcatcagggatataggcctgtagttttctttttttgatgtgtctttgcctgattttgatatcaggatattcctggctttgtaaaatgagtttggaagtattccctcctcctctgtttttcagaacaatttgaataggactgatatttcttgttctttaaacgtttaattgtggtaaattatacattacatacattttactgttttaaccgcttttaagtgtatactcggtggcattagatacattcacatttttgtgcaacccaaaactctgtacccattaatcggtaactccccattcctccctacctctggcccctggtaaccatcattctactttttgtttctatgaatttgaccactctaggtacctcatttaagtagaatcgtgtaatgtttgtctttttgattctggcttatttcacttataatatttcgaggttcatccaggttgtagtatgggtcagattttcattccttttaatgatgaataatactcattatatgtatgtaccacaccttggttatccattcctcagacaatggacacttgggttacttctaccttttggatattggcaaatatttcatttctcttgggtatatatttatttcttttgagtatttcttttgggtatatatccagaaatagaattgttggatcatacggtatttcattttttaatttttagaggaatcaccatagtgttttccattgcaggcgtgccattttgtatttctagaagcagtatacaggggcttcagtttctctacctccttgccaaacttgctgtgtgtgtgtgtgtgtgtgtgtgtgtgtgtgtgtgtgtgtgtgataatagccaccctgattggtttgaagtggtatctcattgtggtttggatttgcattttcctaatgagtactgatattgagcatcttttcatgtgtttattgatcatttgtatattttctttgaagaattggccattgaagtcttgcccatttttctcccccacatagcttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagcttcatgccattctcccgcctcagcctcccgagtagctgggactacaggcgcccgccaccacacccggctaattttttgtatttttagtagagatagggtttcaccatgttagccaggatggtctcaatctcctgacctggtgatacacccgcctcggcctcccaaagtgctggaactacaggcttgagccaccacgcctggccttctggaaactaatctcttatcagatatatgacttgcaatatttatttcatttcaggggttgattgctttctcactctgattgtgccctttgatgcacagatattttgaatttttcatgagtccagtttgtcagttctttctattctatctgtgctttggcgtcatatccatgaaagcactgtcaaaccctatgtcatgaacattatacccaatgtttttttctaagatatttttatgttttagttcttgagtttagagtttaggtctttgattcattttgagttaatttttgtatatagtacaaattaagggtccaattttatattatttgaacatccagttcccccagcactatttgctgaaaagatggacttactctttgataccctgtcacctgcccaccccagtggacactagctggtccatccaattgctgtcctggggccttgtcatgccactcttccactttgaacccaagcccacatcattgctcccctctgggatactgaccccactataaacttctctagggctacaaccttcctaccccttgtgcctcatgaccaccccctcccttgtccccaccatgcccatgatgagtcttttctcaaggcagctcgccttgcctccatctcaccctcacctgtgcaccacagccacactggacatgggtccctctgagcctgagtcccttcccattcccactgtcccctctggcaagaccttccttccaacactgccttcatgctcctcccttgcccctgcagggcagcctctccccttggcccctattcccttagggggcttgtggccacccagtcctggcacctgacctacaagtttgccatcttcattcccccttcttctgttcatcagccccctcctctatcctcccaccctcacagttttccttgtatatgaaatcttcgttcttgtccttttgcccatgtgcatttcctgcctcctcagggaggtcgggacagcagacctgtgtgttaaacatcaatgtgaagttatttccaggaagaagtttcacctgtgatttcctcttccccagagccccacagtcttcgttacaacctcatggtgctgtcccaggatggatctgtgcagtcagggtttctcgctgagggacatctggatggtcagcccttcctgcgctatgacaggcagaaacgcagggcaaagccccagggacagtgggcagaagatgtcctgggagctgagacctgggacacagagaccgaggacttgacagagaatgggcaagacctcaggaggaccctgactcatatcaaggaccagaaaggaggtgagagtcggcaggggcaagagtaatgggaggccttctccaggaaagttggagacagagagcagggacctgtctcttcccgctggatctggctgggggtggggatgaggaatagggtcagggaggctcagcagggtggtgagccggaactcagcccacacagggaggcatggaggagggccagggaggggtcgccgctgggctgagttcctcacttgggtggaaaggtgatgggttcgggaatggagaagtcactgctgggtgggggcaggcttgcattccctccaggagattagggtctgtgagatccatgaagacagcagcaccaggggctcccggcatttctactacaatggggagctcttcctctcccaaaacctggagactcaagaatcgacagtgccccagtcctccagagctcagaccttggctatgaacgtcacaaatttctggaaggaagatgccatgaagaccaagacacactatcgcgctatgcaggcagactgcctgcagaaactacagcgatatctgaaatccggggtggccatcaggagaacaggtaccgaccctggccaggggctctactgttcccgcaattctgctagagttgcctcgcctcccagctctgtccggggaaaccctccctgtgctatggatgcaggcgtttcctgttggcatattgtgtcctgatttgcctctcctgttagagccattggataaagacagtgggtctgggactgaactgtccagtgttgtaatctgggaaagcagtgggccctctgacagaagcctgagcctggggtgggagttaggcaggagaggaagccctcagggccagggctgccccctctgcctcccggcctgcccatcccggagagttccctcctggccccatgacccaggagtccacccttgacatccccctcctcagcatcaatgtggggatcccagagcctgaggccacagtcccaaggcccatcctcctgctagcctggaggaattaggccccagggtgaggacagacttacagaaggtccgggatctgtgagggattcagccagagtgagaacagtggagaggagcagccctgttccctgcatctcccttagaggggagcagggcttcactggctctgccctttcttctccagtgccccccatggtgaatgtcacctgcagcgaggtctcagagggcaacatcaccgtgacatgcagggcttccagcttctatccccggaatatcacactgacctggcgtcaggatggggtatctttgagccacaacacccagcagtggggggatgtcctgcctgatgggaatggaacctaccagacctgggtggccaccaggattcgccaaggagaggagcagaggttcacctgctacatggaacacagcgggaatcacggcactcaccctgtgccctctggtgagcctggggtgaccctggagagggtcaggccagggtaggaacagcagggacggctgtggctctctgcccagtgtataacaagtccctttttttcagggaaggcgctggtgcttcagagtcaacggacagactttccatatgtttctgctgctatgccatgttttgttattattattattctctgtgtcccttgttgcaagaagaaaacatcagcggcagagggtccaggtgagaaaaggggacagtttctggagatgggaaagctcctttctaggcagtagggtctcctcattgctcctgcccagacaagacgtaggtgacaaggctgctggaacaggggatggaagctggggtatttgggaggggaatgggagctgcatctccatctacacccataagtgcttctcaagccagggctggggcaaggccttcgaatatccagctgtggcctcctcctgctgcaagtgaggagtgggcagcagggagggctgtggcacctgctctgtccccatcccagcctctctgtctctcgggctcactagggtgcgtccaggtggggtgagttgggaatcacgtgctgattgctgagggcctggatgatcatggtgtcagagggaggaaatagtaaaggtggctgtgatctggggagggccagaaactggagaggaatccaaggagaggcggtgcccacccgtgtgcctcctccaggaggcactttccaggttcccaccacctggcctccctgagtttccttgcagatgacacagatgaatagataagcagatgtccctgggccatttgaggagcggggcccagcccctcatcagggcagttgtggtccctgttttcatcctacctccagcgtgttttcttctgcagtccctgagggacacagtccccaggcgccatctctttgaggctttgttctgtgctctgtggccttaccttgccctccctgagccaatttccctttctcaaggtggtcactgcctggtaagtttggagtaagggacggtcagaagcatttcccccacagtcaggttgtttgatgggggatgaaaagagacagcagaagttttgtgtttctgcaaaaacagaggcagtgcaggggacagtgagaggctggggtgtccaggagacctgagtctggcggtaggggcgctggtttctcatccttgaacctaattgcactgtcagtcggcccctcatgcctgagcagatgggaaggttcgtcccctgccctgcagcaagagggccctgtccaggaggcacccacagcaggggcagtgcaggtctgtggtcactcctgctctcacctgcggcgtctcccgtggagggattgtcacttctggttccctgtgggcaggaatggtttcctcgtaggtcactggggttttggccaggaaaagggtatgaaattcatgtgccagtttatcaaaattcctgctttcaatgttgatgtccaataaagatgttcgtaatttcagctctataatcttaataggatttcctctaatactgctgttgtaaagcatattaaataaaacaggaactcaaatttggagccccctctccagaagggtctgtgtggagatggtggctgtggcagcggcagttcccaggtgcagagggtgggcagaggcagcctcaggctaaggggtctcccctactccacgtggagaaaagtccttgtaggttgcaagggcagtggcctgggtggaatccctgctagggacagagcaggaaggcctcgcagcctcaccaagcagcagccctggggtgaagtaagtggaccaggagtaagtggaccaggcaggagcagtagtgactcaacagcaggtcacaggcctaggtgggtgctgaaggtcatgggaggccaggcctcctcgagcaaggtggggggtcccagggtcatgtcaggtgcagatcctgtggcagccatgtctttccatgctgggcctgctgggccccccaggcttcctgatggggtccccagttaggagctgcctgctcagggctgggaggggaggagtgctgagctgcagatagagggcagggcccacagtgggcagggcctgccctggtgtgcaggtgcctctgcaggagaggagggcctggggactgagagcaagggtcagggcctctctttggggaggcctctcactgtaacaggactggtcaggcctgagaggagggcactgggttccctcttgggtcttgtccttttgtcttggggccctttcactccctgcacggtgagtggtgggcacaggacaggggctgatgttgatggagtgatgggagagaactgacaggggctgggaaaagcaaggagggaggaagaaaaaagtgggggcctcatcttctctcagagaaagggtgaatctgattttggggcaactgaagagagaaaagtccttagggaataaacacaacactgcacccagtggagcatttacccgtttccctcttctccagagcttgtgagcctgcaggtcctggatcaacacccagttgggacaggagaccacagggatgcagcacagctgggatttcagcctctgatgtcagctactgggtccactggttccactgagggcgcctagactctacagccaggcggccaggattcaactccctgcctggatctcaccagcactttccctctgtttcctgacctatgaaacagaaaataacatcacttatttattgttgttggatgctgcaaagtgttagtaggtatgaggtgtttgctgctctgccacgtagagagccagcaaagggatcatgaccaactcaacattccattggaggctatatgatcaaacagcaaattgtttatcatgaatgcaggatgtgggcaaactcacgactgctcctgccaacagaaggtttgctgagggcattcactccatggtgctcattggagttatctactgggtcatctagagcctattgtttgaggaatgcagtcttacaagcctactctggacccagcagctgactccttcttccacccctcttcttgctatctcctataccaataaatacgaagggctgtggaagatcagagcccttgttcacgagaagcaagaagccccctgaccccttgttccaaatatactcttttgtctttctctttattcccacgttcgccctttgttcagtccaatacagggttgtggggcccttaacagtgccatattaattggtatcattatttctgttgtttttgtttttgtttttgtttttgtttttgagacagagtctcactctgtcacccaggctgcagttcactggtgtgatctcagctcactgcaacctctgcctcccaggttcaagcacttctcgtacctcagactcccgaatagctgggattacagacaggcaccaccacacccagctaatttttgtattttttgtagagacggggtttcgccaagttgaccagcccagtttcaaactcctgacctcaggtgatctgcctgccttggcatcccaaagtgctgggattacaagaatgagccaccgtgcctggcctattttattatattgtaatatattttattatattagccaccatgcctgtcctattttcttatgttttaatatattttaatatattacatgtgcagtaattagattatcatgggtgaactttatgagtgagtatcttggtgatgactcctcctgaccagcccaggaccagctttcttgtcaccttgaggtcccctcgccccgtcacaccgttatgcattactctgtgtctactattatgtgtgcataatttataccgtaaatgtttactctttaaatagacatttctggtctgtgttttatttcatgcgtctgggagcggataaagtgtgaggttcagggagaaggagaggtctgtctcaatgccttgacccagcatcaaagcaatctcccctccttgttccctttccctgctagttcccaatgactgacagattcacagcagaacagaaaggactgggaagggatggaggtgggacatctggcgccaatattcaggggctgaccctgtgagggaacatctgccctgaagagttggagccttcatgtgatgacacagagatctctgtcactgtattcagggaaaggatcaagcctcactccccatgcagggaggaggttctggctgtgatccggcctgtgggagaagtgaggacccgctccctctacagtgacagccaagaacctgcaggtgacagagaaggcttcccctcaactgtctcctatcaggttcttccaggcatcaaggaatagacctgggacattgcctccagtgacatgaacacacccagaagtgaggtggccctgccagggggtcctggtgctgccacttgttttgggagctcagtgtctggagaggggtgtggagagtaggctttctgcaaaacagtaatcatgacctataaattattttattcttcattagctttttgccataaaataaaacaggtacccaaaaagaaaaactgtctgaaaatgttgccctttaataataataataaataataataataaaagataaacaccctttaaccaccagagatatagaagtttgtcagccagcccagaaaccatcatttgccccagctcagtgataaaggcttcccttccccacataaaatcacagcctgacctttatgatgattgcttctttgttctattttatattttcatcctctgaaattgtagtttagttttaccttgggatgtataatttttgttctcttttttctttttttttttttaagacggagtctcactctgtcacccaggctggagtgcagtggcatgatctcggctcactgcaagctccgcctcacgggttcatgcgattctcctgcctcagcctcccgagtagctgggactacaggcgtctgccaccacgcccggctaatttttttgtatttttagtagagacagggtttcaccatgttagccaggatggtctcaatctcctgacctcatgatctgcctgcctcggcctcccaaagtgctgggattacaggcgtgagccactgcacctggcctgttctctttttttctctatgctcctccttgaaattttattgtctggctgagttttccatagtttgcattttgctggctccaccccaaggcatagtttaatatggacctgttttatctgtactttctacaaattggtagttggctacagagatttgcttatagactgacttgattttcttcttgaatacttcatttatggcactccattgtattcttccatcaggaggaagaacttagtactggttatttacttctactctacttttaattgccattgcttttcaatggctaaatctgttaattcgttatgggttgcaaaagaattatagtctcagtctctcattccttccccattcactagctgaataatttctaaaataagagatttacccttggctggatgcggtgacttacgcctgtaatcccagcactttgggaggccgaggctggtggatcacctgaggtcgggagttcaagaccatcctgaccaacatgaagaaactgtgtctctactaaaaacacaaaattagccgggagtggtggcgcatgcctgtaatcccagctactcgggaggcggaagtaggagaattgcttgaaccaggaaggcggaggttgcagtgagccgagatggcgccattgcactccagcctgggcatcaagagtgaaactccgtctcaaaataaataaataaataaagtggagcacttgacggccatgggagagaatcggttatgaccacacacagcaagatg

SEQ ID NO: 672 - DNA, 6758 bp, Human
agcaaaaattttaattttaatgaagtccaacttaacagtgttttctttcttggattatgtttttgatgcgtatctcaaaagtcatcaccaaatccaaagtcacctagattttctcctatgttatcttctggaaattttatagttttgcattatacatttaggtctatggttaattttgagctgatttttgtgaaaactgtaaggtctgcgtctaaattctttctcttcttcttctttttttttttttgcatgtggaggtctaattgttccagcaccatttgttgaaaagactatccattctccactgagttgcctttgctcgtttgtcaaacagcagttgattatttttttgtgggtctatttctaagctctgtattctggtcatttgacctatttgtctattctttcaccaaaaccacactgccttgattgctgtagctttgtagcaagtctcaatgttaggtggtgtcagttatctggctttgttcttttaatttcttttttttttttttcctgtgaatgaacaatactttctgtttctttgcatggctaatttttttaaacaaataaattagagattcctttaatgccaagttacacaatcaaaaagataacaatctctttccatttgctttttgcaaggtttgtgttatttcagggcaaaacgtagagcaagtccactggcaaatctgggggctagtgattattttgttttgatttttatttttttaaatcagacattttaaacactacaatgaggtaactctagaaatcaaattctgtccccctttcccagaggtgttttatttatttatttatttattttttgacagggtctcattctgtcacccaggctggagtgcagtggtgtaatcacagctcattggagcctcgacttcctcggccccaaacaatcctcccactcagcctcccaagtagctgggactataggcacacgccaccatgcccagctaagttttgtattttttgtagagatggagtttcactatgttgcgcaggctggctttgaactcctggactcaagcaatccacctgccttgccctccccaagttctgggactataggcttaagccactgtgccgggcctccctttcccagggtgtattgttgcttcttgtggcttatagttgcttgtttaatgacttttctaaataatttttataaagattattctttgtcatgtgtggctattacattttctgtccagttagcttagtggtcagccagtaacttgagatttctttaaacatctggagcaaaaacaaaaaccaaataaactagcaaaagcaaaaacaaaaacacccctgatctttgcaggttggctgtgttggatcactttctcaatgcttagccagtctattcacagctctgctttagccttcactttctgcatgcatggaagctaaagatgagccagaggtgaagtttaggattttctcaggtctcctctgaacatgcgtccagccttgggcacgtgagtggacttctggactccctggtatatacagagatttcctcagccttttttctcccacatatctttctccatatatctttgcatatttcccagactttttgatgtgtctgctgcttgccccctctgttagcccttgctcaggtggctgcagctagtatgtttgcctttaattgtttacagcaaacaccagccagaaggctgttccagccctgagaaagttctaaggtgtacaaaacaaaggcaagcccctgagtgtgaatccctcaggcagcaaccagacaggtcaaaacacacaaccacaattctttgataacaaggcctatattgccccttctggcatgagcaagctatataactggttataaaaagtattacattaaattatggggacagaaatgactctactagtgaatgaagaaatcatttagattttatggttagtaagtggaggtttgagagtaaccatccgatctttattaatcttagtgtatattatatttctagaatttggactcatatcaagatgctctgaagaagaacaaccctttaggatagccactgcaacatcatgaccaaagacaaagaacctattgttaaaagcttccattttgtttgccttatgatcataatagttggaaccagaatccagttctccgacggaaatgaatttgcagtagacaagtcaaaaagaggtcttattcatgttccaaaagacctaccgctgaaaaccaaagtcttagatatgtctcagaactacatcgctgagcttcaggtctctgacatgagctttctatcagagttgacagttttgagactttcccataacagaatccagctacttgatttaagtgttttcaagttcaaccaggatttagaatatttggatttatctcataatcagttgcaaaagatatcctgccatcctattgtgagtttcaggcatttagatctctcattcaatgatttcaaggccctgcccatctgtaaggaatttggcaacttatcacaactgaatttcttgggattgagtgctatgaagctgcaaaaattagatttgctgccaattgctcacttgcatctaagttatatccttctggatttaagaaattattatataaaagaaaatgagacagaaagtctacaaattctgaatgcaaaaacccttcaccttgtttttcacccaactagtttattcgctatccaagtgaacatatcagttaatactttagggtgcttacaactgactaatattaaattgaatgatgacaactgtcaagttttcattaaatttttatcagaactcaccagaggttcaaccttactgaattttaccctcaaccacatagaaacgacttggaaatgcctggtcagagtctttcaatttctttggcccaaacctgtggaatatctcaatatttacaatttaacaataattgaaagcattcgtgaagaagattttacttattctaaaacgacattgaaagcattgacaatagaacatatcacgaaccaagtttttctgttttcacagacagctttgtacaccgtgttttctgagatgaacattatgatgttaaccatttcagatacaccttttatacacatgctgtgtcctcatgcaccaagcacattcaagtttttgaactttacccagaacgttttcacagatagtatttttgaaaaatgttccacgttagttaaattggagacacttatcttacaaaagaatggattaaaagaccttttcaaagtaggtctcatgacgaaggatatgccttctttggaaatactggatgttagctggaattctttggaatctggtagacataaagaaaactgcacttgggttgagagtatagtggtgttaaatttgtcttcaaatatgcttactgactctgttttcagatgtttacctcccaggatcaaggtacttgatcttcacagcaataaaataaagagcgttcctaaacaagtcgtaaaactggaagctttgcaagaactcaatgttgctttcaattctttaactgaccttcctggatgtggcagctttagcagcctttctgtattgatcattgatcacaattcagtttcccacccatcggctgatttcttccagagctgccagaagatgaggtcaataaaagcaggggacaatccattccaatgtacctgtgagctaagagaatttgtcaaaaatatagaccaagtatcaagtgaagtgttagagggctggcctgattcttataagtgtgactacccagaaagttatagaggaagcccactaaaggactttcacatgtctgaattatcctgcaacataactctgctgatcgtcaccatcggtgccaccatgctggtgttggctgtgactgtgacctccctctgcatctacttggatctgccctggtatctcaggatggtgtgccagtggacccagactcggcgcagggccaggaacatacccttagaagaactccaaagaaacctccagtttcatgcttttatttcatatagtgaacatgattctgcctgggtgaaaagtgaattggtaccttacctagaaaaagaagatatacagatttgtcttcatgagagaaactttgtccctggcaagagcattgtggaaaatatcatcaactgcattgagaagagttacaagtccatctttgttttgtctcccaactttgtccagagtgagtggtgccattacgaactctattttgcccatcacaatctctttcatgaaggatctaataacttaatcctcatcttactggaacccattccacagaacagcattcccaacaagtaccacaagctgaaggctctcatgacgcagcggacttatttgcagtggcccaaggagaaaagcaaacgtgggctcttttgggctaacattagagccgcttttaatatgaaattaacactagtcactgaaaacaatgatgtgaaatcttaaaaaaatttaggaaattcaacttaagaaaccattatttacttggatgatggtgaatagtacagtcgtaagtaactgtctggaggtgcctccattatcctcatgccttcaggaaagacttaacaaaaacaatgtttcatctggggaactgagctaggcggtgaggttagcctgccagttagagacagcccagtctcttctggtttaatcattatgtttcaaattgaaacagtctcttttgagtaaatgctcagtttttcagctcctctccactctgctttcccaaatggattctgttgtgagcaagagtttatatggcttcatggcagcaagggaacagtcaacttcagcatcatatgcaccagtcctcggagtgccctgtgaatcatattggtctttgggtcagtgtcatcattctcttcaagtctggggcttggggaaaaaattagatcagctacggcatataaaaaagtcttttgtttcacatatgtgtaatagcttatttaattttttatcctgctacacaaatatgtaattaaccaatgaggactcatgacttgatagtgtatgtatgtaaagggatatatggacttaatcataagctgttgaggtgaaagacgtggatccacctgctttccaagaaaactcggccaaatttatttgcagctggatattgaatgggacttttctggttgtcttagaattctggctaaaggctcaaagctgacgaaagacagtaactgcaccaacatgatactagacacagccagtctggacttatcaaaagagcagaaagagaccaatgactcccagtccgtattatccatctctagaagactagagtcaaaagcgtgattaaagagtcattaagcggaggttctaggccatagggagattgctttgaatttcttgcagacaagtgtgagggactcagcatggtagaaggtagcctggcatcccactccaagactgaaagcttgcagagtaacaggagcacacaggttcagtgcagcagatgtggtgtggcttgagaattcttggaagagcttgatgagtgtttgctggagtccgagggtgggcactgggaacacagagactggtaaatagtgtttggcaaatacaagtgcttgatgaatatttgttgaatgaatagatgagttcttcccccctggggaattcaggaggtgaaaggttggcttgagcacccaaaatggcaggatgagagaagagaagcactgatagcaacctgccctcccattattgacatggtaaaaggatgtgaatttcttcacatggctttgactatggaagagtagctgggcttgcattgtcatgacgggatatcagccaacagggtagcctgttgtgcaaagaaactatagcagtaagaggacacggggttaggcagaagaggggtttggggtggaggttgctgcaagaggtcagccagataatgtggccctgcatcatggaactgtgcaatgtggggtacactcaaggccctccaataactcacagatgtgccctatgaaaaagccagcatttggactctgccatagcagctggcaggatcatgctggcctgtctgccttattcaatagttaactacaggaagatctgctcctctttgtgtaataccctcttcccttgcaatggcatagggacatctagaatatagagaagacagagacaatggaggaagagtaaagaaactgactatatgccttcgtcatttcactgcaaggaaggccaagcagatttttgaatgaggtgtgagattgctgttaaattggactggcctggacattttaatcccttaaatagaggtgcaatgactaaagtgagatttgtcactaaaatttatggtatctgcccaagattcaggagtgatgatgggaggagatccaacagaactttgttgtaaggcaatggttagagaaaaatgaagccctcgctttctggacttagttcattcaataaaccagtttcggccaggcacgttggctcacatctataatcccagtactgtgggaggctgaggcaggtggatcacttgaggtcaggagttcgagaccagcctggccaacatggtgaaaccctgtctgtactaaaaatacaaaaattagccgggtgtggtggtgtgcacctgtagtcccagctactcgggaggctgaggcaggaaaatcacttgaacctgggagacagaggctgtagtgagctgagacagcgctactgtactccccgctgggcaacagagtgagactccatctcaaaaaagttaaaagaaaaaaaatctggtttca

SEQ ID NO: 673 - DNA, 58111 bp, Human
tttggaaccattgttgagtctgtattggggtcaaacggtattgcagaagaaaataaggcgtttaggttttaggtcaggtgtgagttgaagaggttttaagttcttgagaacacaggctaagggagaagaagggggaatggagggtggaaggttgcccatagtgaaggaggcaagcccagagaaaagaaggtagagacccggagaaggggggtggtgagcagccctgggctgcaatgtggctgagcagccaaagcaggcgacccacaattgacttgccaccaagggaatgtgggtgaatgaccaaggcaggcatccccacggtgatcagacaccaatgaaatgtacgtgaataatcaggcaggtgtccctgcagtgattaaacaccaagggacgactgttttcctgagtccgtgaccggagctggagttttgggtccatggataaaatatgtctcctttgtctctactagagaggagaaagaactggaattggaaatagagggagatttaagggtagtgagagaggctggagaagacagtgaaaagaccgcttacccgatttgaaattggtgagatgttccttgggctgtttggtctgaggacccgaggtcataggtggatctcctcacagagtgagggtgaggacaggggactggtctcctgaaggagtcctcctgtcccgggtcttcggcaccaaatgtcacacgtgtccgtgtgaagagaccaccaaaaggctttgcgtgagcaataaagctgtttatttcacctgggtgcaggtgggccgagtacgaaaaaaagagtcagcaaagggagttaggggtgtggtagctttataggatttgtgtgggtagtggaaaattacagtcaaagggggttgttctctggtgggcaaggcgggggccgggggggtggaaggtctacaaagtgctcagtgggggagcttctgagccaggagaaggaatttcacaaggtaatgtcatcagttaaggcaggaaccagccattttcactacctttgtgattcctcagttgcttcaggccatctggatgtatacatgcaggcttgggctcagaggcctgacacaagttggcacatttgatcctatcaactttagtttgcactttcacttttgatttaagaacatactttctgtttctcagagggcagcctctgatgggaattttaatactcacaagcatcagtggctatatgattgaatgtacttcttcagtgtgagtaagtgacaactttctgtagcatgatatcccttatggacacgatccccattcaaaacgttttaaaactattttattggggacatttattagcatgttaaaactcttttacaacctattagagcatatgcatagaacataaaatgtacactgccaagaacaaatttaaggataggaagaaaagcttacattttttaaaaagtataaattgaaatgtatgcagtgtaatttaaatttgattacgttaacctccatttcatcaggaccacgtgtcgcgttttaacaagagtttccctatcatgtccaggctttggctctggttgcaggcgctgggtaggcacttttacgaggagggacctggcacgatggcaccacaaattcccaagtgtgtcacctctgggcgaacttgggcctgtccactcggccctgcgcggtggccaggggctcaccctctcgcaccgggcgtccctctgcgcgcagcttctctcgcccccccgcgccagacccgggcgaatggcagcaccgtgggaccctgccttgaccgcccccgcccttcggcggcctctcccagcagccggcaggctcttgggcgcgccaacagaggggcgcggctgcggctgtagtcgcagccagttcccgttccgggcccgcgaggcagccgccccggtcctgcccctccctcgcgctactgcgggagcagcgtcctcccgggccacggcgcttcccggccccggcgtccccggaccatggcgctctccgggctcttctctagctctcagcggctgcgaagtctgtaaacctggtggccaagtaagtcccagcgactggggattcgcgcggggcaggccctttctgaggtcctgggcgctgcgagtgaggaggcgcagggaggcgggatttgcgtgcgggcggaacgcagcgcggctctggaggagctctgggtggaaccaagcggagaaacccgcgagtttgaagcatgtagcgaaagttgagagggatgaacttcacagtcagcggaatcgtttatcccactgtggtcgaacgcaggggttctcaatcgtgccagcagcttagaaccacctggggagcttttaaaatccagatatccaggctgcaccctagatcaattccatcagaatctcacggagtcagacccaggcctccgtatcttttaaaagctccccaagtgattccagtgtgcagccagcgttcgagggtttgtggcaaaggctggaagggcagacaggggccttcatggagtccctcctgcagacgggacagcagctcccagtgtcctgcttggtcctggagagagggtgagaacttcccttgggtttcatgctccacaaagtaaggaaatgagacaatgcttggcaaggtcgcctgaatatcacattcaaaaacgcctccaatgtgtgcagttgttttggcacattgtgaaaaacataggaaatgacagaggttgatgtctcattagctctgcattctaggaaacatttcggttgttggtgtttgaaattaagtctggggaagctagtaaacccatggccttgatgacttctggcctttctgctttaagggtgaagccagggccgggcgcggtggctcacgcctgtaatcccagcactttgggaggccaaggcaggcggatcacctgaggtcgagagttcgagaccagcctggcccaacatggtgaaaccgtctctactaaaaaaaaaaaaaaaaaaattaaccgggcgtggtggcgcatgcctgtaatcccagctactcgggaggctgaagcaggagaattgcttgaacccgggaggcagaggttgcagtgagccgagatcgccctgttgcgctccagcctgggcaacaagagcaaaactccgtcaaaaacaaacaaacaaacaaaaaacaaaaaaacggtgaagccagaagtcgtgcttgccaaagggtcgagtttgttctccctcaaagcccctgttgaagattgaactatcactttcagggaagagtaaaagagtaactccacgatgcatcttagagaggagtggattccctgttctcacccaggcttagatgccaggggccaggtagctgaaatccaggcaaaccaggcattgacaaagtacagacttctaccgaatatgccagacagataagcaagctgtgtttaaaacaaacagcagagtggtagaagagggctctttcaaatattgtaagaagagtaggttttatttttgtggagtggagaaataagttcacgctttggaacccatcaaatctgggtcaaaactcggattctgtcacttctatgctgtgactttgggcaagttccttgacctctccaagcccctgttttcccacctgtaaaataaagagcaaccctctcctgaggctagcatagttcagcgagatgatgtgcatcacacacctggaaggtggtggcgctggcaggtgctctggcagaggtagttattagacactggagtggcagtttgtgcccgttaattgtttacttagtacagccactatgagggagaatgtctataaaatgttcccttcaacgctccattccttctcctgccctgctgccccgctcagggccttagcgggctttaagtctgaaatcttaggctgcaaatcccctcagtcccccagggcgtattaatggctctggaatacagttttactgcatgtgataggaatgaatattttgacacacacacactcaaaagctgttcttaatcttgagacttcctcctctctgttgccacatatatatcttttaaatggctttccaagaaagctgggctgtgcacagtgtctcagaattagtgtatgtgcacacacacgcacgttgctccctgctgacaacatcctcagaccatacccttggtgttcctgttttgctcctgactcttggcctagggacagtgaatctttcttgaatgaccaaggacagtcagggatctgaggaagggagaacccaaattctacaattgctgatgcctgcgtcccagctggaactttaccctggtacgtgctctgtgcatcatggatggtcactttgatcctaacagcagtgctgtttagattagacatcagaaatagaaacagtaagtaatataggcataaagatcaagtgtttttctagtgtatgtgtgatcactgatatttgcttacacaagactatcaaagtcttatctcttattcaaagaaaaggattcaatatttgttcaaaatctaagatatgaacgtaggatttaaggtttaagttactagtttcttctatcattcttattattggggggattttttttaggcaagaagaaattagaaaagctaaaatgtgtacttatgctgaatttttgtcatgcagaggctctaggtattttgcaagttttcagaagtcccattttcttttatcttctagggacagtcagttgcatgtcacacaaggggcctcctttgatttatccaaaaggtctgacctggtttctggaaaaactctttagcgcatcaaatactcgttgagggcaagtgttgtttctaaacttgactcttgtggtgagaggtgagtagtcactggcatgtcagttagctgacattttttacccacgctagaaagttcattcaggcaagacttcctggcttgaactcttatttaaacatgtgttttatctggaactgccacagtccaaactgtgggcagagattcctgtgcagagttggctaaggcaggcatgccaccggcccttctcttcgccatcctccctgtctctggagccattgagccaaccggggatgatgccactctgaagggatctcaccttggtcctctaatggggcagagttccctgatgagggatgcacgtccttagagccaacaaggcaattttgtattatactgcatggaaattaaaagttactctccagtaaactgccactttagaatttgttttactgaagcgtccttttcctctaaattatagagcactgtagtaagggcccagataatttcaaagtgagcaccagattagtgccagattttggcagattaagattttaataaaacatgaacattcaccttgattacatttgtttcagaaagttgatgtcccttggccttctgttctgtcattgccaccatacaggttagggtcagaattgggagaatgtagtcatttggtagatattttcagagccacatgcaactgggcctggcagtcacatattgctaaggaaacgccttacatgatagcagagctgagagcagatgatgatttacttgggagagtattcgttttctaattcccaaaagattaaaagtctaatgagtaagaacttcccctgcttcttgtaacacatgcccagattgctgcctatgacctcaaaaccaaaccttcttggaaggaactgggggaaagctaggcttttttggcaggggatatcctaactccttacaacacaggccccttcagtgagtgggtcatttctggactccatttaacaaagctagtgtttcatacttaatatgaaaacaggcgtgttgatgatttcaaatagagatgttgggtctataaagtataccagacatgcagggctgaaatggaagaaacaatgggttttggagtcagaaccaggatccaattcctgttttattccttacttcaggggtccccaatccctaggccatggaccaataccagtcggtggcctcttaggtgggccgcacagcagaaggtgagcagcagtgagcaagcattaccgcctgaactctgcctcctgtcagatcagcggtggcatcagattctcatgcgaggggaaccctatggtgaaccgcacacgcgagggatctaggctgcacattccttatgagaatttaatgcctgatgatctgaggtagacagtttcatcctaaaacgatctcccctgtgcccctactcgccgctgtctgtggaaaaattgtcttccatgaaaccagttcctcgtgccaaaaaggttggggatcactgccttaactaactgtgtgaccttcaccaacatacttaaccactccaactctgtgtcctcctttgtaaactagttacaataatgctttccttgctgggcagttttcagtatttgatgagctaatctatgtaaagtgcttagcacatcacccagcttctagtaagtcatgattatgatgataaagattatgatgattactttggttccagggctggtctttccttctcctagttgtgtgacttcagataaggtttttaatcttcttgagccttggcttttgaatctgtaaaatgggctaactctacctatctggaaagattgctttgaggcttgatttgattaaatgaaatgatgacaggcctgatctggtagaccctaaataagaatagcatttacatagacttcctgtgtcccacactggtctaagagtttagggtttttgttgtttgtttttagctcattttatcttcccagcgcccctgtgcagtggttatcatttcccttgttttatagaggagacaactgaggctcaacaagattaaataactagcccaaagtctatcccaggacttgaagcagagtccctgttcttaaccactgccccagctgctcagtgagtacccccacccctgcttattctacctacctcctgatgcccatctcctgccattaacagtcagatgtgcttatgctctgtgtagggccatatttctggaaacagagcccctgcttccaaagagcagcttacttaggaagtgaaagtggcagctcactcctcctgtcgcctcctcccacttccagataacattaaacctcatccattgcttaggctggttaatatcaactggaaaaaaaaatctgataccgatattgactaacattattagagtgggttgcaatgttagttttgagataaatgtcatctcgatgcactgagattgttagcctgtgtgtaataaaacatgccttcacccagacagatgtggggggtgtttggaagacagaaaccaggcctaggagatcccaggttgagactcaggtggacagcaacagtattgaaaataatattacatcaaaggtgcagtggtctgttctaagtacaccaccttttctgacattccttactcatcctccctctcctttaccccagtggctttggcctcttcttgagttctggcaatcttccctgaggtctgggtcagtggaatttgggggcccagaaaggcaaattctcagttgagtgaggtgtggcttctttagcattcctgataatgaggtagtaattgcttttctggctttctgtgtgtgtgaagtgctctgctggccccctaccctggtgtggaaggctgttagaaagctatttatagctcttggttccttctggcactttggggcttcaattctgcaacatgttaattcaacaaatattatcagaaagtcttgctggtgccaggagtctactaagtacttggattacagcaatgaatgaaacagaccctgcctctggccatatggaatttggaggctgccgggtggagaggatgtcttagtcagcttgggttgctaaaactatcacagactgggggacttaagcaacaaacatttatctctcacagttctgcaggctggaagtgtgagacctggttgccagcatgggagtttggtgaggaccctcttcctgatttgtgaaagaggtttctcatgtctcttgctataagggcactaatcccatcattggggctccacccccacgacctcatttaaacctattcacctcccaacagccctatctgtaaacaccatcaaatcgggggttctccctcaccatgtgaactttggagggacataaacatcagtccataagtaggaggttagggcagtaagcacacaggtaaatacataattgtaacttgtggaaagtgctttaagtgaaaacaacagcatgtcatgagacaggagatcagagcagaactagaattaggagagtctggggacgcctctcaaggaatgagccttttcaactaggacttgggatgaaaaaaagagtgaaatcatgctggatgcagagaacagtgtgttcaaagacccagaggtgaatgggaaggatgtgggtgtgttgagtggctggtgtggtaaggcccaagcccaggagggtacagagctaaataatgagacacactcaggccaagtagggcctcctgggctgggtaaggatttgggattttattctaaagtgcggagggaagctttggaggaatttcccctcctgactttttcctgtcattcataatatacaagaaaaagatcattagtcacttctatttattcagataatgaacaatctctacttcttaagctatataaaccttgtcttagtgtgtgaaacaattctggagtgtctagttttcaatctccagatgagggaactgaggctcaaaacaaagtgaaagaaggcagaggcaggatttggaaccaggcctgcccagcccacggcacatgctctgtagttttctgggacagatgagtgtaaatgcatatgggcctcctaggcacccggcatccttcatcaggagcttcagtggatggactagggtggagtccagtccttcctggctctttagaaacaggaacaaaagaccccgaagagtggagggaggttgggcatgtacaggtcagggggtcagaatctgtaggcaccaaatgtcagggccccctggctatgggaagggctgtcagtttttcacgctagtctgttctgctccgcctagctgttgcccagaaatcccaaagagggtgccttcccagctctgttcacctttgaaaatctgaattcatcatttgtgtgcacttgagagacccagggtttggtaaaaacaaaattctttattgggtgttttcaggtcacaggaaaagcctccactgtgtgggacccacatccttagcactgcatgctggctgcttccaggcatctgcactgaccctgtttctccttccttgctgtgaagcggtcatgaggttgcagtgccagatgtgttgcaggccaggtgtatctcggctggttgggcaggccttctgcttaacatgggacctcacttagtgagggaagagagcagtcctggcccaaggggtgcagtgtctggggcagatgctttaggggttatggctctatcatcttctcaacctcttaatgccactcagggtcaccacacataaatccctgggtactctcccacttagctctgtgacaggtttgtgtcctagatgcttgctgactctgtatacatgttcaatggggttaataaacgtcttcagctaagcattttggccagcgatcagcagagtgtttatttgctgtgggcccggtttcaactcccactttggtggtgactaatatattttgttcttgtggagtgcttttcacttgataagccccagacactttctgtgtcagtcctaaatgccatatccagatgtcctccagcttccagatcggccacttctgtggcactttcctctgcataaacacttcagccctctcgcagagtggagttccaggaaaccggtttccacttcaaggctctgttgttttctgctggctttcttcattaagatatttttattcactggcccctcagagatgaatatcaagtgcagtgttttgggaactttgtttttcaaagcctggataaaaccaagaaaatgtcaagcagtaggtgattaagtaccaagtggtcgcacaggcaatgcttttgacattgacagctgggctctggttaaccttttaaagacagcagcgaagataaatgccttagagcaacagaaactattggtgatggaaagttgaatttattcaccaataaacttggtaagtgacattccctaagtgagcctgtgaattatggaaatccacgtatcagtggacatgatgaagcacctgctatacgcagtgcacccggccagattcattcattcgacggttcctatcgagcaccctctatgtgctggagatacggtgactcaccagatggtcgccctcccttgtcatcagtgctggccttgaagatgacagatggaaatgctggcctaggctgccctcttgtaggtcacggccggtgcttactatgtgaccagtgctgttctaaataccgtatgtacgtgtattaactcactgcatgctcacagagatccctacatggagtaggtgcagttattatctgtacttacagagaagaaaacagaagcacagaagagagcattatttgtccaagtcacatagctggtgattggaaccagatagcctggctttagagtctgtgtccttcactgccactaccaaccaatgtgaaaggaaaataatcaacttaggacacaaagttgcacgccctctgagagaggcggggatagaataccatgggccttcccagcagggagagatgggcttaggggagaaacagagtaaggtgggaaccctacccttttcccattctgacaggtgacatccccgctggggggatggaggaaatgtttggctactgaggaggctactctggccagaagtagacaaaagaagcaactgtctcgcagccaggagacttggatgctagttttgattgatccggacaagtccagggccctgcccagggcctctgttttcccatctctaaaataggtggcttggacaacattctgtttgacctcaggagcccaggatttcagcagagaagggaggagctggctctctgtgcactctgaacagggtttcctgaccagaagaagatgtttggctctgagagatgtgggggcaggcattggacttcccagaaggccttggcagctgtgaaaggatgtatgcgttccactgtggtcccaccccgaatgctgacgttggctgtgtctgcattcctttctttgtaggcaggatggcagtgtctgtgtgtctggagctcacactataaggtactttgtatgagagacagagggagctagagggagggaagagggagtagggaggggaaggaagccgggagagagagaggtgattccgggagggactgacttccatctgctttcaaattctgagggattaagtgctttcagatacttaaagtcagtgagtgtcaatggagttaaaaagcttccaataataattgtagcttcatccatctgctaaattgtctccagagtcggctgcctatagtgttctggcatggcagaggcccacatgaccgggcttgttttccaggttaagttccttaagaaattgtaaaccaagcaagaaaaacaaacagacaacaacagaacacagattgttgtggatcatgcagcaggaaaagtaggacaccatttgagctgaccaagcatatgtgttctccgtgcagctctgtcgaagctgtgtaaggtgtgcttggtgctggctcctgccagatgctgttggcatggcttcatccacccagcttgctgttgggtaacttgcagagtgaagaagtctgttgttcacgtcatcaccacaaccctgaacatccaagcagttcatgtcaacaactagagtataattatcttctttacttgtaaaactgtggagcctgtggattaaattcaccaaaatgaatcatattcaagagaagtcatttcctaaaggagaattcagatgtggtccccattcatgggtatatgtgtgccagttatgttgggggttggtggagcccactctaattgacatttgcaatctgggttatatcacctctgaggtaggcaggtacctacatgaggtaggcagggaatgatggctttaacttagttcattcaataaatgaatatcagttatctattcctattgtccaggatggtggtgggcagaatgtctgagaagcccatgttgtgtatggcaggttgtgactttaccagagatggcattttctggttaaacttgggtgataggatgtgtttttaacagaaagggaaaaagaatctgaactagtttccttggtaataataaccatttgggttggggagctgatactggttaggaaaatgtgaggcccctttgacatcatccatttgctgctgagaaatcaaaattaaaacatcactcggtgtcagaatgttccagaaggcagttgagctgctaatgttttgaagtgttcagaggtatgtgttttatgaaaaaaagaggaaatacaagacaaaggaaatgaaacgtttggcaaccattgagcatttcttcaatatggtatttcttgtggctctgggattttaaaaatccacttgaaagccagtattgttgacttttgctctgtactatttttgtggggactgattatttttcactttatattccttatttctaactaggcttaatggtaataccctaagttgatggccttctactaaatttaaaacaaaatataggccgggtgcggtggctcactcctgtaatcctagcactttgggaggtcgaggcaggtggatcacctgaggtcaggagttcaagaccagcctggccaacgtggtgaaaccccgtctctactaaaaatacaaaaattagccgggtgtggtggcaggtgcctgtaatcccagctactcaggaggctgaggcaggagaatcacttgaacctatgaggcggaggttgcagtgagccaagatcacgccatcgcactccagcctgggtgacaagagtgaaactctgtctcaaaacaaacaaacaaacaaaaataacaacaacaacaaaaaaaactgttcccacccacaatcccatcagatttattgtgatactttcacaaaacaggaagagctttttattgatttacaggtgcacagaaagtcttaacatctcatctgagtttgtttggtcttaatgaaccatcgtttagtttaatgaagaccaagcattttctctctagggcaggtgggccctttgagttgaaagtcatagttcctcaaaacaaggcagtcgctgagaatgttgtgctggcctgcctcaagatgtcctgagatgccctaatgaggaaaaggccctaaaatatttcaatcatgcaagtgtatagccttcttataaaaaaaaaaaacattacgaataaaagtcctaccctactcctggtgtcctctccctttccagaagtaattttcattctcacaccgtgtgtcttctcacaggtggttttctttgcatttacattcacgggcgtatgcctatagagaacgtggagtgctttgtgtatttggagggcaggggatgtgggcaagccatataaatgttattatactctatatttctttctgcaacttacatttttcaagtgacaggatgtcttaaggctctttctatgtcagtacatgcagctccaccgtgttctttttcatcactggtcggcttggcttttagggataccaacccagtaattctaacagaaatgatggatgtggttctgtggagccaagtgaggggtggagtgaggtggcaggacccaacacaagttgggagaaggtgaatgatgtaacccaaggacaaataaagaaggtgcatgtcctgcctatttttcttcctagtaaagcagtatctccctatatagattactgctgagtctgaggtagacagggaatggtgttatattttatcttaaatcttaattccataaatagttatagtatctgaaaaaggttgtagtgacttttctgtgctaagagggatcctttaatgtagtgggctcagacaacgaaggttttttgttttgtttattttttaagaaacaggggtctcacttgtcacccaggctggagtacagtggtgtgatcatagctcactgtagcctcgaactctgaactcctgggctcaagtgatcctcctgcctcggcctcctgagtcattaggacagtaggcgtgcaccaccatgcctggctatcaaacaatcaaggttgatttcttcctcatatcttatgtcctttgcgagttggcaagagctactcattgtggttatttgtgggcctgagctgatgcagctgcccccatcttgtgctaatcatagtgccagaagcaaaaaaaaaaaaattgcacattgataaattaagcagtgatggctaaaagcctcctacccaaagcaacacattctgtttctgctcatgtttcatgagttaaagcctgtaacttcaaaggggtagggaagtgtaatcctaccaggtgtctaggagaagaacctgaactgtttgatgaactgaatacttctaccactgtgttggttttcaaggaaggggtgggaaagtctttgaaaactctcctgtgacccataaagttatatcctagaagccaatcctttctgtgttcataaaatcactggccttttcctgtggccgccaaggttgcagagagcagagctgtttgggaactcacttcaagaagtggtcagagcttgaggagggagggtcaggacaggagcagaggcagatggcatggcactgggccaggttccatatgacctgggtgccagcaaagctggccttggttttgcttatgcttgtatttgttaccaacctatatagcaagtatcacagtagaaaaacttacagaatggcctgactacacagagctcactgttgaaaaacgctgggttgtaactctaagatagcatctgctacattgctaaagaatgttttataacagggcttagatctgttaggaatcttagctgctactgttgcaacaccaatttatggaaagctgtgttatttattttgaaatataaacatgaaaaaaaaaaagagcgaataatgattcccaacaattgggtgcctgaagaaagagtgaaatcatgaggccagtgttgatgatgggaaatgactttcttgaggtttctgttctcaatctggccccatcagttgggatggagtctagtcttgtctgctcatgctgggaggaaggcgctcatagtcacaatggagcagggaaacctctgctgggtgattctgcacagcatgaagctcctgctaaatggatcatgtttgctagtgttttttaggctgcagagaacaggggcacactgaggctatgttcatgggggtttattataaagatacacaaaataagggaagccgtggctggtggcctcagctgtgggcagccaaacccacacctcctgtgggtttttgggactcagcatctctctaaatgtctcaaattcaaactccctgagagaggagctctaactgggtctccctgtcacctgccattacagagggctgcaggggagcagacacgtctgtgatcatgctggctggagcccaaggaagcccttgagagccacggcacccccctgtctctctctgctcatttctgcttccacacattcaccatacttgtgattccttgttctgtgtctgtctgtcctgcccagttgtaaactctgtgagggcagggagctacttgacctctgtgtgcctcagtttcctcatgtgtaaattggcggtaacaatgacccctggcacctagggttgttgcaaggattgagataacagaaattagtaaatgattcgctcattactgagtgccagccctggcctaggcattttgtgcatattaactcacttaatccttacagcaacattttgaggtggaactcttaccttgaggcaatcacggcacagaaaggctggctaacttgctaacaagtgatggtccttataatcagtgatcttataataaagtcccatgaacagacataaactgagagtgcccctgttccccacagcctaaaatcaccagcaaacatggtccatttagcaggaacttccctctaatttgctcatgagtcagaatttgaacactgctgtctctagagatcccagacaccacagatttcacccttatgttgtcctgcctctcaccatgtgtataaagccttaacatccatgctgatgccctagtacaacacttggtgttagctattatcagactaggccctgctggggcccttgcacgttgcagggccggacatgaggaagtgctcagtggatctctgtagaaggaatgaacagctgcaacctcatggagttgtcccaccactctctgcccctgcccacccccttgcagctatcccacgggtcacgctgatggtagagcactgtcatgtgcctcgcagctggcagaggctgctgggcaaggtgtccaggtttgctttagcagttcaggcaggcatggccgggccgaggaaagggagaccatttgccattatctttgagcctccctttggcacgtggaatttctcagatgcagagctttaaagcagcagagtggcaggtgagttcttacccttctttataagagaaaaaccagggaaagcaaaacattctgctttctagaagccaagtcatccagaagccagcttctgcagctccaaagagggccttagcagttacaaagaaacacaagataacggtaagagaacaacaaaaacatggtgtaatgccaaacatgcaaaaagtcagtgtgggcgcaaatgcatgcagagaaaagctgaaaggaagtgctccaaaatgagaatagtggttattgcatgtggataatagggaacttaatttattcctctaatttttttttttgcatttcccaagttttctacagtgagcaggtattgttttatacttacagaaaaagttattaaaacatagaaaggtacatgtggagaacatctttataaaatgtttttttttttttaatcttagcatctcagttataagaaatgcacatctccgctcaaggtcccctgggacagtgcaaggaaagaaagaagcctgcggtgaaagtgacactgagtgagtgtgtatctgtggtttctctggggccaccccaggattcagggacagagtcctggttgctctccaggaggtgagactcctttctaggtcaatcatttcctgaggggtcctggtgacctcacgagatattaatataatatagttcggttagtacccatttctgtttcccagcttatgaacacttcctgttgctcatcatttttgtttttgtcttgggatcattttttttctacctgaaaaactctatttagtgttcattttagtgcagatacggtagcaacaaagtctcagtttttgtctggaaaaactttattttgcctttccttaaaagaaaatcaatttcatggaagtgtaatttcatacaataacattcacagatttcaagcatatgggttgctgacttttgacaagtcgtatgtatctatatgtatattcatatatatacatacacacacatatgtgactgtatacaagggagagagcaagcatgcaatcaagacacagaacatttctatctccccagaaattttccttattcctctttgcagtcaatttctcccccactcccatctgccccctgcctcaggaaaccattgatctgatttctagatcagattttcagaatcatatgcatgaaatctttttttttttttttttgagatggagtctcactctgtcacccaggctggagtgcaatggtacgatcttggctcgctgcaacctccgcctcccggattcaaccaattctcctgcctcagcctccctagtagctgggattacaggtgtgcaccacgatgccctgctaatttttgtatttttcgtggagacagggtttcacaatgttggccaggctggtctcgaactcctggcctcaagtgatccacctgccttggcctcccaaagtgctaggattacaagcgtgagccactgcacccagccctaagtactcttttgagtctggcttctctcactcagtgtagtatctgtgacactcattcatgatggattcttgtttcattggcatttattgttgaattgtgttctactgtatgaatatgctatactttgtcaatccattcaccagcagttgtcctctgtgtgagctacaagttattctattatagccaggactggaagtcccttgtttaaaaagaaaaaacagcaaaaaaaaaaaaaaaacccatcagaacccctgattcttttcaaaaggcgggtttctagaaggggaagttactaaatagaaagttttcagagtctgttgacacatattgtgtcaaaggactttccagagacttccacagatttacatttccaccagtggtataggagagtcctgactcaccaaacatcaacagcatttttgtatcttactctctatctttgcaaggatgcaaagctgcaaaattgtatgcagcagtgaagagaattttacattgagtataaaccagtaggtccagtgtgtattttcttcctgagtttgcagaattttcagtgacctcacgtctttaacctctgtctcactgagttgccgatgaaactgatctgaaaagccaattaagatcattcctggccaggcacggtggctcacacctgtaatcccagcactttgggaggccgaggtgggtggatcacgaggtcaggagatcaagaccatcctggctaacacggtgaaaccgcgtccctactaaaaatacaaaaaattagctgggcatggtggcaggtgcctgtagtcccagctacttgggaggctgaggcaggagaatggcgtgaacccgggaggcggagcttgcagtgggccaagattgtgccactgcactcccgcctgggtgacagagcgagactccgtctcaacaacaacaacaacaacaacaaagatcattcctggcatcagtatttcaaatggaagggcagcaggcaggaactctgatgtctcaacaccctagcttttagtgattgccctggagtggcactgtccacttgagtagcccctggccgcatgtggctcttgagcactggaaatgtggttgatccaaactgagatgtgcgattaaaacacatgccaggtttccaagccatagtatgaagaaaaagaatgtaaactatctcattaataaattttttgttgatgggctgggtgcagtggctcacacctgtaatcccagcactttgggaggctgaggtgggaggatcacttgaggccaggagttcaagaccagcctgggcaatatgatgaaaccctgtctctactaaaaatacaaaaagtagccaggcatgggggtgtgcacctgtaatcccagctacttaggaggcggaggcaggagaattgcttgaacctgggaggcggaggctgcagtgagccgagattgcgccaccgcactccagcctgggcgacagagtgagtgagacttcatctcaaaaaataataataaataaattttgtatggatgacatactgaaatattttgagtgtattagaattaaaatatatcattgaaattaatttcacctgtccatttttacttttattagtgtggctattagaaagttttaaattactaggaaagctgtgtcatatttcaattcaacagagctgctctatggtctcctttttccctttgaagatccgccatcctgcaatccctgcttccttttcaccagagcagcttccctgaatcttctcctggaggctctgcagaccttttctttagtttggaagatcacattgcaggaggggacttgggcactggtttctgtgaggagcccggagtggtgaattgcccctgggattcccttaccctggaaactaaccctctctgagggcagaaagctagaaagaagagcggttgagaggaaatgcctgtgcaacccccagctcccttcggggctccctcactgcccacaggctctacccccacctgcctttgcctcaggagatggcttttggtggtggactcaccctcctccgatctcctctgcttcatttttccacttggtgatccatcttttgttctgcggtgtgtcctgttttctggctgcctccattagcttggttttttcctttgggtatccctggagctgtcttaccaggatctccaacttcagtccccattggtctgcaccactggcctgggaaagctccacccaggagagcagacccagctcccagatacctggccccagcccaatctccgtcctctctttgcctggaagagaggaccagaccgtcttcatcaactggacccaccctttaccaagcaaagaaaggaaaggattgccccccagggccagcagatctctggctgtctggtgtttctggtaataagtgcccatgaacttcgaattgatctccagtctcccatggtatggttttggtctacccttagattctgtttaccaaggcagagttcagtttctctgctttcccttccaacatccataccttgttaagttcttgctgaattgagctaactctgcacacctgattaaatcttcagccagggctctggacattataaagcagcctccttgccagatggctgtcatataatatattgctttatttaggtgattgtaagtcaggagactttccttcggtttctgcctttgatggcaagaggtggagattgtggcggcgattacagaaaacatctgggaagacaagttgctgtttttatgggaatcgcaggcttggaagagacagaagcagtgagtaaaacgggcccctcgtggtaggcgggcaaaggtcgggaaaggagggatgaaggaagctgtgcaacaccccttcccagctttctaaagaatggagcatggcattgcaaaatgctgaatcacaaagtgagaagtgacttctttccagttttctctcagccttgtgatgatcttaaagagaaagtctcaattctgtgctactgtgtctttaacatctctcaaatgcttccgagagaaaacaggccccaaccctggagcctttccaggcagcaggactagctggaatacagtaacattgtggtatttctggtgaattaatttttgtgttactttctatgtattgcaaaggatattttttttctgtttctaatggtgacattacattcctttaaaattattagagttttcaaaactcaattgaaagcaaaaggttaagcaaataaaggacaggtgtgactcaattatggcaagaacaacaaaaaagtgactatggtggggacgttgaacatttagaaaacactgtcctaaaagaagaaggtacagagagtagtctgatacctgggagtactagattttaaaattattctcttgccaattttattcattcattcaccatgtgccacaataatttttttaagtctttctttgattttgcagattccagaaataaattggaaattgaagatttaaacaatgttgttttaaaatattctaacttcaaagaatgatgccagaaacttaaaaaggtattattaactgctaatttaaatttaatattgtcagctggtatgctttaaatgaaccgattttctaaagctaaggatcctaaagtgggtcatagaattgactgccatggaaaatagccgggtgtggtggctcacacctgtaatccaagcactttgggaggccgaggtgggcagatcacttgaggtcaggagttcaagaccagcttggccaacgtggtgaaaccctgtctctactaaaaatacaaaaattagctgggcatggtggcacccgcctgtagttctagctactcgggtggctgatgcaggagaattgcttgagctcaggaggcagatgttgcagtgagccgagattgtgccactgcactccagcctgagccacacagtgggactctgtcaaaaaaaaaaaaaaaagaaaaggctggattagtatttaataacttttattggaacaataactaatattttcatacctttaaatttttttggtgaggatctcttgcccttctgttgctgataattttaaattttactctttcctgctctatcatttggattctaaaaagaaagctattgtgtggggtctggcatttgataggttaaaaaaagaaaacatagaagcatgtcaaagagcaggagactcatgtgccacttggtggaaaaaaaattgagaaccactggacctgaatgttaacagatgtggcttgtgaaacatattaatgatgtggatagtgttaaaagatctatgagcttttttttgaactacaaaaaaaccttttttttactctctctctgaaatgcatgagttttcctgcctagacaaacgacaaagtggccaattccaggcctttccacttccaagatcattttacacacgcaagtattcctggacaagaagaggctgaaggatcttctgtgggatttttttaaaaaattattattttttgctgttattgttacaaggaaggtagtgagtgcaattttgggataactcagatgaacccaaatgttttttaatgcccaaataaaatagcctgggtccctgttcctacccagacaagaaactcagcacttgtaccaggttttcaagggtttccagagagatacctctcttgggaatctaatcccaggaactctgtgccggctctccctcttcctcctgcccctctgccctccctctgtcccacttcatgccacatgggctattgcttttccctcctttcccagggtgcttgtgtataacagactttgctgaaggtcaaggacacgggggaagaggttatagcacaacccaaaatgggcaacagtgactgagacatcaccgtccgcaggttccttgcctctggctaccacaggagacttcatgctgctgtctctcttctcaggctattttgtgctgagaccgtctcccaccaaaccccacaggtctttctttctcagttctgggcctgttccctgcttggggaatgcagaaacctccaagccctgttaaccttattatgtaaaataaacacctttccatctctatcccagtataggatcaaagcacacttttgctttatagtaataataaagatgttttgatttaaaaataaaaaagagttggctatctctggtcacctaccctagagatgtaaccctcaagtgcaaacaattaaattatgattttttttctttaatgcatctaagataaaagtttttttagagacagggccttgctctgtcacccaggctggagtgcagtggtgtgatcatcgttcactgcagccttgaactcttgtgctcatgtgatcctcctgccttagcctccccaatagctgggactacaggtgcgccaccatgcctggctaattttttttatttttgtagagatgggtgtctcactatgttgcacaggttggtctcaaactactggccttacttcaagctatctacccatctcagcctcccaaagcgctgggattacagtcatgagccaacttgcctggccagataaaggtcttaagcatggttccttcctgctctaggtagagaaaccccacaaccagtgggaggtggggtgagctctttctgtagcttttgctttgctgatgatgtcattgatctcttcaggggctgcgcagagtagcaggggccctggagggcgcggcctgaatcctgattgcccttctgctgagaggacacacgcagctgaagatgaatttgggaaaagtagccgcttgctactttaactatggaagagcagggccacagtgagatggaaataatcccatcagagtctcacccccacattcaattactgaaaagcaatcgggaacttctggtcactcacatccgcaatactcagtgtctggtggacaacttgctgaagaatgactacttctcggccgaagatgcggagattgtgtgtgcctgccccacccagcctgacaaggtgccccggggacagggacgggcatggcattgtgtggaccccgggagctagaagaggcctctccctgctgatctgagtgaagagcgtgggagtttagtccagcgggcagggctgcattttggggtactaatagcacacaaatgcctgggttagcaggttgcacagtcaggtattttacttctgtgtttgtgtctggagcaaaccctgacatctcagttctcattgctgtgtgtattggttcccagacacttcatttttagatcccctttaaattaggagggaaaaacaacataagcataagagcatccccagcagcgatgttcattcagtgcctctgaaggctggagggctgcttgttgctgggtgagactcggaggggaaccgactcagggtcaggaatgatgacatcccacggtgggtccacagtgaagaatcttccccgctccactgtgggacgccttaacagcccttacttccacttacgctttgcgttatctcctgaaaaataaaatggagaccacaaattccttcttggttagaggaatgacacaactcatttatgacatgaccccgctgggactcagaagagaccaggacggtttctgggggaagcagtagcacactcgtgtgctttgttctcttctcttgatttgttttcccacatttttaacaagaaaaaaagccgtttttaatatatggcctatcgccctcctactgtgtggcccaggtgcctacctcattatgcccaaggggtggttctcacctctccactctcattcctgcacagcagttgtgtcaggttaagagggacaaggagaaggctgggcaccgtggctcacgcctgtaatcccagcactttgggaggccgaggcaggcagatcacctaaggtcaggagtttgagaccagcctggccaacatggggaaaacccgtctctaataaaaacacaaaaattagtcgggcatggtggtgggtgcctgtaatcccagccacttgggaggctgaggaaagagaattccttgaacctgggaggtggaggttgcagtgagccaagattgtgccattgcactccagccctccagcctgggtgacagagcaagactctgtctcaaaaaagaaaaaaaaaaaaaagaggtagagaagtccatggctatttgtctgtcctttttatttttaggctcatggaagcctcctggtttcttagagctgagtggttttatttcttgctcaggaggtcatttcacagattttcgggctccaatatgttgactgtcacagcagctggggggatggcatagctaccggctgtactaagaactcagagccctgccctgagcctgcctgagggtccttatggtaggaggatgcccctcatgccagcccgtgccctcatgcttgtgtcacctccaggtccgcaaaattctggacctggtacagagcaagggcgaggaggtgtccgagttcttcctctacttgctccagcaactcgcagatgcctacgtggacctcaggccttggctgctggagatcggcttctccccttccctgctcactcagagcaaagtcgtggtcaacactgacccaggtaggagtcagccccagcaagaccgcaggcaccagtgcaagcagggccctggggggtttggtaatggctgggccagccctgagtgccacctcaggaagcaggcccaggtgctattttgattttagaaaggaacagctgaatcctgtctcccaagtgcagcccaggtggctgcgattgaactgcccacacctcgatggtctggtttatagaggggcctttggaagtatgggaatggcctgtgttctgaccccttgctttcttcctattctgacatatgtagacattttaatggttgcacaaattcaaggttgtatttttttttcttttaaaaaaatctttagctggacatggtagcacacacctgtagttccagctactcaggaggctgaggcaagaggactgcttgagccccagagtctaaggctgcagcgagctatgattgtgcccctacactccagcctgggtgacagagtgagaccctgtctctaaaaaaggaaagaaaaaaattaaaaagccttgccaggtttgattctaggcaaagtattctgtcaccgttgagtgccagtccttatttccaaactaatggaagaccccatcagttaactgattagttcaataagtattttttgctgtatccaccacatgccaagaccctacactgtgctggatgtcagggagacagtggtgagcagacacagacagggttcctgccctcagggagcttcaagtcagctggaagagaccaccagtcagcaatctcaaaaatgtgtcaggacagcggcagtccaaggcatgtgagaacatatcattagggccaggatctgctctggggcaggagtcttctttccctgcttttgaactctccactttgagacagctgttggtaacataccagcaccaaggacctaagtcctgccttttaaagaatccaatatgttgttggaaacagaagcacaagacaggtgtgtgcttaggggaaacaaggccagccggcagagtgtcagtgctaggctccagcttccacagcccctgcaggtgcctgccagccactgctagcttctgactctgtctgctccttcctgtctccccttgtttccttcccccatgaaaaaaaaagaaagtattcccatgaggaatcattctttcgaaagacttctctgttggttccgttagccagctactttactagcttttacagtgtaattcactctacaagcagtctcacacaaaagactacatattgtatgattctgtttatatgaaatgtccagaaaaggtaaatctatagacaaagcaaatcagtagttgcctacggcccagggattggctacaaataggctccagaaaactctgggaagatggtagagatgttctagacctggactgtggtgaggtttgcacaactttgtaaacttactaaaaattactgacaaatatataacactccctaacactttgggaggccgaggtgggcagatcgcttgaacccaggaatttgagaccagcctgggcaacatggcgagaccccgtctctacaaaaaaacacaaaaattagttgggcttggtggcatatgcctgtgtcccagctacttgggaggctgaggtgggaggattgcttgagcctgggagtttgagactgcatgattgggtcactgcaccctagcctgagtgacagagcaggaccctatctctaacaacaaaaaagcagtgttggtggaggagggccagcgtggccatctggcctggccctcgagtgcgaggggcttcagtgtttagctgcagttcagtgatgacactgtgcggaggaataagggtggcctgtctcagacactgatcccagctgaagtttgtcaccttctttctggcaaatctgaggtcaagcagagagatcaaagcctggggccctcagggtcaggaatgctggctctgtgacgctccccaggtcctgcatctgaggagtggctgcgctggcctcagggcccaggttgtgaattttgtttatgcactcgcctctcctctttgagacctccctgtttgatgctgtttctgcctctctcctcaccctgctgctgtgccctgccaccccctccctccagtgagcaggtatacccagcagctgcgacaccatctgggccgtgactccaagttcgtgctgtgctatgcccagaaggaggagctgctgctggaggagatctacatggacaccatcatggagctggttggcttcagcaatgagagcctgggcagcctgaacagcctggcctgcctcctggaccacaccaccggcatcctcaatgagcagggtgagaccatcttcatcctgggtgatgctggggtgggcaagtccatgctgctacagcggctgcagagcctctgggccacgggccggctagacgcaggggtcaaattcttcttccactttcgctgccgcatgttcagctgcttcaaggaaagtgacaggctgtgtctgcaggacctgctcttcaagcactactgctacccagagcgggaccccgaggaggtgtttgccttcctgctgcgcttcccccacgtggccctcttcaccttcgatggcctggacgagctgcactcggacttggacctgagccgcgtgcctgacagctcctgcccctgggagcctgcccaccccctggtcttgctggccaacctgctcagtgggaagctgctcaagggggctagcaagctgctcacagcccgcacaggcatcgaggtcccgcgccagttcctgcggaagaaggtgcttctccggggcttctcccccagccacctgcgcgcctatgccaggaggatgttccccgagcgggccctgcaggaccgcctgctgagccagctggaggccaaccccaacctctgcagcctgtgctctgtgcccctcttctgctggatcatcttccggtgcttccagcacttccgtgctgcctttgaaggctcaccacagctgcccgactgcacgatgaccctgacagatgtcttcctcctggtcactgaggtccatctgaacaggatgcagcccagcagcctggtgcagcggaacacacgcagcccagtggagaccctccacgccggccgggacactctgtgctcgctggggcaggtggcccaccggggcatggagaagagcctctttgtcttcacccaggaggaggtgcaggcctccgggctgcaggagagagacatgcagctgggcttcctgcgggctttgccggagctgggccccgggggtgaccagcagtcctatgagtttttccacctcaccctccaggccttctttacagccttcttcctcgtgctggacgacagggtgggcactcaggagctgctcaggttcttccaggagtggatgccccctgcgggggcagcgaccacgtcctgctatcctcccttcctcccgttccagtgcctgcagggcagtggtccggcgcgggaagacctcttcaagaacaaggatcacttccagttcaccaacctcttcctgtgcgggctgttgtccaaagccaaacagaaactcctgcggcatctggtgcccgcggcagccctgaggagaaagcgcaaggccctgtgggcacacctgttttccagcctgcggggctacctgaagagcctgccccgcgttcaggtcgaaagcttcaaccaggtgcaggccatgcccacgttcatctggatgctgcgctgcatctacgagacacagagccagaaggtggggcagctggcggccaggggcatctgcgccaactacctcaagctgacctactgcaacgcctgctcggccgactgcagcgccctctccttcgtcctgcatcacttccccaagcggctggccctagacctagacaacaacaatctcaacgactacggcgtgcgggagctgcagccctgcttcagccgcctcactgttctcaggtgaggctgccaggcaaggggagcaacaggtgggccgggcgggccaggctcggagggcatcgggaatggcatcatggaccaggatcccccaggactcatgaccatggcccttggaatgtccagaccttttctttcttagcagggcagaggtcaaggtgcaaagcttcgaggcaggtggacctggatcagccacagctgggtgcccttgaacaaagtgcttaactctcagagcctccacgccctcatctggaaaaagaagatgctcataatcctatcaattatggccacagggaccaatgttagttgagaatgggtgaagtgcattacaaatattacctaatggaatgctctttacaaccctgtaacttaggtactgttattgtctctattttggcagataaggaagtagaggcacagagaagttaatagcttgctttaggtcacacagctcagacatagcagtgccagaatgcataaagaaccttccttttaagattaatgtaaggctccgagatagccctcaaaaagtttctggaatatgggagcttttattactgcagagaaagcagaccttgtgccagttggcactggtgactttctgtgatcaacgctagcagcccttcacactgctagagacctcagttaaaatgctgactcgtggttgttttcctgttccatagtttacgggaaacagagcccagtctgttttcttctattagcatttcctatgtaaaataaaccttgtaaatctctacagggggttaaatttgccattacttgactcatgcatttctaaaaagcagtagggatttggaactgactcccagtgcctgtcacaccagtgtcagagtgtaaataattgcatggggacatggggtgcagggggtcgaaggctgccctagcctgggaattggaaaacctggagtctgttctctgtactctcagccagtgactctccctctgtagccccaggcagtctcacactcagtgccaccctctgtccatcttttttttttctcccccaaatggagtcccgctctgttgcccaggctggagtgcagtggcgtgatctcagctcactgcaacctccgcctcctgggttcaagcgattctcttgccccagcctcctgagtagctgggattacaggcacacgccaccatgtccggctaagttttttgtatttttagtaggacggggtttccccatgttggccaggctggtcttgaaatcctgacctcaggtgatccgcccgcctcggccttccaaaatgttggggttacaggcatgagccgccgcacccgacccctctgtccatcttttcaatgggaaactccacaccagtgtggtggccctgcccttcctgctgtccccaggtgaagctttccttcacaccagtgcaagaaaaaacagcttgtaggaaagcagaggatatgggtaaccacgggaagcacactcagttctctggctgcatcagttaggattagttttagctgagagcgaaaaccccaaatgttggtgagttacaagcttatttctctcatgtaaaagtctagaggtaggtagttcaggactggtatggagtctccatgaccctccggagcccaggctctcttctgccttcctgttctgccatcctcactacccggctttcccatcttggcccaagagggctgctcaaactccagccatctagtcgacactctagctatcagtaagaaggaagggcaaagattgagagcatgcctcaatcttttaagaacacttcttggctattactaattatattgctgcttagatttcagaacttaatggtatgggcagaatttaatgagatgggcccagctaaaagatgggggaatctattgctaagaaagtatagatattgggaatgtctagcagcctgtgctgtcttgggctggccatgccatgtacatacacactatttcccagcaccaagctggggactctgagggaaagggtccagagtgtctgacttgatcattttgatgtggcctaaaaatcaagcttttaattgttcagccttttacttgttatcaaggtcagcttgtgggtctaattgggcccaaggcttgtgtttctaagtaaagttttattggaacgcagccatacccatttatttacttactggctgcttcacactacacagttgagtagctgtgacagagaccacatggcccacagagcctaaaatatttgctgtctgacactttacagaatgacatgagcagtctcctttgacagtgggactcacagccttttccagtgacaaatcagggttagcccatgtgtttctggatggggggaagctgttggcattttgggtataacagttcttgtgagacctgtccagcattttgcaggacacctaacatcattggccctgcctgcaagatgacagggcactccctcctccagtcacaaccactaaaagcagcccctgacatttccaaacccatgccctccaccatacgagaaccaggtacagggtctggctgacacataggtcacacgcaaagggtggatgtcagaggtggctggcctcacacgtcctccctgtgtccttcacggtcgtgtgaggagccaggggctgtgctgcagcctcgctcatgggctggtgcaggatgggtctggcggccccacgttggccaggctttgtaaggggctatttggctgattgctgtggccattctccaggggcgtctatacctgagaaaactccagggcctgaaggcttctggatctttgtaagattaatggtccttcataatgagtgcctgccctgactcgtaatttttttgctgttttatttcagactcagcgtaaaccagatcactgacggtggggtaaaggtgctaagcgaagagctgaccaaatacaaaattgtgacctatttggggtatgtctttctccagaacactgggccaactacctagtaataatacagagctgcagggaattcacattcccataggtccctggatgatcggcacggatggcccagggctgggaagagcgctggcccaggagttgagagtcctgggttctctttgtggctcggccagtcatgaagtcttgctgagcctcagcctcctcacctgtaaaactgggatcccagtataggcaagtaggcttacaactggttattgggggatgcaacgagaatataaggggatatatttaataaatgctagaatcctgtttacatattagtctggactattttgggtccataatccctcatccagagcctttggggcaagacccgaatggggattctgagtgcatgctatggcatgacgtggccgcaggggtctaaggcagtgccccattttcaaacactttcatatttctcccgcagaatgtatgaaacagtcaaaccaagtgtggtaagaaagactataagtagctccacatcagttgccaaaagaattgtgagaaactttgggcattcagagcctttgaggttttggagtctgagagaagggattgcgggccagccccacacaactggtggctctgcaagctggagcagttgttcagtttcttggggcctcagtggccttcgatgttaatgaggacatggacgcaaacgaccccgggccacactcggctccagggctctgtgtggctgtggaaccctggaagcctgagcttagctgcctttcaacttccatctgctgtactattgaattggcattgagcggtgagatggctgaaaggtagacatcgagaagttttaatattcagaatcttttcttctcaagacgctgaatgtaatcttagttgtaaatacccatcacctgccagtcaccgagcactcatgcaccagggctttgcgttatgtcctaagatcctcataaccaccctgcaaggggactatcatcattacctctgtattacagatggagaaactgaggcacagagaggtaacgtgacttgtctcaggccataaagctggggaaagtagtggagctggttttgaacctgagctgtgagacctcagagccctaaactctggtgcctgtgtgttcccctttcaacccagactttggaaatcagtagacaccatatgcttcaaaaaacaggggctattaaaatgacatcaggagccagaaagtctcatggctgtgctttctcttgaagtttatacaacaaccagatcaccgatgtcggagccaggtacgtcaccaaaatcctggatgaatgcaaaggcctcacgcatcttaagtaagtggggtaggcaccaggttccttagtatattctcttgatcacccccttctgttgttcaaagattaaatgtcacagtaaagagctttcatcctaaagccttccacttgtcccagggccatgttggtcaagtaaagatacctctgtgtgatctgtgaggcttggattctggaagggcctcccgttattggtagggggaaaggttggcattttgatttcattaactactaggccgaagaaaggactaactctcaccctttctggtggtctttttgccccaagggagtttcctgtcgggttgcaaggaagagcttgggcccttgccctgctgtaggtgtgccctgcgcagggggtgacagtgcgccaggcttggagcctctggtcctgccctgacagtggccacataccttgacccttggcagtcaaagtgggacctcccaggtctcccgagggaagtcagtgatgctgctgaggtcaattagaggaccccagggagggctcaggtccctgagcttctgcagagactgtggaccatctcctggagaggaaccctgactgactgtcctcagggcttcagttccctccctgacaggaggcccaggccatggctcttgtggatcccagaagaaagtgtacggttcccaagatggggctggaaggggctctgtgctggggaggagggtgacccacattggagcccctgcatagctggaggctgactgtgtgtgactctctctgcagactgggaaaaaacaaaataacaagtgaaggagggaagtatctcgccctggctgtgaagaacagcaaatcaatctctgaggttgggtgagtagaaggggatggatgtatgtggtacaacctgctgtgtgtgtggggggcgggccttgctgttcttttcatacatcagtacaccagaaggaccactggggctcgctgtcggggagagatagtggagagctttcaccatgctgcgaaactgaaaccgtgcccattaagcaataactccccggtccccctcccccctgcctcttgcagccaccctgctacttactctctctatggttttgactactctacctcatgtaagtggaatcatacagtatttgccttttggggatggctgatttcactagcatcatgtcctcaagattcgtccacatggaagcatgggacaggatttcctttttttttttttttttttttttttttgacagagtctcgctctgttgcccaggctggagtgcagtggcatgatctcggctcactgcaacctctgccttctgggttcaagcgattctctcgcctcagccacacgagtagctgggattataggcacccgccaccaatcccagctaatttttgtatttttagtagaggcggggtttcaccatgttggccaggctggtctcaaactcctgacctcaaatgatccacccacctcggtctcccaaagtgtcaggattataggcgtgagccaccgtgccccgccaggatttccttcttttttaaggctgagtaatactccattgcatggctatgccacattttgtttactcattcatccaagaacagacactggcttgcttctatgctttggctgttgtgaataatgctgctgtgcacatgggcatacaaatgtctcttcaaggactgccttcaattcttttttttttttttttttttttttagattctttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccacaataaacatacgtgtgcatgtgtctttatagcagcatgatttatactcatttgggtatatacccagtaatgggatggctgggtcaaatggtatttctagttctagatccctgaggaatcgccacactgacttccacaatggttgaactagtttacagtcccaccaacagtgtaaaagtgttcctatttctccgcatcctctccagcacctgctgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcgaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggcgattttgctcattagttgatgcagtttcttcctagtctcgatggtctttacattttggcatgattttgcagcggctggtaccggttgttcctttccatgtttaccgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgaactttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcagtgtagatgtcctttctggttgttagttttccttctaacagacaggaccctcagctgcaggtctgttggaataccctgccgtgtgaggtgtcagtgtgcctctgctggggggtgcctcccagttaggctgctcgggggtcaggggtcagggacccacttgaggaggcagtctgcccgttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggctatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgatcccttgcgcttcccaggtgaggcaatgcctcgccctgcttcggctcgcgcacggtgcgcgcacacactggcctgcgcccactgtctggcgctccctagtgagatgaacccggtacctcagatggaaatgcagaaatcacccgtcttctgcgtcgctcacgctgggagctgtagaccggagctgttcctattcggccatcttggctcctccctccaattcttttgggtatatatccagcagtgggattgctggatcacatggtaatttttaattttttgaagaatcatcatactgttttccacggcagcagcaccattttatgttcccaccaacagttcattctagtttctccacatccttgccaacacttgctattttctctttttgacagtacccatcctaatgagtgtgaggtcctgtctcattgtggttttgattcttgaggctttttaaagctttttgtttcattataatttttattggattacaaaaggaacacaggtaattttatttggaaactatgaaaaataataaaaattatcttctcagaaaatgattcttgttaacatttaagctcagttaagctctctcactttctctcccttctctctctttgtacaacttttaaaaaatatagtaggggtgagactatatgtatctatactatagtaggggtgagactatatgtatccttcctttttcacttaatctcatgccttgagtagctttccactttattaaaaatgtgatgccattcaattgtatagtaaatacatatatgtaagcaaaacactgaaaactcttattctgggttccagcaagccatacctggaatggtgtaagcaggtagtttgcttggtgtgaacgtgttgttgaggcagctgccattgtgttgtgagtgggccacacgaacttgttctgttgtgtgtagacagtgtgtgctgatcctattaggaacagccaacgctttgtgtgagccacacacggttctaagtgctttgcttctgttaactcagtgaatcctcacaactccatgacggaatgctctaattatccccattttatagatggggcaactgaggtccaagagactacataatttcccgaagttcacacaggtagcagatggcagagccgggtcaggagtccaccatcttaccacgcagactgttttagccagagactctccggatctgctgtaggggacagaatacagctttatcgccgcacctgtccaccaagatggccgtagccacagagcttggttgggtaacgtcctctttatgtgacaggaacgttgctgatggggtttctgaaggtacttcctgctctttgtctcctggaagactgtgtcttcaggaatgtctctgaccctgcccagagttgaacggatgctgggaacccagcacctgcacacggccttccctccaggactctgcgcacctctgtgctccacaggagacatgcaggtgctttctctcatgagctcaggctcctgggctgacagctctccgaagctcgtggtgaggctcggtctctaactgtgccacttgccgatggcctctgttcacaaggcttcccctgctcttcgatcttgcatcaccccttgaatttgaaatccagagcagcccactcagagaccagtgtgaggaattagtgtccaggccacagatccagggactgggcacaaacatctgcctgttgagtaggaactgagctgtggccattggcaaaaaaggaggggtgagcatggctgtttcttggggagctaacattcactatcttgtctcctccctcaggatgtggggcaatcaagttggggatgaaggagcaaaagccttcgcagaggctctgcggaaccaccccagcttgaccaccctgaggtaactgtggccctgctgtctccaggggccaacctggtccctcccagctgctctaggtttgctggggaagggtgattcgtgctcctaatagaagaggaatttgcatgtgtgattttccttactcttgtcaaacctttctttgatgcataagaggccatctagtaaagcacattcttctctttttttaactttaagttctgggatacatgtagaagatgtgcaggtttgttacataggcaaatgcatgccatggtgatttgctgcacctatcaacctgtcatctaggttttaagccctgcatgcattaggtatttgtcctaatgcttgccctccccttgccccccacccccaacaggccctggtgtgtgttgttcccctccatgtgtccatgtgttctcattgttcaactcccacttacgagtgagaacatgcagtgtttggttttttgttcctgtgttagtttgctgagaatgatggtttccagcttcatccatgtgccagcaaaggacatgatctcatttttttttatggttgcatagtattccatagtgtgtatgtgccacattttctttatccagtctatcactgatgggcatttgggttggttccaagtctttgctattgtaaatagtgctacaataaacatacatgtgcttgtgtctttatagcagaatgatttataatcctttgggtaaatacccagtaatgggattgctgggtcaaatggtatttctggttctagatccctgaggaatcaccttaagtgtttattcagctcagtgaattctgcatgtgtcccacaccagccaaccaccacccccatcaagacagaggacatttccagcccctcagccatccctgcatgtcccttgctggtagagggagggtttcctaagtgcagatgaaacttaataagatgctggccagcagattcctgccccttccttgtcctcaggatgatgctggaaaagagggactcttcctctctataaatggggatgcacctacccagcccccgcttaggctgctggccaaatcttgggaccttggtatgtccacggctctgctgctgttcttcctaccactgaaaaagagtccaagaaggtggggacagtagcagaagagactttgccaggtcttgcagatggggtaccttgatggggccagcctttagaaggacagcttgccaggcctcgccagcctcctgcccatgtgcagaaacctgaggtgccgaccccagcccactgttgtgtgagcaggctgtgctgatgacccatttcccgtccagcctgcccttgtgctctgtgtgtgggctctggggcagcagcgcctgggcactactgctgcagctgaacacttctgcatcctgccccgagtgagcctgggctggggccacagccaggcagaggcttcccagctgttctgatgttgaagctaagattgaatgtagatgtgtctttaataattcaccccaagtgtgttccttcctagtcttgcgtccaacggcatctccacagaaggaggaaagagccttgcgagggccctgcagcagaacacgtctctagaaatactgtggtaatagctcgagtcatttcatttgtttgtttgtttttctgtgatagggtcttgctttgtcgtccaggcttgagtgcattggtgtgatctcagctcactgcagcctccacctcccaggctcattcgaacctcccgccttggccttccgagtcctgagactataggcatgcaccaccacacccagttaattttaaaattttttgtagagatggggttttgctatgttacccaggctggtcttgaactcctgggctcaagcagttctcctgccctggcttctcaaagccctgggattgcaggtgtgagccactgcacctggcacagagtcattttggagggtttaggtcccaggaattatcccaggggctgcacatggcctggaatcttaacagaaaaggtgtctcccaattggaaaggctctaggcctttcagttaagttgataatttcctcctagagaagagaatagccacttctacaagcataaacaggtacaggaggaggaagtgggctccgggagcctggatctgaggccttggccttctaggccccaggagaactagaacgctggccatgcaagctatccaggtatccttggataccttcagatgtgcttagcagaggccaacttccacacacttggctcaaaattttctcccttcctcctcttcatctgccttcccccaggcagcctcctccttccccaggtcttcacatcagggtttggcctttatgctccatccagctcatctgtcacttgtcacctgaagcccacagtcctcgctccctctctgcactctagggcacttactaagtggatgtggcctcctgagagtgttttttgttggtgttcccttttttatggccacttaatgttttattttgctttatttgtatttacatctctgtatcataaattccatacaggtggctgggagcagtgactcacatctgtaatcccagtactttggaaggctgaggtgggaggatcgcttgaggccaagagttcgagactagcctgggcaatatagcgagaccctctatctacaaaaaaaaaaaacattccttacaggttaagtgagggagttgtattacaaccctccctatcatctactcagagcccagtgctcatttgatcttgctaaattagttactgagaataatgacaatatcctcttcatgagagagttttgacattaggcctgctgtccagtaagtgcattttaaattctttcccctcaacaaatcatttaacattttgaaaagtagtttatgttttttggaaaaaatgtaagacactaaaggaggacatgaaagtacctcctaaagttcctgctaaaaggaggaagtgaaagtacctccctttgtgttttccaaaataacctttcctttctagccttttgttctatgtatgttcaaagatatgcaaaacagaatagcattcaagcagtggctctaaaaatattgtaatcacatactttacatgtctcctttagggtttctccatcttgatgctgttgacattttggtccaagtgattctttattatggtagggctgtcctgtgcatcatagacggtttagccgcatctctgccctgtacctcccagtggtgaggatcaaaaatgcctccggacatggccaggtgccccatggagagtgaaatcacatggatagtagtaatgtcaacacctagaagccctcaagtgctgactgcatgccatgtgttattctacactttttccctgtgttaactcactcagcctcacaaccactctatacgatctctactgttaacgttcaccagtgagaaaactcagacccaaagaacttaagcctgttgcccgaggtcaccctgctggtgggtgatacaaacctgcccaggctgagtccggagtagatgtcaatgctgtgttcttctccctcctcattctacctcattctccctacaagctgcacaacatctcgaatagatatcacaatatatttcatcagttgtttctgatctaaatttgttcagattttacattaggataataccacaatgcatgctgcaatgtataaagctttgtgtgtatatccttgcacactgtagggtaaatttctagaagtctgattgtcttaaaatgaagcacattaaaaatttgggcaggcacatccaaactgcccttcaaggaatttttttttttaaatgttctttctgttctattcttcttcctaatgattctttcgtccactggcacaagtgggtcctaccctgtttacaccaaggagctttggtgctttatccagaccacttctggttctaaggaccattgagagacttcctgaactttcagtcacttaacttgggtccctcacaagttaactgagagcaaagtactgaacacattttaatgtgcagtcagtgactgtttcaggtcttcaaactaacttggataacacactgtcagtggtgttcaagggaccctgggactagaggagaactgagaagcaggcattggccctttgttttccgtgggcccccatcttccatgaaatctgagggctcagcaaaggtggggagggagggtgggctcctctacaggtagctgggctaagaaataggagcccaggtacaggatttgcattaaaaatgagtcccattgaccttctgtggggctgacaggctgggcttggagcctggctgttttctgggttctcagcaagtgatcatctgcatagctggagagccttgggctgagctcccgctcctgtgaactctaaaacaatgtctgccaagtaggctctcttgagtaaatacttccttttttttccttaggctgacccaaaatgaactcaacgatgaagtggcagagagtttggcagaaatgttgaaagtcaaccagacgttaaagcatttatggtaactcagagagccttacaatttcagactgtgctacttttcaaaagtattttttgagataaaatttacatactgtaaaattcactctcttaaagtatacaattcagaggtttttagtgcaaccatcaccacctaattctagaacattttcactcctcctccccactccaaaaagccctggtatccattaagcagtcactccctgtcctcctccccagaccctggcaaccactaatccgctttctgtctctatggatttgcctactctgggcatttcatataaatggaatcaagcaatatgtgaccttttgtctctgtgttctagcatgtttcattcctttttatggctaaatgataattcactctaaggaaattttgcagtttattaatcagttgatgggacatttgggttgtttctactttttgactattatgcgtaatgctactgtgaacactcctgttcatgcttttgggtgaacatatgttttcatctcttttgggaatatacctgggaatagaatttctgggtcatatggcaattctgtaactttttgaggagccaccaaactgttttctaaagtggatgtactattttacattctcgccagcaatgtatgtggattccaatttctccacatcctcaccaacacttattattgtccatcttttaaaatctagttatactagtggatgtgaagtaatattgtggttttgatttgcatttccctgatgacaacaatgttgaatgtctttttatgtgcctactgggagtctgtatagcttctttggagaaatgtctccatatcctttgcccattttaaaattgggtttgtcttctaatgctgagttataggggttctctatatattctgggtgctagacctttactagatacaggttttgcaagtattttctttctttctgtggagtttttcctctttcttgatagtgacctttaaaggacaacagtttttaatttttgttttttttgagatggagtcttgctcttgtcacccagacaggagtgcagtggcatgatctcagctctctgcaacctccacctcctgggttcaagcgattcttctgcctcagcctcctgagtagttgggattacaggcatcagccaccatgcctgtctcattttgtatttttaatagagatggggtttcaccatttaggcccaggctggtcttgaactcctgacctcaggtgatccacctgcctcagcctcccaaagtgctgggattacaggcgaaaagccactgcacctggccaatagtttttaattttgatgaagtccaatttatctatttttttctttggttgcttgtgctttcagtgtcttatctaagaaatgattgcctaatccaagatcacaaagaactccacctaagttttctgttaagcgttatagttgtttcccctcacatataggtctgcaatccattttgagttaatttttgtatagtgtaaagtgagggttaacctcattctcttgcacgtggatatccagctgtcccggcagcaccacgtgttgaacagattatcttttcctattgaatggccttgacacccttgtcaaaaatcaattgaccataaatgtatgggtttatttctgaattctctgttctggtccattgatttatatgtctctcctatgccaggaccattgctgtagctttgtgtagtacattttgaaatcaggaggtgtgagttctactttgttcttctttctcaagattgtttagaccattctgggttctttgcatttcttatgaattcagactcaccttgtcaatttctgcaaaaagactagactctgctacatattgttttttctttcctttttagcctgcagaattatttgatcccattccctaagtgcaggccagcctctccagggagagcagagctaggacagggtcagaaagagagtcttggctgctttgtgcattcccaacctgcactggccctagtgaaggcagcccgagtgggtggatgtgcctggacactgcaggctttttaggggcattaggtgctctccttcctggcctcctgccacatcttggttggaggctgccttccctgccttcaaaaaagcctaagtggtgactagaaaacagcagagtgtaactgaatacagaacttggtgcccacttcctggttctatttttgtcccttttgaaagggaaggtcattacctctgccattgaacccaggggccctagcccttgtggggtatggctgggagcaccagatcctggctgcagcccagccaccagtggtcctgtgtgcttgggcagtaacagtgacaagagctcccttccccctggacactgtgcctaataccctcctcttgaaatctcacacacccagtggatggggggcactcttatagttattctcagtttacagatgacacaactgaggcacagacagatgcgtttatttcttcaaggttctgtagctgaacagtggggagggagggtttaagaggagctgcacccgctctgcaatactgcctctcacgagggagtcctcttcattcatgacagcatagggccctcgtcttcctggtaagggcttccttcttgggtcagtgccaggatttctaagggtcatgtttagcaggagcctattctacaaacagccaggagcagggaatgactctgtgatgaagcggagacactacagcctcttgatgcatttatttcctggttgggttagaagcgtagctgcccaagggagcatttcaggagaggcctggcttcctagcgatagctgaaaactttgtttcatttgaatcactgctacccagaacaatggggtgcattctcagagtccccattattaaagcttttccactgagccccatgagaactattcatgagaactatttcatggcagcataactgtttctcctccctccctcttgcatgttggtagcctcttaactttaaaacctgccttgcctttccctagctacctggaaggagacgtcagacttcctgtcccatggtgtgtttcttacaatttgttgttcagattggtggtctcccaaatatatataaaaatataaatggagtctcactctgtcacccaggctggagtgcagtggcacgatcttggctcactgcaacctccacctcccagttcaagcaattctcctacctcagtctcccgagtagctgggagtacaggtgcacaccaccatgcccagctaatttttttgtatttttaatagagacaggttggccaggatggtatcgatctcctgagctcgtgatccacccacctcggcctcccaaagtgctgggattacaggtgtgagccactgcacccggccccaaatattttgattatgcacctctgcagtgaaaaatgcaaacacacacatcagttcatgtattacattatgttcactataaaaacaaacagaaaatttaaaaaatatcaagctatcctttactctagtggatcttacctggacacttttagccagatacaaagtcacatggactcagttcttcccctgaccaacttgtctcttatcccaaaacacccttgcaactcccttacgaaggggtcaaatttgatccagtattatggattttatacaagttatgttcttctttcaggcttatccagaatcagatcacagctaaggggactgcccagctggcagatgcgttacagagcaacactggcataacagagatttggtaagatcccagcgtttgtcacagtaataacaccagtgactgtttactcaccaccactgactgtgcaaggcacaacgcagggtggtttctgtttattcctccagcaaccctgcacagtaatggtattacctctgttttacagaggtagacagaggcccagaccagtgaaataaggttgcccaaggtcactacgagagaagctagaattcagcccagaatgcctgattccatattctgtgctctcctgccctgggcccccgccctcatctaccttcattgggtgggatgggggaagtggccagtgaaatgatttcctagtggaagtaaatccccctgggactcagcaattgagagatgactgtgttggccaggagtttggagctcattcttccccttttctgggttccgtaagacatttccaggctgacttgaactgacctgtgctctttgtctacttcttttttctgctttgagaacttccttatgctaatagaagaaaaaaagtttgctttactgtgacattgagcgccatgccacttctttcttgcctcccataaggcacagacactccccactcagcagctcccttaacaacttaattgcctgggtgacgtgggactgggtggatgctgggagaggggccttattaactatgtcctcctttcatgactggggagaatttcatagccaattaaaaaaaaacaaaaaacagctccttggccaacacaggctcctcatacagtgttttttaaactttgctttagaacttgtttggaacttgtcataaaatcgatcagtttggtgaattgcaaccaacaatatttaaaaagaaaacagaacagaacaaaatatcaggatgcaatgtgcatggtatgaaagtatcatttcattcatcttagttcatgcttgcatgtgagtgggtgtgtgtttgcataagtgttggttcacaacataaaatgtaattcttatttagggttgtagacaaaaggtttttttttaaaaaaaacactgttggctaggcatggtggctcatgcctgtaataccagcactttgggaggccaagatgggcagatctcttgagcacaggagtttgagaccagcctgggcaacatgcgaaaccccgtcactacaaaaattagcccgacatggtgctatgtgcctgtagtcccagctactcaggaagctgatgtgggaggatggatgcatgggagatcaaggctgcagtgagccaggatcatgccactgcaatccagcctgggtgccagagaccctgtctcaaaaaacaaaaaagaaaaaaagaaaaacaccatcatagagaatagagcccagatctaaacagacacctgtggcctgtgtgcctgcgaagcccagcctgcccagcagcctgggaagcactggagggcactggaactgtttgcatgggtgtttgccctcaggccactccgtttctgctgattcttaagttttgaggacagcaggcagagggggagaggaaggagactgccagactacagaacagtttgcagagcacagttggcttccacttttctctgtagctggtcaggcgggtagtaaagacctacagttgctttaattctgtcaagtttcaaaatctgcattgcttccctcttgagggtcaccattcctacacaaggaaccattttagtagggccaggagacttcagcttcaaggcctgcacttgtgtcagggtggagaggggaactggccaccaattcagagagggcaggacaggcggcatgggtgctggtcttgggagtgtcttcacttaggtccctggcttgttctgggagcctccagagcatgctcctctgtgtgtgacttcatgggactgggctctgagaaggctgtggctttgttggccctgccagggactgccacaccaggccacagggttgtggttgagctggccggggagccacgttcagggagcagctctgcttggagccaacacttacagagtaagccttctccttggacttgttaactgtactgacacttatttctacctcattcctttctgaaaataacttggaagtctgaagtcccttgatgagttctgtctttaagaacagaaattagaggtgaacaatgaacactgtaaattacagaaatgtatcccactccagtataacagctttctgtgaggctatctcctccagactgtggctctgggagggtggggcctgagtcaaggtcctagggactagtgctgtgtcttcatttattccttgaataacgaaacgcttgagcatcagggactgtgctagcaccaaaaatccagtggtgaacaacatggcttcatgggttcactgtctagaaagggagaagcacattaaagaaaaaatcatttgcgtaattatttaattacaactgtgatgggtactatcacaaaggggaaggccaagagggaacctgatttagatgaggttgcagggaaggcctctctgaggaagcagcacttacactaagccatgaaggatgaataggagctagtcagctgaggtgagtattctgcgtagggaacagcatgtgcaaagggtctggggcaggagggagtgtggtgtcctggaagaactgccagaagctgctgtgccccagggttcagacagtgtggaagaggggactacaggaggctgaggagataggcagggactggaccataaaagatctgtgggtcatgatgtgcattttggtctttatcctaaaagtgatggaaagtcagtgaacagtttgaagcaggagaggcatgtgatcagatctgcaatgcaaaaagaccaattcttggctcttctaggaaactgaattggagaaggccagagtacgtggaaatgacctgtcagtaggacattgtactgatgcagggaagagatgatgggtgctcagaccaagatggccggccaaagacatagaggttccagggaggcattctagattcttaggaattaggggagaactttgtgatacaaggaacatggggatgagaaggaaggtgtccaggttgacccccaggttactaacctgctcagcaggatgagagtggtccattcactaagccaggggaccctaggaggtgtggctactttgaggtgtgggggagaggtccaagtgaggatgccaagcaggtaactgcctccacggacatacaaacaaggccgtggcattgatgagatcgggtggggaaaagggcttagccccaaacctggaggaaatctcagatgtagaggtcacatggaggagaatataggaaaggaaattgaagtagagtgctcagatgcaggagaaaaatcagcgcatataaccaagccaaggggagggagtgcctcaagaaggagggagaggagaggtcaggacagccaaaatcctgagggccaagaaagacaagacctggaaaatgtcattaaattcaggcttatggaggctacaggtgaccttagtgagacccagtgaacagagggatggcagctggagaggatccatgctaatatgaaggaactatctgcaaagggtatgttccttaatttcagggatacatgtgtattgtgtgatacacgagtgtgtgctatgaacacaccttgggaaggagtgtgcgaggatccttaacattttacctgtgtacttttgtcttcctccttttcaacagcctaaatggaaacctgataaaaccagaggaggccaaagtctatgaagatgagaagcggattatctgtttctgagaggatgctttcctgttcatggggtttttgccctggagcctcagcagcaaatgccactctgggcagtcttttgtgtcagtgtcttaaaggggcctgcgcaggcgggactatcaggagtccactgcctccatgatgcaagccagcttcctgtgcagaaggtctggtcggcaaactccctaagtacccgctacaattctgcagaaaaagaatgtgtcttgcgagctgttgtagttacagtaaatacactgtgaagagactttattgcctattataattatttttatctgaagctagaggaataaagctgtgagcaaacagaggaggccagcctcacctcattccaacacctgccatagggaccaacgggagcgagttggtcaccgctcttttcattgaagagttgaggatgtggcacaaagttggtgccaagcttcttgaataaaacgtgtttgatggattagtattatacctgaaatattttcttccttctcagcactttcccatgtattgatactggtcccacttcacagctggagacaccggagtatgtgcagtgtgggatttgactcctccaaggttttgtggaaagttaatgtcaaggaaaggatgcaccacgggcttttaattttaatcctggagtctcactgtctgctggcaaagatagagaatgccctcagctcttagctggtctaagaatgacgatgccttcaaaatgctgcttccactcagggcttctcctctgctaggctaccctcctctagaaggctgagtaccatgggctacagtgtctggccttgggaagaagtgattctgtccctccaaagaaatagggcatggcttgcccctgtggccctggcatccaaatggctgcttttgtctcccttacctcgtgaagaggggaagtctcttcctgcctcccaagcagctgaagggtgactaaacgggcgccaagactcaggggatcggctgggaactgggccagcagagcatgttggacaccccccaccatggtgggcttgtggtggctgctccatgagggtgggggtgatactactagatcacttgtcctcttgccagctcatttgttaataaaatactgaaaacactcttacgggttgagtctggagtttttgaagggacttggcttggtaagcactcattgactcctgagccccatcctgattcactccacagtggggaaggggctctggggtgatgtgctatgaggagagcctgatgaaggccaggggtgtcaccagtttgatccttcacaggcctctctgcctaccaagggacaggaagcggctgtggcagcctctgaggtctctccatctggcctctgaatctcttcaggtggcttctcagaggaaataacttgtgagtagggggtggctggtgccaggacaggccaagtgggccaaagttcatgccttcatcaccatgccatggtagagcccacgggccaggttcgacgtccactaccttcctcggctgttcactgctgagtggcggatccaggtaggcccatggcaagaagcaccgagctgccaggggcagcacgtgacagaggaaggcatgcagggcctccaacggtccacctctgagttcttatgagtccaagcctggctttgtagagcagcctgttaggaaggggaccgttgcgggggaaatcctgtacagttaagcaactacaaggcggcagttccttaaaggctcgattttggtggttcctacgaggtccctcccaaccccagacctgagtattcacctaataatcaccccaaggcagccactctctccttactgcagaatctgggcagcaaatatgcccagaaagaagaaagaagggaatgagcatggcccactgaaggccaaagggggagtaccacagacctcagactcgccaagtcttaccacaaagttcacttctcagcagacaaaattcacattttattaaactgctaaaactaaacccttgagagtctaaaatttactcagaaactaccaaatgttattgcttttagagactatcaaaattaaaactgctgcttctagggaattagaatttgtgtggtattgacttaaattctatttggaaatactttgatcttccagatggcaagtggtagattttctattcctcctgtaaaactgagaccaggctcctaatttgatggaaaggttctcttattagaaacaggtgagcttctgagcagaaacatggagacttttcctaatcaagaaaaagacaattgaaaaaaaaaattctgtaaacgagggctatatctctttctttccacaggacatcttgattgattttgggaaagaagctacagctcccatatttcacacctgcacttgtgtcatgtccatgctgacatggaacttctttaaaaagccatgtggagccactgtgtggccatgtggtattagctctctggagcgccctagctgtgtggctttggagcactcttaagacggccagaatcttgatttcctccttggaaaaactgagagaatctgactcaaaaggttgttgagaggattaaatgagtcatggaaagtagctggcacaaagcctggcacagagtcctgctcaacgtatggcagttagttactatcaagccagcgggtctcatttccgctcaccgtgggactcccaagttgtccccttctcactcataggctcagggaactttccaacaaggtccaatacaggactaggagttctcaaagtaaaaccccaaagtattcaacatcaagcttcctgcaatatcctacctttgtcagtgaaaagcatagctgttagttttcattattattaccaaagaccatactgccatttaagtgtcaagtcactgaacatagggggcacctgtgtcttcacagcacaaaagaacagggcaggagctggcaccaccctatggagccaggcccatgagcctttgccaagcgggaaagcgctttctgctcatccatattttggttcacttccaggtggaccacaggtctgtttccagtaaccaactgcttacttacaagaaaaaaaccttgctctagagctgaaaggcaaaaccatgaccattaacccaggatcatgaaga

SEQ ID NO: 674 - DNA, 185765 bp, Human
ccaatttcaatgccctttatttctctcttgtctgattgctctagctaggagttccaattaatggtggtaaaatgggcatccttgtcatgttccagatcttagaggaaaggctttcagtttttttgctgttcaatatgatactaactgtgggtttgtcttatatggcttttattattttgaggtatgttctttttataccctgttttttgagagtttttatcatgaagggatattggattttatcaaatgctttttcagcatcaattgaaataatcatatgttttttatcttttattctattgatatatcacattgattaatttgtgtgtgttgaaccatccttgcattcctaagataaatcccacttggtcatgatgaatgattttttaatatgctattgaatctggtttgatagcattttattgatggttttattggcctgtagttttcttttattgatgtatctttgtctgatttttgcatcagggtaatactggacttgtagaatgagcttggaagtattccctcatcctctattttttggcatagtttgagtaggagtagtattagtttttctttaaatatttggtaaaattcagcagtgatggcatcaggtcctgggcttttatttgctgggagactttttactacagctttgatcttttgtttacttgttactaatctcttcagggtttggatttcttcatggttcaatcttcgtaggttgtatttgtctaggaatttattcatcttttctaggttttccaatttattggcatatagttgctcatagcagcctctcatggtcttttgaatttctgtggtattggttgtcatatctcctttaacatctctgattttatttatgtaggtcttctgtctttttttcttaatctggctaaagttttgttgattgtttttaatcttttcaaaaaatcagcttttagtttcattgatcttttgtattgttttcttcatttatttctgctttcatcttcactattttttcctgctgattttgtgtttgggttgctcttgcttttctaatctttaagatacactattagattgcttatttgaagttttacttcttttttgatgtaggcacttataactatacatttcccttttagcactgtttttgctatatcccataggttttagtatgttgtgtttccaatatcacttgtttcaaaaaaattttcagtttccttcttaatttctttattgacctattggccattcaggaacaggagcatgttgtttaatttccatgtgtttgtatagtttccaaagtttctcttgttaatgatttctagttttattccactgtggttagagtctcacccaaggcccacagcatgtactacctggctaccactcttgactattcagggcccaagggctctttagtcagcagatgatgaatcctgccaggactgggttcttcccttcaaggaagggtttttcttctggctcagggtgtgtctagaaatgtcatctgggcatccaggagatagggcctcagaactctgcctcatgccctatcctactatggctgagctggtattcaagttgcaagacaaagttctctttactcttccctctccactcctcaagcagaaggaaggagtctcttttggagctgtgagctgtgttgcctgtggttgtggaagagatggtgcacatgagctggtctcactaggtcacatgcccccaagttcactgtctctgagcccagcacagcaccaggactttcccaagaattgcagtccttgtggcctagactgcctttcaagtttatttaggacctcagagtactttagccagggtgataagccttgccagaattcaggttctgacttctgggatgggtgattcccttttggctagggctggcctgaattcaccctccattgagttttgcctgtattgctttctgctgtgacagggcaagactgagtttcagtgtaaagtctaacaatcactgtgctctcccttccccaggcacatagattctctctttgaacaatgcagctgctgcaggggatggggaagggatggcactggcaattcaagactgcctttcctacttcttcagtgcctctttcaccaatatgaagttaaaaccaggtactgtggtcacttacctgatttttggttcttatgatggtgcttttttttctgtgaatagttgttcaatttggtgttccttcagggaggatgattgatggaggctactatttggccatcttgctctgtctccatccatactaatttttttttttttttttttttttgagacagagtctcgctctgtcgcccaggctggagtgcagtggcacaatcttggctcactgcaagctccgcctcctgggttcatgccattctcctgcctcatccatactaattttttttaaatctgcctgggccctgtagctagagtaaggtcagagtctggggcagaactaaacatggaagcagagtctgctgctccagctcagagactagagggtcagagagttgaatgggtgctgacattgtggatccccagtgagaacttgctcctgcaaccttacaagaaaaactgcttttctacaggagaatcaccacgttacattagcagtttatttatttattttttttggaatggagtcttgctctgtcttccaggctgaagtgcagtggcataatctcagctcactgcaacctccgcctctcaggttcaagcaattctcctgcctcagcctccaggatagctgggattataggcacgtgccaccacgcccagctaatttttgtatttttagtagagatggggtttcaccatgttggccaggctgttctctttctgatcacttattgataatcttgacctaaatttagaagtaacttgggtatcactagatacatatgggcaactggaatgcattctaaactgagtaattagaattgaaataatctgctcaaaagtaggaacactgctttccattttatatttctttatttactttgggggtttctttagtgactcttccaggacttgtatgtgggttcattatttacttgacagttaaaaagttggtcagaaaagttatgtctgcctcctagtcataaatgaaaaggtaagaaatccagaggaaaaaattacatattctctcttagtttatttttattatcaataaaatgtcagtgccctttaaatgctgaactttatcatgcatatgaactttgaattatttttgttcagaagagagaaacatggaaagaaattatatgctccctcatataactcaaaggcctgatccatcaaagctagaaaagttattgtcatcttgggtgacttttgatttctcccttgttcttgtaaggcctactctcttccactcaccaatatcttctagtagcttccccctggtgatgtgtggctggctgagtagcttcttgagaacatagccattattgagcttaattgtctttcacttattattctagtgacattctattacctcaagataacatacaagtctaatttacctaagtggatactgcttttgtgtgttacattatgctttagaatttcaaggttctgaaattattttatgctttttaggaatccaaaaattaagctgttttctgttattttctttaatcttcactagtaaatgagattaacatgcatggaaatctggccttgggagaactaaacccaagtggtcacataaaacccaggaactatgtcagccttaaaaggccaatccatcattcctagcaaggtgaatgtaccacacagaattatcagagatccccccttacaaaatggtaataacaaaaatatttgtcatttttggggtactttctaggtttccttataaaatgataataacaaaagtattcatcatttttggggtactttctaggtttccaactctttagagatattattctaaggcaattaactgggaaaatagaaatagttaaaaatcactttctttgcattgaagggcttccagtataccatggtgctaacttaattctccagttttagtttccattcctctataaaaaattattttatctaatcagaatggtctgtttctcaacaaagcagtctctcaataccagtacaggatgctgattaggaaattaaaattgttcttctggagactatctttggtttttcactgaatttcttattctactggacgttttcagaacatagtgcaggtattagtcactgcagattactccccttacccctcttctgagatcttagaatgttctggatgatctgatggctggttcagagatggctgttttataagttaagagtaattcatttaaaacagggtccccaacccccagaccacggtctggttaggaaccgggccacacagcaggaggtgagctacaggtgagtgaacactatcgcctgagcagtccacctcctgtcagatcagtggcaacattagattttcataggagtggtaactatttgtgaactgcatatgcaagggatctagattgtgtgtgccttatgagagtctaatgcctgatgatctgaagtggaagagtttcatcctgaaacaacctcccactctggtccatggaaaaattatcttccatgaaactagttcctggtaccaaaaagtttggcgaccactgatttaaaaggacaatttacacaaaatcaccctcaaagtgcatgtgtgagtctagcatatgttgtagtgtacattttttatagggtgtgcatagtggcaatatgtcctctataatagagttgagatatctgctttctcaaggctagactctgagttaattaggtggagtgatcctcctgatgtgtaagacagttccaggcaagtgctatttatgcctgcttctccattggtgccagcagtaacttgactctccccttaactccctaagccttttatctctctcttactgagagctttcatcacctccatcctgtgttgtagatctagctatctactctttttctcccttcttgtttttcacattgcttgactcataatgtttgcttaatacatatggtaatcattgatattgtacagcaaatatttccagctctcagtcttctgagcagatgataagattgtactttccaccatctttggccaaatgactcactttgaccaaagaaatgtgatcagaagtgatgcaaattattttcaggtgaaatcatttaatagccactgctcaactcctacttttccttcctattcactgtgatggtatgtagagatgaagtctgagtccctgaatgactgcaatgtccagagtctcctgctgacctgcaaagtgcatgtagtttaaactagaaatatacttttgattctttgagccattgagattttggggtggtttgtatacagcataacctgacttattctgacaaatgcactggacctgtactttccaatatgatagccaccagctatatgtggctattgagcccctgaagtatggcatcttatttcattttctgttgctgtaacggaatactcaagaccgagtaatttatagagaaaagaaatttatttctcacatttctggaggctggaaagtccaagaggatggtaccagcatctgataagggccttcttgctatgttatcctatggtgggaggtaagcaggcaagtgagtgtgtgtaaaaagagagagcatgggggccaggctcacttaataaaaacctagtcttgcaataacaaacccactcccatgacaatagcattaatccattcatgagagtgcagtccccatgacctaatcacctcttaaaggtgccacctcttaatactgtcacaatggcaattaaatctcaatgagagttttggagtgaacattcaaaccatagcatgtggctagtccaaatggagatatactataagtgtaaaacccatgctgaattttgaagacttagtatgacaaaaagtatgtgaactatctcaataatttttgaatattagttacatgttgaaataatattttggatatattaggttaaataaaatatagtattacaatttattttacctggtgctttttacttttaaaaagttacacatggtttgcattatctttctgttagatagtgctgcactgaactacaagcttattgaagacaagagttgtatccgttttacctttttttcccccacaacatccaacagtgtctgggatatgagatatgcaacattaatgtaggtttaatgaacaaactgtgtctccatttatatgtagtttaacatttaacaaataatgccgttctcaacatgaagtttgtttgtatttttgtgtttaataattccttcttgtaattccgttagctaaagaataactcaaatctttttcaatcatcagataattgaatatcatattgtgatgttatgtttatgctataataagaaggctggggttatgcccattaaatacttctcctgatgaaattttttagcaaggtcactccttatggctaacattttcttatctttgtaaaaataacaaagaagtccctgtttgttcagtcatagttgtgacttttatttcttttccaatatctgccacttaggatatttattaaattaggcccctttgcatggggccttgtgctacaaaccaaaaggaaacagaaaaagagaaatggagctgccatgaagtccttctgcagcatcagctgtggggactgcacatgtgaggaagcagttctttggatttttagatgagtgagacagaaagtaaaataggtggtaaaaagagtcactgaaaggaacaacataccttaacaaataaagggtgggggaaacacaaagtaccaaataggctggaaaacatcttaagcacttaataaattatagctattgccatgaaagtgtacgaacccagaaggagttatggacggatgcatactaggctgttccattggctaaggagcggcaggggaggtgacacaggggaaggggaagatagatactctcatcaaaagaccatagaattagcaaaaacttgtccacaaaccaacttatatactattccatgtgcataaaatcacatattatgtgtatgtgcatagaaagatattacaacagtggttaccaaactgtagtgattctttctctgtatggtggctgaatctcaggtgacttttactttctttgttacacattttgaatttttctccagatgagcatgtatcatctgtatactcagcaaataatctgatctagcattttttcatttatgggtaacatcaggacaaagattaagaacccaaccaaaaattgtctatattatttgcattctgttgaatgctaatttttaaaataaaactgtcaaattattataaatataaaagtaatcagaagtatactgccagtacatgcattttggttatcacagaatatttaaaatgtacatgtttataggcctagtatcctcctccctgggttaggctccaattgattttctaaatgacacagggaagtagctgattcaggtcatggtggcatcttatctgaaagtgaacatttcttcagaaataaaaaatgcttttgtaagattatagaagatttgggaattatgccatgagggcacatgctgagtaatatgtttttgaggcaggctgccaagtttcgtcaaagaaaggcaagtacagggtttgttttgcaatgtctggaaaacttggaactctaatttcttggaaaatctttccaaaataaattcagtatgaaggcattctacctcaacaaattacatgtagcaagaggaaaggaaaaacaaagtgtaacaagatgtgagatgagaaaaggagattttttttccccaagagatgcgaccttgttgagttcaattacatgtctgacagcatcagagaaaacatcctcgtaatgttaattttactcaaactcctgagtgtgggtaaagtaaagaaattatccttcatcatcagttcacttttatccatctttaaaaatgtacaaaatataaggtgtcatatatccaaaaatattctgaattgctggagatcttcagcaagccgtttacattttctgggtccatttttctcctttgtctaatctggagggtttagatgtaaaaagtgctatggtctctcctaggtttaatttttttaagtaaaacaaattattatttttgacatattcacatactctttgatatatgtcagcaaaattttttccttatcaaggtctaattcttatatggtgtgaaaagcactgtggttacttcatagacatgatcgaaaactaggaccttccccattgtcccttccagttctccatacactttgaagcctttgcatggttgtcagaagggttgtagtgattgataaacaggaagaatccaactgacacaggttctgtatcaatgagatggctgtgcagagcaggagacagcaatattctccccctggcaaggataaactacccttgtcctcaagtcttcttggagctgccctgctgctggtgactctgcctaatgaggtgggagatctgctcaggttctttaagaaacacaatctgggtcttcatgaggcgagtccctactgttcccagaggctctcagccacagtagtgcatggaggtatgaactaagaagctgtagaaggatacaagtgcactttgcttggcgactgcttaccaccgtctttccttatgggcttgggagctggtggaaaccaattcagcagatttttgagtgacttttgaattgaaggtgaattctaggagatctgactgtcccaagtaggatgatactttaagcctttctgatgtgtttaccataattcaattgaagaacatttatgtatagtttattcatgaatcctacatttattgagtgcctgccctatgccattttggtggggagaagtataaaaataataaaaaagtataatttagtacagaatgactaggtactaattaaaattgagacagactcatagaggaggtaacatttcactcttagtgaaaagaagagcaagccatgaaaaggtttgatgtcaggatattccaggagagggattggcaagggaatggtggggaggagcttcacatgttcagggaaaaggaagaagtccagtgtggccggagtacatgagcaaaggggagcatgacaggagttgaggtcagggaggtgggcaggcgtgaggtcaagtgggccttgcaggccatggggaaaaatttggattttattgtaagagcagttaaccattagagggtttaaacaagagaatgataggccctgatttgtatactcttcttggttcctctggctgctaggtgaagaatggatagtggaggagtagagagaatagggaattagttatctagtcatccaactgagatgtgatggtgactcagacaaggttagtggcagtggagaaggagagaagtgtcatggctttgggatgtatttcagagtagagctcacaggacttgctgatggctgcctgtaagagaataagaaaaggcataaatcaaggaggattcctatgtgttggacttggaaaaactgggtgtatggtagggctatttatgaggagggagagacctggggaggaactggtttggagacttaccaagagttctgattttgccatattaagtttgggtggcctaatagatattgaaggaaagatatcagacaggcagcttgaattgctatggaaagtcctgggctggagatttcaatttgggaaccattggcatggatctgatgtgaattgtgaaaagataagtaaaagtttaaaccagtcctgtaattcatcttgagcatgtgctactttcagtcaggaaaaaaaagaagccctcctttatgaaatgatatggtaattattgcttactacttagagtctttgtagcagttgattttcaggcaattagaataaccacatcacttttatctgataattagagctaatttgcaagtactgatgataggctcattcactgaataaacaaaatgcagagcacaaagtttgtttctacagccatatatgtgaagttcctcttcaggtcttttgcaccacagggctgctgaattagtgcagagtttaattcagaattttcactcttgttcattgctaagctcatggctttattctgtaatggtattgtgtactttgggaagaatgccgttgggggaaattctgaccccttctcccaatctcagctgcgctgtcagaagctgtttgccctgacaggcctgggagcttggaagctagctatagtaagagtgatgcttggccgggcgcagtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcacctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaaaaagagtgatgcttcacattattgagtgtccacgaaatgcttatgacaatgccagttgttttgcatagattatctctaaattatattaaaacccctgcaaggtaggtatttttatttccattttaatgatgaggaaacagaagcttaaggtgacatggctagtaaattacaaaatcaggcctagggtctgcttgcttctgaaagcatctacaattttcattctgccaggctgttaaactgccaaaatttgccttagtttattcttccagtcctgctttctcctatcaactcttatgtctttccagccaaaaacccaattggctatcatctacatttctgtctttaaaaatcatccctaagggccaggcacccctgcaatcccagtactttgggaggcctaggtgggaagattgcttgaggccaggagttcgagaccagtctgtgcaacagagtgagacccccccatctctaaaaatacttaaaaattagctggatgtggtggcacatgcctatagttccagctactcaggaggctgaggcaggaggattgcttgagcccaggtcatcaaggctgcagtgagctatatttgtgccactgaactccagcctggcagcctgggtaacacagcgaggctcttttcacccccatccaacaacaacaacaacgacaacagaaaaaacagaaaaaagtcccctgaagtatacacacccctaccccgcctcttacgcctctggtttctgtctaaatatttcagccccatcctcaaattcatacctttcttctccccaaccataccttcctagtacactctaggattctattacttacacagacctctcattctttaacttttcccttaatatttccctacactcttgccaaaactcactcttggctttattctaaattacaagttcctgagccacattcttcactcgtcgtcatttctttcaattttctggctctcagagtgaggagcaggagccagagaatttcctgcttcccaccagcacatccagtctattgcttgttcattgcctctcaagaacttgtgttgtgaattccactctatcctgtgtaccacacttcttccatcttacattcaactcacaccttctgctcacttctcaacctagaagagtccacttttgctgactctctctttcttctatcatctcatggaaactgctaaacactttacctggtgttccaatccctggcctcagagatctttggcctgaggacattacggaactttcctttcctttccctttcccttctcttccctttttctttctcagagtctcactctgtcacccaggagggcgtgcagtggcatgaactcggctcactgcaacctctgcctcctggattccagtgattctcctgcctcagcctcctgagtagctgggattacaggtgtgcaccaccatgcctggctaatttttgtatttttagtggagatggggttccaccatgttggctgggctagtctcgaactcctgacctcgtgatccacccaccttggcctcccaaagtgctgggattacaggcatgagccactgtgcccggccaaagaactttatttctaattcactcttgctccttataggcacaaccacacttcagacctgcttgacatttgaaactgccccttatctgaaatgatcttctcggatgatacccagttatagttctgcctctttgcaatcttctcttgggctgaatcttggctttattctcagtgtaacagcttcttgcctcatccattgccttgacatgccacactggcctcacctgcctctctactcatgtggaccgtttggtctgccatttgagctcagtttttgatagttccatggacttcaggctctgatcctattttacttgctctgcaaatctccaattctaggtatcaccatctgatttctctccgcctcctcttgtattactgagtacaaaaaaaggacatgaatcttgatttttgttaacaataaggaaaatctgctataacgttttagcatgtaactcacagtcagtcccatgattggttaatttagcgatccaataacatcatcaaagaccttggatcttcccatttccccccgccccctcacctaaccccctgttgtcctattaggacagcttcagtctctagctagccaccagctgctgcatttccaggggccgtgcagagaccagactcagcagaaaaattggtttgattggttttaccacaaatatcaacccacaattagaacctcttctggcttcattgcagtctcattacaaatttgctcctacttgtgtttctcactggaactattctgagctttttccaattccaatcttatcaagccccacctacttgtttctttttttgtttcaaaagtgtcttccatatctgttcctattgcccctaccctaacttgcacccaacaattgtttaccttgcccccatccattcattcccctgtccctttcctgccaggttactgttcctgaagctggcgctgagtgtggcacttttttgttcactctgcctctagtgggtccctgaagttcagatggcttattgtagcatttgggatccattaagacctggccctggactacattctcagttttaatttccattatttctatttatgtaccccataagccaatcaaaatggaaatccctggctattcttttactgctccccatattttcccacctctgtctttgttctctttctctgaagaggactacccctcaactctgcaagtgaaattactgcacactttaaggtctaactccggtggcacttcttttaaaagctttcctggcctctctcatcctcagcaagaaattatagtcttttccgaattttgtagtagattatcttaggttacttgttaactctgtatgatattttttattgtagagtaaatccgcactttgttcatatgttcttggaaactgtgaagttaagtgaaaccaattttaccataggctgattgatataaaaagttaagttcaggccgggtgtggtggctcacgcctgtaatcccagaactttgggaggccgaggcgggcagatcatgaggtcaggagatagagaccatcctggctaacacggtgaaaccccgtctctactaaaaatacaaaaagattggccgggcgtggtggtgggcgcctgtagtcccagctactcgggaggctgaggcaggagaatggcgtgaacccgggaggcagagcttgcaagtgagccgagatggcggcactgcactccagcctggtcgacagagggagactccgtctcaaaaaaacaaaaacaaagcaaacaaacaaaaaaagagttaagttcctaaggcatatttctggccacaaaaacatcaccaaaactcgaaataagacaaaacacttctaacattaaacattaaaataaatgtaagctatacatacatttaagaaagatgaataaaaacaagtaagataattatttagacacttcttccaaatcagagttgtgagtgatcagagcctattctggcagctcagcgtagctcagggcacaaggtgggaaccaaccctggccaggagccattccctcccagggtgcactcagacacacacccacactcactcagactggcaccatgcagacacgccagttcaccgaagatgcacgtttttgggatgtgggaggaaactggaataaggggagaaaacccatgcagatatggggagaacctgcaactccacacagacaatggcctcgtctgggaatcggtttttgttctcatcaacataataacagagtgacgctattcaaggacctgctgtacatccactgtggattgctctgtaggcccagttttcttagtttccactaatatcatttgaacaatttttcagttgcttggtgtttgattgttttagttgtttagacttttttccattttcctgacctatgatctcacgaaagctaatagtatctgttatggacttagaggacatccggcttctgaggccctttgggactgtacatgattttgcttggaaaaagcccaaatactgtaactaaaattgttcccgtggttattttgtccaattgatatgaggttgtttttgtctttttggttttgatgcagtgttttggtagaaaaacatagcaaacaagattttactaatatcactaagttaactttgaggtacccagttgttgctaacgtagttctctacatcaccaaatattactgatcccaccattacaagacctctgaaatctatccctttctctcccttcacactgtaggggccggatttctgaccctcaccacctctctgccaccagcttcatcctactgctatctgtctgcagaagaatcatctctggtggggccacttctctgcttacgcacattttctgatttcctattgcttccagaattaagtccaagtccatttgtgggacctctgagtccctttagattcaaatcccagttgccttccccaggttcatctcttgtcacttgcttagctgtgtctcctgtccccagccacattgagattttcactactcccagaaagacccatgttcttctggggcttgaaagatccctctaatttcttcccctgacccattcccattcattatttaataaaaactcaagtattacctcatctgtggtgcctttccctacttcctcagagagcagccccctttctgtgttcctataccattcattcactcattcacatattgaaatccaggtagttaaaaagtgctgggaattaagtgacctagaaaccttagtccctggactgtaaggggctgtatagggatgtaaaaaagaaaatgacaacattgagggcagggaggggaccaaattagagagactccatgcattagaacaaactcgaggagttagtgcctgactctgtgtgtgggaatgcagaaagcggaagagaagagaacaatccccatattcctgccttgaatgacacaggtatgtggctgtccatggacacaggaaatgaaaggaaggagcaggcgaggtgggaagtgggaccagtttaactttgaggtgactttaggacatctgagtgatatgtccagtgtgcaatgggatttatggatcaagagctcaggagaggaagcggagattaagttaagtttctgggaggttccaacaagcaaatagcagttgatgttaggaaaatttctgaatttaccaggtgctccatgcccttcttttgttccgtatcatattgtatatctggtgacatagcctgctttcccataaggacactcacttattaattcacctcgtatcctcagtgtctactacactgctttgcacataaaaatttcatttcaagtgagagaatgaatatgagttcactcagccatgtcttactcatgggtgagagaatattgaaattgatccatttaataaataatgtattgagcaccttctatgtactgggaagtctcctggccactggaaatacagcagtgaaaatgatagtgggggaacagtaacacagtaaataagcaagataatatcagatcataaaaatgatcatagctaatactatggagttcttattatgtgtcagggcctgtcctgagcatttaacatgaattttaaaatttaatattcacaatatcttataaggtagggaaattaatcgagtaatatggtggcaaatggtcagagaaggctgtttgcagttataatggagctgaattgtgaaggagccagcctcaatgagatctgggggaaggatgtttcatgcacagttcaagtaaatttaggttttattaggttcgtttttgccattaaaagtaatggctaaactgcagttacttttgtaccaatctaataaaaccttcttcttttaatgtgaaaagaatacagacttttcttaatcactgcaagttgcattcactagccttcaaatactctacaccttagttcacctacaaccaatcaaactagcagtagttaattgtagaatctaaggttagggcaaaagacctttccacgtacattaagacacacatgtagcttgtagtgagtggagattggggaattttacctcatttgtactcactaatgtattatgataaagatcaacaggaaaatgatatgaaaacacatgtagaaaaatgatttagattctaaggtagattaagttaggaaagagcaaaatcataaagatatacctactttatctgctcactcaatcagactaaattcttaatggaaaagtttcttaggaacaagcaaatataaacaattactttttaattcatttttcctgatctgtataggttatttgcatgtaaatcatattgacacacaaactttactttgtcaatcatttagggcaactatgaaaagattaatacagtagttggacttttgattttccatcttgttcttacgtagaatttttgatgagactgtgatggctaaagggagggaggaagttcatcaagggcccgaaatgtctgtctgttattagaaaggagccttcattttccagaacgaatttatccatagcaatctgtaaaataaatctgtgtagaaagacgtctcaaactaggcatgataaaagttagggccatactgcaggaaagaagcttagaaggatcttctcatccagtgccctcagtttataacccaggagaggccagctgtcttatctaaagtcacaacctagaagggatgagattctgggtagcatttcttgataaacttgcatatttacttagaattatgcattttaagcttatctatgtattttaattattttaagttagaaaactgtaatatagttttaatttttaaatataattatattttattgccttaagtttaatagtttaatagtttaatttatgtgggcattttgtatttaatcatgggaaagtaaaaactgttataattcaatttgatttactgaattagtgaataaatttatttttgtctgagtttttattaaaagagacgaattttaatcaatagaatttatgtatatatatatgtatatatatatatgaaagtctaaaattggaacaaaataaaaaggtgatgcaactaggagcccctttgtatctctactgtcttttgggcttcctatttttgcattatttccacttttattgataaccaaacactttccaaatgttaagtgtataatctcagagggctagttaggaatttgctgaagagtggtagagaaagccatacttttaactatctttaagcctcctcatgctttctaagaaattaatcttctttttctgtttcccgatctcttcccttctgtctgtttcacttggtactagatcagctcttatcattcctcctgcagttgaatccacattctgtttccaggattttacgaatctcaaaaatttgaaagctactgaccattctggaaaataatcagttatgggtgcacttacatatgtaaactttaatatatcacttcacattttaagtggaccttaccattgtttttgcctccttttgtgatataaatgtggggtaacctgatctgctgagggagtagctgtgatccaaacatgtgagttgagtgcccacaaggcagggctgaagccttggaggacctcgcatccatctttagctacaagtcaactggcttctcaaaaacagaacagcctcaacaatttgttgattcaaaacttttaaatatcaatatttttcagattaatacttttatttgtctaacatttaaatttatatatttttcttagctaaatgtttgtttgcttaattttaaattggtaataataaaaattggcttataagtgaacaattttgatagattttagttcattatttagttcattatttgtaaaatgcatattttccttcccctttatccctgtgttcaaatgaggagttattatttgcttcaggaagcttctcttggggattaaataagcattttcttttcttttcctttctttctttcttttttctttttctttttcttttcttttctttttttttttttttttttttttttttttttttttttttgaaacagggtcttgctctgttgctgaggctgccaggctggagtgcaggggcacaatcacaactcactggagcctcaacctcctgggctcaagggggcttttcatctcaccctcctgagtagctgggaccacaggcgtgtaccaccacgcttggctaatttttaaaaaactttttgtagagacggagtctccctgggttgcccaggttggtctcaaactcttgagctcaagtaatcctctcgccttggcctcccaaagtgttgggattacaagcatgagctgctgcatcagggctaaataagcattttctataaaaggtttattagcataatatctggcctataggaaggatggaatttatgttagttgttgttgttgctactattattgccagaccctgtgctaggcaccgaagatagaaaggagataaaagtgtactatctcaaaaggatcaaagcctggtgatgaggcctgtagggatcgagttagaattacgattgttttctaaagatggaactttgtggctattttgtagtttgggtctggagccttctgccattttacacaccaggtctatgcatctgttctttaatgcaatacatagacctgcaaaaatacacaaaggattacagaaggtgaataaagagtagtatttccataacatagcatggaacccagcagcctctagttaaaaagttttactgtgcttcccaagttcttgatttaactttattagttgaatcttccatatgccttcaagggaagcataactgaaatacaactagcagttgtatttatattaagcttcatctagtttgttatcaaagtataatttttgctttgttgaaaattttttagatttgttttgattagtctgtgtagtgattaggcagatctgtggaaaacgggtactttccaatttcttgaaattctaaacatgttttaatggtttgtttcaacatgttttactttcaatgttttagtagctaaaggcgcattactgattagaagacaaataagctcttttgagttactttacaaattttcatttatctctcatggtaatttacaattactagagaacttcggttaccttaaaaacatttgagagtaatttttcttagcaccatagatggtaatgttgatatgtggaacaaaatcttcaatagtgactggctctgatttccaaggaagttgaaggtacattgaaaacattttcagtattaagaaaatacattaaaaataacccatttaaatatgctctactagatcctcaatagtaatagtatcatgttcacagtttattctgttaaatatttggatttttcaataatgggtttctttccttttaacagttttctcctgagtggtccataataccaacttgttaaatttgcaaaagagatttgtatttcaaatttaagtgcaagaaaaagctaatgtttctactgatgttgtttataacaagagagtgagaaggcccagtgaaactgtgagaagaatgatttatcttacttactgcattagaaatcggcctgttattacttcgttggcttctacaaaagagcttgtaaataaaatgttatagccctaattgaaaataaaaggatagtgaatggaatttagccctattcatccttttggatttaagcatgattcatttcagctaaaaattttaaaaatcctcactttcattatggtttttttttttttgtttgttgagacagagtctcactctgttgcccaggctggaatgcagtggtgcgatcattatgtacattttttaatgcaagtttaatgagtatccatatctcagattagcacagcaattttttgaggcatttagaaattcccagatgtactaccatgggcagctgaatgctttggtgcaagcgcaaggtaggatcagagcaacctagggtgaaatcctactagctgtgtaactgttgcccactagctgtataactctgagccagttggttaagcgtgtgaagtctcagtttctttacttgtcaaatggggaacaaaacaaccacctcacagggtagcttagagaagaaagagaaattcattatgtagagcatattgcagtgttttgttaattatacttggaatcctttttaaaaggatggcagtaggctgaattacattcctgcatggcagtaggctgaattcttacccagtttagtatcatctgatattgaatacagctcacttcatataggatgaagtgaataaatagtctaagccagaggagttggcaaactatagggccttctgcctgtgtttgtaagtaaagttttattgctaattaccctgatttgagaaacatgacactgtaccccataaatatgtacaattattttatatcaatgatacataaaaaagttgttttattgcagttcagccttgcttattcatttaagtgttgtctgtgtttgctttcatgctatcatggcagattagttgtggcacagaccttgtgacccataaagcctacaatatttactgtctggccttttacaggaaaagtttagctactcctggtctaagctgttgtcaggggattgcttaattgatattatgaagtgttgtggtttgcacaaatgagaggatccattttaagtgaattactgtaggaatagactacagcattacttagctatttttgggctcaccagagaagtccaaggattatctgtgattagtggtgagatcctctggaatagatgggaataaaaacctagtacctacagaagggcatttggacaggaccaaaaccttctgtggttcagtttcagagtggggagaagccagggagtgatattagattcctatatgacatcctttatcagcctacagctatggaaattgttccaagcattcattacaaagtggatttagttattcttaaaaggtctttgtgaatcatcctaaatcttaaattaaaagattgtaacccgatattactatgtagagaccctggaattaatgcattttacctggttattagagtagctgcttcaggtgccagagtaggcaaaactagacaaggctctgtgtgctgcaaatgactgaaggtctgaagccatattccacttaatttaatcatttttaaaaattattattttagagcagggtctcaccctgttgcccaggctggagtgcagtagtgtgatcatagctcactgcagtctcagactcctgtactcaagtggtccttccacctcagcctttgagtagctaggactatagtcatgcaccacaatgcctggttaattttttaaattttgtagagatggagtcttactatgtcgccaggctggtcttgaactcctggcctcaagcaatcctcccgcctcagcctacccaaatgttaagattataggtgtgagccacagagtctggcttcaatttaataattttgatagatttaacatcagatcaattgctggcctctactggaagttctgagaagtctttcatttttcataataagtaatattctaccatcccaaagtctgcttttctccttaattgatctttggggagttagacaatacaatcatcattcctgagagctatttggtgctttagagtttacaaagtgcttccatttacacaattttattcaaataacataatcaccttacaagctagaagggttggaatcatccgtatttcatactgataacaacttcaggttctacgaagttaagccacttgcctaaggccatacaactctaaagggtgaaggagggacttgatttgtcttctgacttcatatcccatgttttctctgccaagttattttgtctgatgttaactctccgccaagtttactgaaaaatagctaaaatataaagtctcattagtttttaaagtaagcatccagaggagagaacatagagaccttttcaccagaaacacgtatcatctagatcagagctggcaaactgttggaccataagtctcatctggcctgcagatgtgtttgacttagcctctataatatcggcctgtacatggctttattaaacaattacatggatttagctgttaagtaatatcacaaataagtccagatttccaacttctttagaaaagtcagatctggccacactgtgcccacattcatgcatggcagtaggctgaatttaaacagttgtctcctttggagggggcatttgctttctagtttctacaagtcactataatgccctgttgccctcccattcaaacctcacttcaatcatttagggtacctacctgactcctggaagcatttgagtttgtgatccctgatctagactaggatactcattttgtgaatgaagaagtgacattcgaagtagtaagtcaattaggcagcaccaagattacaacttgttttcctgagacagagcccttttttggatcctggcttcatggccagattatcattactgaagaataacagaacagcaagggaatagtaattagaaatgccaaaatgatgcacacttttaaataaatggatatggttttagtgagggtctgctatatattttatatttatgccatattagccagacttaaaatatttcaaacatcagactatgtattgtatgtttcagttttgaaaacatgggtcactgtaaactgaatgaatgaatttcattttcttatgttggagaagttgattggagggtgcatttttgaatgaatttcagcactgagactgagtttcagttttagaagcagaaggtgcctcatgttagataatagcacatgttaaagagaaactgagggaaagagcagtgatcggtattgcgggtatatactgagaaactgggatgagtggatgcaggagtggactagcactgtcagccacaagtaggagcatgtagaagctgagtgagaataggcagtttaaaggaattgacggtgggacctacccagtgataagaaggggtgtcagatatataaatgagctgagtgagtatagtgttgatcacttattttatttcaatggcttttgaggtacagtggtttttggttacatggatgaattgtatagtggtgaagtctgagattttagtgtacctatcacccgagcagtgtacattgtacccaatatgtagtattatttattcctcaccctccttccttctcattctgtgtccattatatcactctgcatgcctttgcctacccatagcttagctcccacctataagtgagaacatacagtatttgattttccattcctgagttacttcacttggaataatggcctctggctccatccaagttgctgcaaaagatgttatttcattcttttttaatggctgagtagtattccatggtgtatatatatcacattttctttaaccactcattgattgatgggaacttagcttggttccatatctttgcaattgtgaattgtgctgcaataaacatttgtgtgcagctgtctttttgatataataacttcttttcctttaggtagatagccagtagtgagattgctggatcggatggtagatcaatttttagttctttaagaaatctctgtactgttttccatacagggtgtactaatttatgttcccaccagcagtgtataagtgttcccctttcaccatattgacaccaacatttattgtcttttgacttttcaataatagtaattcttgcaggagtaaggtgatatctcattgaatcacttattttttgtgaagtgtaatttctaggatggattatatagttcaaacccaaggggataaattatatcctattgagtgaaagaactaactaggggacttgcaaaaaataactataataaacaatgaagagtagaaattcttgttttttgaatgaacctacaaaatgcgtaaaacaaaatatttgatgaaaacattttcagattatgatggctgttcttattactattcattcattcattcattcagtaattatttatagaagtttgctaggtgtagggcaccatactgagcattggggaaacgtctctgcctttgagttgcttttgacctagttggggagataaaaaaggaagacatggagtattctacataaggcaagcccatgttaagttaatgttttggtggcttagagaaagagacaccacttctcctagcttgactttctgagggatgaggaccaggaatttgaactagatctgaggggatgagtaggatttgaaataccagaggaatggtagaagtttgtttagggagggccttgacttccaggctagataatttgcatttcaaagagatggtttccaaaactgaccaagtgagcttggtgctaagatcataatatacatttaaaagtgttttggttactctggaggctgaggcatgagaatcatctgaacacaggaggcggagtttgctgtgagctgagatcgcaccattgcactccagcctgggcaacagagtgagactctgtctcaaaacaaaacaaaacaaaacaaaaaacaaaaaaaaaagtgttttgggatggattactttcagtggagtttgtaaaatgcctttgtgaatagctgcgatttagaaaacagcttgctcaggagagaatcaaaaccttcctaagcagaaataacccctcagacttgcacctggagtccacttggagattctcccaggtattacttaggatacacagagactaatatacaaatgaaggaaaatgtacagatagtgcctactggtaatagattacagttggagaatcccattttgctaaagatagtattgagtctggaatgttatttaattttcagttcctgtataggcctatggaagtcaccttatattggagtctttatagagtctctcatgttacagggcgctgctcaattaccttattttgagcagcagaccacttgaggaagacacattagacctaaacgagctcatcagagctatttttatttgctcatagagatgtagctgacatgatgggtaaaaaaaaggaggcaaataaatggaatacagtttctgttattattcctagagatatgagtttgcaattgcaggtgctggatataattttaaacatgccttttaaagcaatgcagcagatattttgtggatattacaaacatacacctcaggacaaaaggaaagctaacctaatatgactggaattcaaggtgtatggtaagatttccagtgagggtatgtattagtccattttcatactgctatgaagaaatacctaagtgtggttccacatggctggggaggcctcacaatcatggcagtaggtgaaggaggagcaaaggcacatcttacatggcggcaggcaagagagagtgttcaggggaactgcgctttataaaactgtcagctctcatgagacttattcactatcatgagaaaacccacccccatgattcaataaccttccacagagtccctcccatgacacataaggattatggcagctacaattcaagatgagatttgagtggggacacagccaaaccatatcagggtagattcagaaaatgtttctctaacagtttagactgatgcaaaggtgtactttttggaaaactctttgatgacttaaagtttaagtggaaatgtagagtctggataaaactcatggaatttatagcattccaagattaatatataattttataggatgtgttatagaatatggataattaaattaattatataaccattaggtttgaacaagtattaatcctggagggagtgaaggttaattttacggtcaatttgagtgggccatcgggtgcccagattaaacattgtttctgagtgtgtctgtaagggtgtttctggatgagattagcatttgaattggtggactcagaagacttccctcctggtgaagtcgggcatcatccaatccattgagggcctgaatagaacaaaaacaaaggaaagagaaactcaccctttcgcttcgtgccttcttgcttgagttgggacctctcatctcatcttctcctgtccttggactgggatttataatttggctcccctggttctcaggccttcacacttagactgggaataccactggctttcctgggattccagcttgcagatggcagatgatgggatttctcaaactctatagtggcatgagccaattactcataatctctctctccacttccctctctcattctctcctttcctctctgtgcatatataacctcctttggttctgtttgtttggacaactctgacaaatacagatggtcattataaagcaactttatttttgtcacccacttttgttcttttaaatttattctgtgctcctacttattattgttctggtttgaaatttagacacagcctcatggttcttccagtcacttctacttccactggaagtacagtctgcttagtatatttattccaaacttcagaatttattgaagttaaagcttcccctttctcccagtgcaggactgctgcagacgagccctcattagtgggagatgtgctgagaagcccttctctttcccactcagtgcttctacttcctctcatcctctcctagcttactccccttgaagcatggtggggtatgtcatcagagtgaggagaggttggagctgaaagcacccactgtcttctgtggggcctggaaatctctccctcaccggagatcgctcatctgtgcttgtcttccatgggtgaaaacatttctcctggttcgtctctcctgatgctttgctcagctctgcacacaacttcagtttccttttgatgaggccccttgcttgcttctcagcattcattttttttttttatgattagcaagatttttttaattatactttaagttttagggtacatgtgcacaatgtgcaagttagttacatatgtatacatgtgccatgttggtgtgctgcacccaccaacttgtcatttaacattaggtatatctcccaatcagcattcatttttaaaactgtggcaaaatatatatattacaaattcatcattttaactattaaattaaattaatttatttttgagacagggtctcactctgtcacccaggctggagtgcagtggagtaatcatggctcactgcagccttgacctcatgcgctcaggtgattctcccacttcagcctcctgggtgtctgggaccacagacacacaccaccatgcccaactaatttttgtgttttttgtagagacagggttttgccatgttgcccaggctggtctcaaactcctgggctcaaccaacccccctcctcagcctcccaaagtgtcgaaattacatgcatgagccaccatgcctggcaatttcaagtattttaaagttataattgtgtgattttaagtgtatctatagtgtagtgcaaccatcacaccacacatcttcagaactttttcatttccccatactgaacgctgaaactgtactcattaaacactaaccctccatttgctcctccctccagctcctggcaaccaccattctcctttctgtttctatgaatctgactactctgtaacctcacataaaataaatcatatgatatttgtctttatgtgactggctgttttcattcatgttgtagcatgtgttcaaaattttcttgtttttggaggctggataatatccgcattttgtttattggttcatcttttgaagggtacttgggttacttccatcttttagctgttactaataatgcttctgtgaacataggtatgcaaatatctgtttgagtccctgttttcacttttttggggtatatacccagaagtgtaattgctggattgtatgacaattccatgtttaattttttgaagaactgtcacactgtcttccatagtggcggtaccattttacattcccatgggttccaatttctgcataccctagccaacacttgtacttttctgtttttatttgtttgttttataatagcaatcctaatgggtgtgaagttgtatctcattgcggttttgatttgcatttccctagtgactggtgatgttgagcattttttcatgtgctttttggccatttgtatatcttctttggagaaatgtctattcaagtcctttgcctgctttctaattagattgtttgtttttgttgttgagcatcagcattcttgggtaggatttctggtgaccctgtgctggtccctgtgtgctccatcatcagggtcagggaagcatacagatggcacactccagtggaggaactgaggagagcttggtgaagagattattctcagaagtgtgggcagtgttgagatactaacaagggatgttgaagtgccttgtgtaacagtgtagagtcattatcacccctgggcctgaggggacaaggagaaggcatgaggacagagagcctagagagagctacatctgcaggagaggactgcccagcagaagctgtcaacttctctagaacctgtgctaacccagcagggagaaaactggggggataaataccccattctctctccccttccttgttcttgtcttctgcaggtgcctcctgttggacaaatgtagctggaagtctgtgataatttccatcaaggtcagtctcttgggcatagagcaggatagtaacaggtggaggctgggtctacagtggtagacaagatatatccagcacatgagtggaattcctctttggtccacaggatcttctacccattgttgggagtgcagttacttctcaaaccacaggcttttctctgctgccctaggctgcttcagtgagtcacttaccctttagggttctcaagagtgtgagttagtcgccattccaccacaaccaggaagcatgtgagctctaaaaattccactgaagctccttactctaggcttgaggtgagggacaaattcttccccaaattcttcttgcggggaagatgagactcatagcacaccagtaactttctccaaatagtcttctgtaatctccaactacctagacttttatgccctcagtagagatgaggagaagggtaaaatctaggaaactgcaatctttacgcagtcctttcacacctcactgtgaaatatgctggctatgggctaggaactttagcagaaactggggctgaattggttgtattttaacatcctgtaacaaacatcatatgcagtccatatccctaaaagtttgtatattttggtaaatataaacacatttttaagaaagtcatctgagtcagaaatgggaaagattgctttatatttgggattacttcatatttggggatataagatatgctttctttgacattttcccaatgtagaaacacaggccaaataggataactcatgaattccatgaaatttatccaagtatctcttagctttaagtagctaaaacctaaattaggtaaatgaaaatatttcaacatttggtaaggtgtgcctaaattaaagttcacactagaaacattcttgtttaatttcaggtgagttcagtagagtagtttccttggcataaataatttcacatctaactgtttatacttttaaatgtattttaattgtgaaggcctaatttctgaatttagtttagaataaacctctagccattttctttcttatgtatgtgatccccaaagcagacgtgtcctaggcatcagttttcttatctaatcagagaaccagtgaagaaaggaggaacctgtcatctccatgcagaagcaagggattaagtgattaagctgtcatttctcaaagcctttctccaatgcttgccccataagttttgggttttaaatgagtttagtggaattctgcagtcttaacatatggcacatatccatgacttcagtaaattacaggtactaacttttgttctttctggtgcagatgtgttatcattttgctctgttttgttttataatgtcagccttctctgtgttattaatgtagtgtcatgtgctaccattttaggtaaaaagctttttctgttatttcctatgaatctcctaggaatggacccatttggagaaccagactgttcattctttcctttccctccttttctcttcttccactccttcaaagtattggttgagttgctatattatgtgtcacaggcattgttccaggtgttggagaatctgaaatgaaacacaaagtccccctgctccaggagcttgctatcgccatccaatggaaaggaaagcaacaagtaaataaaaactgccacatgatatacatgtcagacaggagacacatggtataatgagaataccacaaaggggcctaatggggtgacccaaggtgggtcctgagggtttatgaggcaatagttccataatcaaggagaagaaaggcaaccctgggcggagagcacagcatgggaaggccaagaccagggaatccctggcatttgagcagtcaacaatctcagcgtcagccatgttcatggtgtggtacagtggtacttttgtggaggcatacattttaaattcatgccctgggtggccagtgtacaggaggaaatcacttaatgggggggcgtgtgcccagctggctgctggtatctgcttctttgtttggctctgtcttttgcttgctatcctagatgcaataactcctatgaaatgaaagcaagaactttctgtcttagtgacaaatggtcatcttatgagagttgaaaggttaaattgtcacatgagtttatgcacaggaaatgtgatttgggggagaaacaagtgcctctgcaaacatttttgtatttgggaagtggggatgattgcaaggtttatgcctgcagcgacagggagggggctgcatacatcatgttgtgtgaagagacggggcattggaggaagagcaggtttgttcaaggtgacgggcaagagggaaagggaaaggagggagaagaaagatggaaggagatgatgaattctgttgagtttgaagagagatccaggccagaaatgctggttaggaaggcattggtgctgcatggtagtggaagtcacaggggtggactaggtcatttgaagaatgcacagagagatgagagggctaaggaaaaatctgaggaacagcacagggcatttttagggtagtgaaactattctgtatgatactgaggatatggtagataaatgacattatatagttgtcaaaagtcatagaactacataacacaaagaaaactctattgtaaactttggaatttagttaataataatgtatcaatattggtttatcagttgtaacaaatgtaccaccagaatgcaagaggttaataataggagaaattgtgcagtgtggggagaggtgaatattgtaggagcactgtattttctgtaaacctaaaactgctctaaaaataaagtctattaattaaaaaaaaaagccagtgaagatcagttatgtgcatagcagctatacttctgcagaatctccttggtgagcgtgcttttttcaggcttacataatacagttaaaagaaagaaaaataacactcccctcacagagaaataatcagctgaacaaatcactagttatcagaatgcaggctgtagtacatcctgtttttctaactcctctaaatttactagtaaagcaacccaaattgcatggaggaggggaggtcattgcttgctgtcaaggctgcactaatgacattagggtggcattagcgtaccagggctctcctagtcctcactacaccacattttgaatgagttttgcttggacaagtgttgagggtgaggtggcgggagagggaaggagagagatagcttgtgctttgtcctattacctgaaccagactcaattgtcaaacatttttagtgtcgttttcctgtgctcacggaatcctgagagtgtagcactactgtggggagggcaggagccaacaggtatagctggcttatcccagcatttcttccttcccatctgtgcacagcgtaagtggcacagtccacagagtccgctcccattttctctcttcccccttaatggggcgggggcgtgagcccagctggctgctggtatctgcttctttgtttggctctgtcttttgcttgctatcctaaatgcaataactcctatgaaatgaaagcaagaactcaaagctcaagtggtcaaagctcaagtggcagccaagtggtttcttgtgatctgctgaggtcggcttctgataattagaagtgacaggtgatgactatgttatcataacctgcagccacaccaccttcttctggttctgagacaatgtgtagtagaaatggttatttgttcatcgagctggtccccacaattcacacccaaagaggccttttcatggccctgcacgcactgatggctgtttcaggtagacaagcccagcagtgtgggaacccagatatctcccattctgtgtgaaggagctacctagtttctggaatttaactagattagaacctcaagtgatgcattataggtctgaagaagcatgccaatcatgacctttatcttccattttatgaacccttggagtggagcctttagaaagaggaaacagcagagagagggccttaccttgtggcccatgtggtgacattttaggagctgcaaaaagggtccctttgcctcccaaaaagttccctgaggctgattcattcaattctatatttaatgtttcatttagtaacactttagattgaggattattgttttatgttaaaatataaataccttctgggtattaactcttttcagttatagcctttatggtaaaggagttgccaagggctcagaatttgataaggcaaatggaggagaaagcatgagggcttagtgggtgggagtggtggagagtgatatggagcgagacagaaactgaaaactgaggccagaggagaagaaactgtgcctatttattcagtttttcctgggagtttccttgagaagaatggagctatgtgtgtgtgtgtgtgtgtgtgtgtgtgtgtgtgtgtgtgtgatatgagattgcttgtgcgcctgtgtgcatgtgtgtatgtgtatgtgttgaacgatactgtggaaagtttgggataagaaatgataactgggaagagccagacatcgaatgcaatattctcaactaacattcttcttagaatgatgcttggttccctggagactttatgatcatgagtgctaaatgtgtgaggggtgtgtgtagggaggcagaaacagtgatggtttcatagatgtccaagttgctgctacctttgtaaaatcattatttgtcccttcatctctagcctgttaggtaccaatgtatttattgcccactcgaactacttcctctcatcatgggggcctcctgtttttgaggcaacataggaaattaggactgatgacgctgcatcagaaaagcttttgttttcacttggtttaagtctgatagagaagttggctacatagaacctccacaggcagttgctccaatgacttaaaatgaatttgtccttctgcctcaactctccacagttagcatgtgctcattcacccactcctttttatggcccttggattcacccaatccaaggtgaactacttccttacttctatgtcttcactgtcttacgatcttgatcaaacagacaacacactcaacgaaggtgtgggtgggaacggaacccacccacatgattgtgaatcacctagagactggcagcagaagaaaatcactgccaccctaagccttgagtggccagaggagagagacacattcattttcagaactagtgagagctacagctctggtaaggaacctcccaacaggagttgtggccatgggtaggacagctcaagaccataagctggcaaggaaagatcacagaggaaccagtatcctgatctttctctattcagctatttcttcccattggtggaagcccaagagaaacacaagaccagggtccctaaaggtcagcttctcaaggcacagagcagggcacagaaaggtggtgtgtcatactggaggggcaaaaaagctggcaccatctcactttctgcatgtataaaatgaagacgtaaactgccaggattgaatgtgatctacatacaatcatttagcacagcacctggacaataaaaaggaccctataaatgtagtttagtagtagcagtgatagtaatattagaacatttttactacattttagctatatcataagtaagtggctctccctgtagcctaataattaacatcccttatcatatcctaaaatttgtaagaaataggcttaagtgagacttgcttgtttagtgatattcatacctgtagatgtgaatgtatagctacatgcttctttaatttggacagagagaaatgtagagagttgtgatttcatgatttcaattctacagaattctatagattagatgtatagggcgttgctgccctaatggataccataacaaagaaataccccatcttttcctctctccatgactgagcatctgccttagtgcagattctggaaaggaggggatggaccatgaaatttaaattgcatatatagatgtggctatggaaatcatatagaaccaacattcctccctttcttccctctcctacatattgtatatgtaatacgtatgtgtgtgtgtgtgcttatccacagaatgtgtgagtttgaggaaaaaaacaagataaaacacattccgtaggtagtgcagtcacacatagctgaaaaacctgtatcagttatcaattatctatttgtttggagcaaattcctgcaaatcattaaatatacaaatttccactttcattgttaaattacccaaagtataatctcaaataacctctgacctcctggagttgatgacagttttatactgaaaatagaatttttttttgtacatctatagtgtatcttaaattacctaaaagaaagatgatgccagggtagttaaggagggaggtttcagttttggccaagtttcgtacatcttaattgcgatactttgcaccccatggatacctgtgagtgcaaaaatgtctgctttgtttggacttatatttatttttattgtcttcccacttttattttagattcaagggatacatgtacaggtttgttatctggctatattgtgtgatgccgaggtttggggtacaaatgatcttgccacccaggtactggtcatagttgtttgtagttttagaagaaaaaatgaatgagactcaatttaacactggtaatatcccttctttcccagggaaatttagtgagttgaaagttgcaagagtaatgctgttagtgttagtcacttttcaaaagtgttttgccatttaatattcatttttggggtcttctgtgtggtcatgtgggcctactatattatactttgaagagatcagtgaagtcatatggtttaaagtttcacttgatgaatgagcaaactggtgttcacaggggcaaagtgacttattcgaggtgataacactggtgagctggagaacaacctgctatcactttatttcccttttttttttttatcttggagacttttattgaaaggaactattcaaacttttcaaacttttaaggtccatatttctgagttctgagtgttctaatttgattattcataaaaaatatgcacagttcctattctcatggagcggatagttgatttatgaatatatgtgtatgtatcctgttaacgagtcatcatgactaaattaacttagttaagctacttaacttttcagagccttaagtttcttataggcccagcaagttttattggaaaaaaatgggcttcgaaggcagagagatgtggtgttttctgtttactagctgtataagtaactcatagaggaataatagcctcctcatggggttgtttagagggtaaaatgaggtaacctacatagaatacctggtttatgcattcctattgtatctgtaagttggagatgacactgtgcaacctatttaccacatggcattgtgattaccatggagacaatggttggaaaagggcactgtgaacagtgaagtgctgctgtcacatcacttattgagggattttttttgtttgcttagttatttcaacgtaagctttctattgagggacaacatgcacacagaaaactacacacaagagtgtacaactctatgaattttcacaaagtgaacatacttgtgtaaccagaacctagataataaaagagaacctcctagaaagccccaaggtacccttttcccatcactacctcatctcaaagataattatcctaacttctaactccatagattaatttctcccattttggaactcttaaccaatggaattatacagaatgttctcttccctttctggcttctttgactcctattatgtttgagaggttgatccattttttttctgtgtagttgtggttcattcattctcatggctctagagcaggggttcccaaaccccggtacggtctgtggcttgttaggaatcaggccccacagcaggaggtgagtggtgggcaagcgagctaagcttcatctgtatttacagtcactccccatcactcacattaccacctgagctctgcctcctgtcagatcagtggcggcattagattctcataggagcgcgaaaccctattgtgaactgtgcgtgtgagggatctaggttacgtgttccttataagaatctaatgactgatgatctgtcactgtctcctatcacccccagatgggactgtgtagttgcaggaaaacagctcagagtttccactgattcttcattatggtgagttgtataattatttcattatatattacaatgtaataataataaaaataaagggcacaataaatgtaatgtgcttaaatcatcccaaaaccatctccaccccctggtccatggaaaaattgtcttccacaaaaccagtccctggtgccacaaatgttggcaactgctactctagagtgtcctattgtaccccacaatttatgtatctattcttcagttgatgggcttgtgggttgtttctaatttttggcttttatgaatagtgctgccatgaacattcttacatgtgtcctttgagaacatatgtatgcatttttgttgtatatatatcttgaaatcaaatttctgggtggtaggatgggtatacaaaggtttgattttaataaatagtgacaaataattttccaaagtgtttgtaccaatttacatgactacaaatataatattttttaacatctgtaaaattgttacattcatagtgggatatacaaaaatacagcttgaatcattgaaaactgggtttatgtttttctcttttgttgacattctattttagttatgttcttagattgcatggaatacagcctcatttccagtaacttagcttgtggggaagaagggtgttattgtaaagattcttatgcatataaactcagaaaaagctaaacagtgaagctttaaaaaggccagaaaaatgtacaggtgccaggctgtgggatcttgagtgttctgctctttaggattgattctggtatcctgagggtctgtccatccttgtgggacctgtattctgcaggcaggtaccataaggtactgctgtaggccagcatcattctgagtgagcatctgttttgtttggttgctcttctaccatgcactttgttaaacatttggtcatcatcctgcttaagggaagcccatatttgcaatcatttgtcaggatttccagccctctatgtgaactatgttaccatttctaagcaattaacttctggaagctacctgctctcattggtccctaaggagtagatggatgtactgtccgcccttctagatttagaggttgttagatactctgtatttatactagatgctaaatgaactacacagaatcataagaaattcataagaaaactttagcaatcacaattttttaactaataatgtgagtttttaaataatagacataattcttaatgtaaacttctactaagactactttacaattttttttaatatcttaaaaaacaaggggcacttcttgccattttgtgctaacttagtctttattggttgaactagtgctaggcaaggaaggaattagctatagggagcagggaagacagatctaaacagttctgcacttatgagcatattagtgaataatagagatgctccttatggaacccaggcatgaaaaccatccttggacctgtcacatcttggaattatgtgctggactcttgtattggttcgttgactttagttgtagtttaggaagtgatagccagaaacttgaactcttgcttctagcttttagaccttctacttaagacagaagaactatgtatttcacctcgtctaacttctagtatttcagataatttcttctcagatacttttttttggctcaacctatgcttaatatttttagctaatgctcactctgtcatcattaaagtggtttgcagaagaatatatggcctacgcagaagaatatatggtctatgcaaataacttctcactgtacattctctatacagacctatacaaatattttcataaaacttctgagctggaggtggaactattacaaagtgttgtggttgaaaaaggttgatggattgaggttattcctcaagacctctttccaccacaaaactgaatatcctaattagagaatccattagaaggaacttgaccaagtctgtggcttaatttatgcctcaaagtgaagtgattaatattattcaatgcatgcataggaccagaaattcttatttgaataagttattcaacttatagggtaattaaaaactgaaagtaaactgtcatttcactgctatattcctatatattaaattaaactttaaacattatttaaggattcaatgtaatatatttagcttttttttttaaaagcaagtctggaagctgggccaatttctacaaatgttctgctcagtagctagccttttgtggaaactcaatagatcttaaacacttggttcatttaaattactcttctttttgctttcaggaaagattgagaagagttacagggaagtttagtggattagtcattcagttccttgatggatcacttgcatgtgccaatgccagggaacatttaactgattaaaacattctgaatgaatttgtcatttgggggtactctttgaatgaatatctttattgcattgactgtgtcctactgatatgacttaggcttacttccaacattaattctaaagaggctctggctaacttatctgtagaatgtgtgtccaagtcaagttcgtgatgtatttggttaaaaaaaactttgtggctcttgaaagaaatacaaagatttagtagtcagtattgtttataaagtctagggtggtcatatttaaataataaatctaagaattagatgagtactgttacacatttttgttaataaatcttaaatactggaaagaatagacttaagaaaaatattccaacattgaaaacctaagtatctaaacatatttcagtctcatatgccaaaaaatatgaaattatagcatttttggtcaggataaacgcctcctgcatctttttgtataagaagtattttgaatgaaaatagacttgccatgtcagactatttgaaatttaagttctgttttcaattttaggttcttaaaaaggtccaacttagccaatgaacataaaagtgcttactgctaatttagctgctgctgcagaacatgaaaggaaatcatgaggccattaacacatctagaaatagtcattttctagctttcggttcctaagatagcttagtgaaaataaaatattcagacaaggcagggtagggaggtgagtttttaaaggattttctttttaaactttccttccttccaccctcgctccctcacttccaccctcctttatttctccttctttatgtgtgttaacttagaacttcacttcaagattttccgagtgctaagtgataggggcagtgagatatacgctttatctccctgcataggcaatgagtaaaaaagatgtgaaattatggcaaattcaccagcagatttcaaaggtgaaaatgcccttcttgtaccagggttaatatgatctccagccatccattcacagatcatgctcactctgttgatggcaaaggaaagttctctttgaggccttgaaatggaaactgcacatcgtgcctggaaagtccctccaggctagtgttcaagaagtctttctttcacacttcagtttcttcattgcattatatttactgactgcctaccctatgttagaccctgtgttaggtcctgcagtcctgttcacaaggatattatagtcttgaggggaaggcagacattcattaaagactcacctcagtgttgacgggcagactgcaataaaaaagtatgcggcactgtgaatgtgtaacaggtgtgggcggtggtcagggaaggctgagactggttaactgggcagaggcaaagggttgcaggcaactcgcctgaggtggagaggcaaggctggtgacaggggcagggaggccgtggacagccgatatcacaaaaggcggtgctgaaagatgcaaggggactgaggacttctttttagctgagcaaacagtgcacatttcttccactcagacttttccttttctaattaaaaaaatggggacatccacatcttgataacacagttaatgtgtgaatataataactgcttaataaatccttgttgaaataggaatgctgattaaggcacttaggccagcagctgaaggaggcttaatatattcagagatgattcctaggtatctagaaaaggatattttaagctaagagaaaagagggacagttcaccagtttcttcccttctagggaaacaacataaaaggactggagttgttaaaagacagggtgagaagtctgttgacataaaacatgagaaaatgaagtttgtgatgttttgatgcagaagtaagttatcattattgttgagtgataatggcattaattttctgaagatgggcagctcctttcatcccatttaatgtgtatgtgtgtgggcatgtgtgcttgcatacctaaggctaaattaatttttggtacaatagggtagggttgctagatttggtaaatggaaatacaaggcatcaagataaatttgaatttcaggtaaaggaagtataacttttggagtatatatatatgtcccaaatgccctaccagagtggaattttcctcttaagaactctggaggcgtgttgcctcatttcccccatgtttttagtcattgcatgtataatgtttatatttatgtttattcgcagtttatttttgccacatatatttttagaatctaaattttcccaatagtctggaacctttggtgggtgtacataatgtgatgaaggattctcttcctggagaggctgctgatatatagccaagattctgtctttgtgctctgggcttctgtctctgtagtgttaatatttcaagaatgagactagagcatttttcttactttagtgccctttggagcaacagaaagctgcctttgctgcaaaggaccctgtggaatgattgttgatctgccttctagaaactgagctgtgcccaaaaccttttaccagtttctaaaggcacctgctttcattttcctaggaaggttctttaggtgagcgatagtcacccctatatctctgcaataccaagtgagcagcttgttgtgtgtagataccatgaaatagaaacagattcatgaagataagattagaaggtaatctttagattacagaaacagattcatgaaaataaggattagaagttgtgaatgaaaacaactgttgctttggatggctggatttaaaaatgttcctcaatattgatgatgtggtattttaattaaaaaataggatcagatcatgacacatagaagaagctataatatgcacaatgatctgcttttccaggaaatgagtatctttggggatcagcattgagctcactacacatgataaaaaataaaactcattggaaatctagaaattggcaactaaaaattgagtcaaaatgtgttttaaccaccccacccccctcttgtttgtttttattcacttctgataacctactggctgtttagttatattttatggttgttttggctatcacaaactcatacagaatagctggaattatcagtctcaacagggaccatgaagacatatgtgtgtaattcagtacatatattaaaaaatagctaatttacaatattacaggcacaagggagcccactgatgtgaagtttcagtgaaacagtgtaaagaaatgatgttagttaaatatcactatttctcaaagtaaaggatgtcattgtattagtagaatgttaaccctctcttttatgggtcagttacatcaacttcatcataaaccctcttcaaaaaacatgcattttaggacttggatatagtcaggtctgtgtttcattaagcatttgttcagattccagctctcttgctccacaaccattgatatttctcaatttatctataatttacaccctgactgtctccataaaagatataatgtttataaggaaagatatatgcaattagataataatttgaatgcttttacagggagagggaaataaatatgccacccaaacctaggctaatacattcattgaaagcgagtactaataattatttctaagcctcccagcagccaaggcaaaaagggactccagtaacataacatgatcattatttcattgtttacttttactactccctattccacgttgagattgttagagatatgttagtgatcacctcaagtcttattacctccagaaatgtaaagtttgacttaaaatcacaatgaactcttccaatttttttcatactatattgcatgtgcttaagtaattctttgggcttggttttagatttttaaaaattatggtaaaaagcacataacattaaatttaccatctcaaccatttttaagtgtagggttcagtagtgttaaatatactcacattgttgtgcagcagattgctacaactttttcgtcttgttacactgaaactctctactcatgaaacaactccccatttctccttctcctcagaccctggaaattaccattctactttctgtttctatgaatttgaccactttagatacttcatatgaatggaatcatacagtgtttgtcattttgtgactatttcacttaacgtaatgtcctcgagtttcattcttattgtagcatgtgacaagattttcttttttttttttaaggctgcataatatcccattgtatatatttacattttccttacttattcatctgttgatggacatttggactgcttctatctcttggctattgagaataatgccacaaggaatgggtgtccaagtatctcttcaagatccttttctgaattcttttggatatatacccacaaatgggattgttggatcatatagtaattctattttgaatttttggaggaacctccatgctattttctgtaatggctgcatcattttacattcccaccaataatacacaagggttccatcttctctacatcttcaccaatgcttggtattttacgctcttttgatggtgaccatcctgatgagtatgaggtgatatttcattgtggtttttatttgcactcttctaatgattagtaatgttatcatcttttcaagtgcttatgggccatttgtatatcttctttggagaaatgtcagtttaagttctttgcctattttagaatcaatttttttgttgttgttaaagtttcttatatattttggatattaaccccttttcagatatattatttgcaattattttctcccattttataggttgcaatttcactctgttgattgtttcctttgacatgaaaaagtttttgtgtcattccatttgtttatttttgatttcgttgtctgtgcttttggtgtcatatttaagaaatcattgctaaattcaaagtcctgaggctttacccctatgtttctttctaggagtttaacagttttaagtctaatttttaggtctttaattcattttgagttaatttttatgtatggtacaaggcaagggcccaaattcactctttttgcatttgaatatcctatttttccaacactacttgttgaagaggctgtcttttctctgttgtgtggtcttggcactcttgctgaaaatcatttggtcatatatgcagtggtttatttctgggctctctattttactccgttggtttatgtatcttactttaggccataccacactgtcttaattactgtttctttgcagtaggttttgaaatcaagaagtgtgatgcctctgactttgttctttttcaagattgttttggctcttttgggccccttaagatcctgtagaattttataattatttttctgtttatgcaaaaagtgtcattggaatttttatagagtttgcattgtatctgtaggttgctttgggtattatggacaactttacaatattaagtctttcaacccatgagcatgggatgtctttccatttacttgtatcttctttgatttctttttgcaatgttttgtagttctcagtgtataagtcttttatctcctgggttaagttttttcctaagtatttaatccttcttgaggctattgttaacagaattattttcttaattttctttccagattggtcttgttaatgtatagaaaatgcaactgatttttgatcatcgattttgaatcctgcaaacttttctaaattcatttattagttctaacatttttgtgtgtgtgacttaaaagaccatgtcatttgtgagcagagacaatttaggttcttcttttccaaattttaggctttttatttctttttcttgtctaattgctctggtaagaacttgtagcaatgtatcgaatagtcgtggcaagagtgggcatctttgccttgttcctgatcttagagtaaaagcttttagtcttttctcatcgaatatgatgttagctgtgggcatttcatatatggcttttattatgttgaggtagtttccttctattcctagtttgttgagtgtatttatcatgaaagcatgttgaattttatcaaatgtcttttctgcattgattgagatgatcatttggtttttgtccattttcttaatttggttattacattggttaatttttatattttgaactattctttcatttcatttataaatccctcttgatcatggtgtgatcaacgtgtgcttgaatttggtttgctattattttgtttagggtttttgcatcagtattcatcagacatattggtctacagttttttttgtgtgtctttttctggttttggtattaggataatgctagcctcatagaatgagtttggaattgttctctcttaatttttttggcagaatttgaggaggattggtaatcattattcattaagtatttgatacaattattcagagaagccacatggtcctgggattttctcttttggaaggttattttttttttttattactgcttcaatctcctcactagttatagatctgtttccgtcttgataggttgtatgtttctaggaatttgtctttttttagattatccaatttgttggcatataattgctcatagtagtatattttttattgctgtgacatcagtggtaatatctcttttttcttttctaattttagccatagagtcttctctcttttttctttgttagtctagctaaggatttgtcaattttgttgtttttttgggaaaaccatcccttggagtcactgattgtttctattctttatttgatttatctctactctaatttttatggtttcctttgctctgctaactttgaatttagtttgtttttctttttctagttactgaaggtataaatttaggttgttgattttagatcttttttcttttttaatgtagatgtttactgctatgcacttcccttttactactgctttcactgcattccataagttttgtatgttgtgtttttcttttcacttgtctccagatattttctaaattatcttgtgatttcttcttagactcattagttgtttatgagtgcattgtttaatttccacatattactggattttcctattttctttctgctattgatttttagttttattttattttgattggagaaggtattttatatgatttcaatcttcttaaatttgttaagatttattttgtggcctaacatgtggtctattttgggaatgttccatgtgcgcttgagaataatgtgtgttctgctgttgttggatgttgtatatatatatctgtagacccagttggtctgttgtgttgttcaggtcctcttgtttccttattgatcttctctctgattctgttgataactgagagtggggtattgaagtcttctactattatcatattggtgtctatttctctctccaggtctgtcaattttgcttcatttatttaggtgctgtaatgttaagtacatatctgtttttttactgttatatcttcctggtgaattgacccttttatcattatacagtattcttcgttgtctcttgtgacaatttttgtcctaatgtctactttgtttgatacaactctggtcacttctcctctctgtaggttcctgtttacatagaatatctttttttaacccttttactgtagcctatgtgtgtctgtaaggcaggttcactgattaccaatcagtaattctaatttctatcaattgtatgagacagaacactcaaacaagttaagtgaagcaactttataggcacagttaggcagcaagggacaacaaaagcctaggattcatagttccccaaagctcagagtgaatggaatctttctgtgtgttacctactttgcagtgcaggtgaagaactttgaaagcagtctactctggattgtatacccaggggcaatggggattgctgggctaaagtgctgcagggcatcctattcttggagggacaggaacagagcccaagctgtttcagatactttctccttatctcaagatgctgcactcctaatatatcctacagttatttttgagaactacaattgagaaagtggggaagagtgcagtcagtcaaggccatcttggaattcgttctgcactgtctctagtgctaaattgagtctcttatagacacaacatatggttggatcttatttttttaagtccttcggccaatatgtgtcttttaattggtgcatttaagctatttacatttaaggtaattactgatagggaaggacttactattgctattttattgttttcttattgtttttgtccctcatttcttctcttgttgtcttcgtgtttcatttttttttgtagtgacatgttttgattctcctctcattttcctttgtgtgtagctgtgtgtatatgtgtatatataaaaatttatatatattacatatatataaaccttaacgagtttgagtaagaagcagttcatgaattgggaaacaccaaactgaaagaggtttagtgttctgatgacaaagcataccttacatatattctatagatagtttatttgtggttatcattgcaatgagataaaacatcttaaaattatgacactgtattttaaactgataacaacttaactacaatcatgtagaaaaccttttacatctctgccccctcccagtttatgttattgatgacacaattatctgccgtcatatttcatatccatgaacatagatttatcattactttttatgctttattaaatagattttaaaaatctataccagatttataagtgttaatttttctagcaggctttgatatggttggctttgcacttgcctggggtgcaggatccttttaactggtttctagatttctctcaggggcattggtccattggtcatttttaagttcatatttttgtggttgaaggggagtccagggcttcctattttgccattttaatgttatcactcctggttctaggttttatatatggtgatattgaagatcagtttgtgattgtaagtgctgagactaaatgagactgttatcatcatcctttgattgtgaccactttattaggactatcgcttttcccttaagcctttttgtttcccagatgaatcccattaattgacttttggggtttaccttttgggtaaatcttcttactccaagactctgtgtctatgtaccatgctgattaatattatactagaaagtggtttgctgttttatttgactacagcttaactaaaaatcttttgactttccctaggaaaatctgagaaagcgtatcataggtggtctgaatttaaggcaaatatgggtggcgattagaccaattatagacaaacatataagaaagctgtgagaatgtgtgtgagatgaataattatgaaacaccaatgaaccagtgcagctggggatttaaacatctaagtgggcttaatgtatcattttatatagctgaagtaaattaaaacaatattttgtgtgaacattaaacttttcttcctttggtatgaatactctggggatttggaataagcatgattattataattcacacctcttttaaaatcttaatgttgtttgtggctagttgagcatgtgagactataaagtagtgaactctgcgctctttatggccacagcttttgttcctaattcttcttggcctgtttcaacctgtgtgtcatgactcccaagctgaactaggtaaaagaatgtgaatggatcatcatttctagaaaagcatctcagaacatagtccatttagataattggtttaaaaagtagccttttatttcatagaaagcagcacagtctaatacaaggaactggtgtgctacacatgaggacatgctctgccttaataattctctggctgtcttaggtagaaaagtttggggttgaaagaaaagtgatgtctgtttcaaaggaatgaaaattcttagggtgtaacaatagcttattagtgaagagcctaactttggctcaagcatcagactgcttgagttcaaatacaaattcctccatttaccatcaatgtgagcttggtcaagttattcctccaatagtcagtttcctcatctgtaaagtgagcacaatggtaggaccacaatttaattgattctgattggaattaaatgtactactctgtgtataaagaagtaattagtccagtgcctggcacatgataagctctcaataggtattagaccttttttttcttgttaattttgttgtttatgttatctttattataaccatgtgggaagttttatgctgaaaaatatataatactgaatttttttaaatagataatatgcaacagcatctgtaatgactgcataaacaattcttgcattttcctgaagtgttcattttaaatgattgattcatggctcggttcaagtatacacacagattagcctttgcaaataattcacttaatactagctacaccctgtggcagttgttttaaggtttttgatctctagggggtgtacagaagtgttctacttgtgcaaattgttttcctttttatgtcatcaattctgaaaacgtaggcttattacaggaatttttccccccatatatttttgagcctcatgcaattttgtatagcagtagccagtgaagttatccatattgcttcctctgatatagtctctgagtcaatttgttttaatgtttaaaaacttattgcctacttttccttgacacttacatgttcggcgtttcagtggaagataaaatgaagaaacttgatttccactccactagaaacaggctattttccttctatttcatcaaatctcaaagcttatagagattataactgcatgttggttattttactgttcttgcctatctatctatctatctacaaatctatctttctatcttgttcattttagggataatgaagaagcatttagtgggaccccacaagcataataaaaagtgtcactgtaagatatatttacaagcataaatataaaaagcaatatagtacttagcaaaaaatataacacattctctcataaggcacattttttccacacttttattttgtttttacgatttaaagtagtcacttaaaaatcagaaagcaaaagttttttgacctagatttagttggtttataataagtcttgttggttatggtgagtaatcagttaatacctgttaagctaataatgaggtaagaaatatattgactttatttcttggtgtggaaatgacttattcattcaacagatacttattaagtgggccaggtactacttgttaatacaaatggtgaataaagtggcttacactctaatgagagagacagacagctccgagttaacaaatggataaaaatatacttacatatgtgatatgcatagtgtaagataacgagggtggtcacggtggtggtaacctactccaaatactgtactcagagcatatgtgtgataaatgaagttgttgcagtatgtttaaaacactggagccaaaattttgagtgctcatttgaaaacactttatggtaaaacagtggtgcttagaatgatgcattaaaaaatatatatgactatcttgctgaaggtaaactttttttacaacttacctgacatgatctttctaaattacaatagattgtatatgttggaaaacatttttgtaaaatgtacaataagtctgacatgtgagtgaaaaaaaccttttttcttaactttcaaaagtgctaaaatgccctgtgtagtatcatgtaaaatagtgacactaatgcctcactcagtggggaggtagatgtggctgaggagggacagatgaatggatctagtcagtagtaacacatttgaagttctggctgatccacagagtcttttacttctagggtcaaggtggtaacagccaattaataggagagcaggttggaagaagagtaaaagatctacatgctcatgttacttgtcgtgctcacagaaaacaaaccagttttgtgtgagaaaattgtttcccgtcaacttgaaaacattgaatttgctcaccctggagctttctttgatgctcctctcttcaagtcccatgtggctgtcttccttctaagaaagctatttataaactgcagtgctctacgcaactgtaagcacagtggctgcagtctagtggaaatattttggggtcacaggtagttctgtattcaaatctcagctctggctctttctagctgggagacttgagcaaattatttaacttcctgatctatagcttcctcgactctaaaatgggggtaataaaactttgtttacaggattgtgtgaggattgagactgacacaggtaaggcgtcttctaccatggctggcacttagtctgttttgcttattacttagggctcaactttgaacgaacttgaggttacaaagctcagtatcaggttatcctcgggttgtttcctctgtaatcctcatttccctcagagcatggtgagagtcttgaagacatgaaacattttatgcttttctaccttccttgtgccttgcagagtcctcagtatccagtcagcacttaatgcttatactgccacttctggactgcctttcaacaaatttctcaaagttagagaccatgaagggcatggagactggtgcttttcatgccgtgcttctgcagattttggtggggaggcggtaataggggaatgaaggtggagccatatgaaataaactcttaaaggcatgatagtgaccaggaaaataatatgtaccatattgtgtgacaatccctatgcattgccaaaattgcccagtgtatttttattatgattaaaaccacaatgacacatatgatgcccatttaacatgctccaaaaacacaacaggaattcaccttcacaaagaacaatagacatggggccaagaccttggattctgaccagttttaaacacctgcttcctcctacacagtcgagaattatcttacacgattcagccttagaactgggggcatggtttaaattgtaatgtctgaggagactcaggttggctgaataagaaggatgacagtgcctttgtccagttaaatctgcagaggttgtcttccatcctatgcagctgcctaccataaaagaggaatctaggaaagattttccatatagcaggcactcagtacttatgtaaagaatgaaaggacaaaaaaattgttctctttgtatgtcttaatgtaaccctaagagttccaagccaattgttgacattattctaacatagcataaagatttggacagacctgggtagcacattgtaatgatatttggcttgttgatttctcagctctaagagaatctctgcttttgccaataggcacacataagaatgttcttaatgctttagtaataacatagttatccaaaatgttaaactttattccgcaaaattttaactcaaaaaatatttttcagcaagtttacatgtattccctgggcaacactggtcaggcattcattcaacagtagacatttaagtatatattatatactgttcttgattgtgtgggaatttcaaagataaatgagattctatctttgccacttaagacttacaattattggctcccaggcaagatggctgaataggaacagctctggtctgcagctcccagtgagaccaacacagaaggcgggtgatttttgcatttccaactgaagcacccggttcatctcactgggattggttagacagtgggtgcagcccatggagggcgagcagaagcagggtggggcattgcctcacccgggaagtgcaaggggttggggaactcccttcctatccaagggaagccaagagggaccctgccatgagggacagtgctatcaggaccagatactacgcttttcccacagtcttcgcaacctacagaccaggagattccctcaggtgcctacaccacaaaggccctgggtttcaagcacaaaactgggcggctgtttgggcagacatcgaactagctgcaggagttttatttcatacctcagtggcacctggaacaccagcgagacagaaccgttcactcccctggaataggggctgaagccagggagccaagtggtcttgctcaatggatcccaccccatggaacccatcaagctgagatccactggcttgaaattcttgctgccagcacagcagtctgaaattgacctgggacactctagcttggaagggggagggacgtctaccattactgaggcttgagtaggcagttttcccctcacagtgtaaacaaagccgcctggaagttcggactgtgtggagtccactgcagtgccacaaagccactgtagccagactgcctctctagattcctcctctctgggcagggcatctctgaaagaaaggcagcagccccagtcaggggattatggataaaactcccatctccctgggacagagcacctgcaggaaggggcggctgtaggcgcagcttcagcagactttaacgttcctgcctaacggctctaaagagagcaacggatctcccagcacagtgctcgagctctgctaagggacagacggcctcctcaaatgggtccctgacccttgtgccttctgacggggaaatatctcccagcaggggtcgagagacacctcatacaggggagttccggctggcatctggcaggtgcccctctgggacgaagcttccagaggaaggaatacacagcaatctttgctgttctgcagcctctgctggtgatacccaggcaaacagggtctggagtggacccccagcaaactccagcagacctgcagcaaaggggcctgactgttagaaggaaaactaataaacaaaaagcagtagcatcaacatcaacaaaaaggacgaccatgcaaaaacttcatcctaaggtcaccaacagcaaagaccaaaggtagataaatccatgaagatgaggaaaatccagcataaaaagggtgaaaattccaaaaatcagaatacctcttatcttccaaaggattacaactccttgccaggaatgggaacaaaactggatggagaatgagtttgatgaattgacagaagtaggcttcagaaggtgggtaataacaaaatcctccaagctaaacaagcatgctctaacccaatgcaaggaagctaataaccttgataaaaggttagaggaattgctaactagaataactagtttagagaagaacataaacgacctgatgaagctgaaaaacacagcccaagaatttcatgaagcatacacaagtatcaatagctgaattgatcaagtgaaagaaaggatatcagagattgaagatcaacttaatgaaataaagcatgaagacaagattagagaaagaaagaatgaaaaggaaggaacaaagcctccaagaaatatgggactatgtgaaaagaccaaacctacatttgattggtgtatctgaaagtgacaaggagaatagaaccaagttggaaaatactcttcaggatattatccaggagaacttccccaactgagcaagacaggccaacattccaattcaggaaatacagaaaacaccacaaagatactccttgagaagagcaaccccaagacacataatcgtcagatttaccaaggttgaaatgaagggaaaaatgttaagggcagccagagagaaaaatcgagttacccacaaagggaagcccatcaaactaacagcatatctctctgcagaaaccctgcaagccagaagagagtggggaccaatattcaacattcttaaagaaaagaattttcaacccagaatttcatatccagccaaactaagctttataagtgaaggagaaataaagtcctttgcagataatcaaatgctgagggattttgtcaccaccaggcctgacttacaagagctcctgaaggaagcactaaatatgggaaggaaaaaccagtacaagtcactgcaaaagcaaaccaaaatataaagaccattgacagtatgaagaaactacatcaactaatcggaaaataaccagctagcattataatgacaggatcaagttcacacataacaatattaaccttaaatgtaaatgggctaaatgccccaattaaaagacacagactggcaaattggataaagactcaagacctattggtgtgctgtattcaggagacccatctcatgtgcaaagacacacatggctcaaaataaagggatggaggaatatttaccaagcaaatggaaagaaaaaaaaaagaaaaaaaaagcagggattgcaatcctagactctggtaaaacagactttataccaacaaagatcaaaaaagaaaaagaagggcattacataatggtaaagggatcaatgcaacaagaggagctaactagcctaaatatatatgcacccaatacaggagcacccagattcataaagcaagttcttagaggcctacaaagagacttagcctcccacacagtactagtgggagactttaacatccacctgccaatattcaactgatcaacgaggcagaaaattagcaagaatattcaggactggaactcagctctagaccaagcagacctaatagacatctacagaactcaccaccccaaatcaacagaatatacattcttctcagcaccacatagcacttattttaaaatggaccacataattggaagtaaaacacttctcagaaaatgcaaaagaatggaaatcataacaaacagtctctcagaccacagtgcaatcaaattagaattcaggattcagaaactcactcaaaaccaaactactacatggaaactgaacaacctgttcctgaatgactactgggtaaataacgaaattaaggcagaaataaataagttctttgaaaccaatgagaacaaagacacaatgtaccagagtctctgggacacagctaaagcagtgtttagagggaaatttacagcacaagtgcccacaggagaaagcaggaaagatctaaaatcagcaccctaacatcacaattcaaagaactagagaagtaagagcaaacaaattcaaaagctagcagaagacaagaaataactaagatcagagcagaactgaaggagatagagacacaaaaaacgcttcaaaaaaatcaatgaatccaggagctgtttttgttttgaaaagattaacaaaatggatagccagagtaataaagaagaaaagagaaaagaatcaaatagacacaataaaaaatgataaaggggagatcaccactggtcccacagaaatacaaactaccatcggagaatactataaacacctctatgcaaataaactagaaattctagaagaaatggataaattcctggacacacacaccctcccaagactaaaccaggaagaagtcaaatccctgaatagaccaataacaagttctaaaattgaggcagtaattaatagcctaccaaccaaaaaaaagaccaggaccagacagattcacagccgaattctatcagaggtacaaagacaagctggtgtcattccttctgaaactattcaaaacaatagaaaaagacggactccttcctaactcattttatgaggccagcatcgtcctgatatgaaaacctgacaaaaaaagaaaacttcaggccaatgttcctgatgatcatcaatgtgaaaatcctcaataaaatactggcaaactgaatccagcagcacatcaaaaagcttatccaccatgatcaagttggcttcatccctgggatgcaaggctgggtcaacatacacaaatcaattaacgtaatccatcacataaacagagccaatgacaaaaaccacatgattatctcaatagatgcagaaacgcccttcaataaaattcaacaccccttcatgctaaaaacactcaataaactaggtatttgtggaacatatctcaatataataagagctatttatgacaaacccactgatatcatactgaatgggcaatatcatactgaatgggcaaatgctggatgcattccctttgaaaaccgacacaagacaaggatgccctctctcaccactcctattcaacatagtattggaagttctggccagggcaattaagcaagagaaagaaataaggggtgttcaaataggaagagaggaagtcaaattatctgtttgcagatgacatgattgtatatttagaaaactccatcgtctcagtccaaaactccttaagctgataagtgacttcagcaaagtctcaggatacaaaatcaatatgcaaaaatcacaagcattcctacacaccaataacagacaaacagagggacaaatcatgagcaaactcccattcacaattgctacaaagagaataaaatacctaggaatacaacttacaagggatgcgaaggacctcttcaaggagaactacaaaccactgctcaaggaaataagagagaacacaaacaaatagaaaaactttccatgttcatggataggaagaatcgatatagtgaaaatgatcatactgcccaaagtaatttatagattcaatgctatttctgtcaagcttccattgaatgtctttacataattagaaaaaactactttaaatttcatatggaaccaaaaaggagccggtatagccaagacaattctaagcaaaaagaacaaagctggaggcatcatgctacctgacttcaaactatattgcaaggctacagtaatcaaaatagcatggtgctggtaccaaaacagaaatatagaccaatggaacagaacagagacctcagaaataacaccacacatctacaaccatctgatctttgacaaacctgacaaaaacaagcaatggggaaaggattccctagttaatgagtggtgttgggaaaactggctagccatatgcagaaaactgaaactggacctcttccttacaccttatacaaaaattaactcaagagggattaaagatttaaatgtaaaacctagaaccataaaaaccctagaagaaaacctaggcaataccattcaggacataagcatgggcaaagacttcaagactaaaacaccaaaagcaattgcaacaaaagccaaaattgacaaatgagatctaattaaactaaagagcttctgcacagcaaaagaaactgtcatcagagtgaacaggcaacctacagaatgggagaaaatttttgcaatctatccatctgtcaaagggctaatatccggaatctacaaggaacttaaacaaatttacaagagaaaaaacaaccccatcaaaaagtgggcgaaggatatggacagacgcttttcaaaataagacatttattcggccaatgaacatattttaaaaagctcatcatcactggtcgttagagaaatgcaaattaaaaccataatgagataccatctcatgccagttagaatggcaatcattaaaaagtcaggaaacaatagatgcaggagaggctgtggagaaataggaacacttttaccctgttggtgggagtgtaaattagttcaagcattgtggaagacagtggggtgatttctcaaggatctagaattagaaataccatttgacccagcaatcccatttctgggtatatacccaaaggattataaatcattctactataaagacacatgcacacatatgtttatggcagtactgctcacaatagcaaagacttggaactaacccaaatgcccatcaatgttagattggataaagaaaatgtggcacatatacaccatggaatactatgcagccataaaaaaagaatgagttcatgtcctttgcagggacatggatgaaactggaaatcatcattctcagcaaactaacagaggaacagaaaacaaacaccacatgttctcactcataagtgggagttgaacaatgagaacatatgggcacatggaggggaacgtcacacaccagggcctatcaggggttggcaggcaaggggagggatagcattaggagaaatacctaatgtggatgacgggttgatgggtgcagctagccaccatggcacatatatacctatgtaacaaacctgcacgttctgcacattgtatctcagaacctaaagtataataatttaaaaaaaggaaaaaaaagcataattatttttatattaacactagcatttcatatcttaaagcaactgatgtttaggaattactacacgtggtggctcatgcctgtaatcccagcactttgggaggccgaggctggtggatcacatgaggtcgggagttcgagaccagcctgaccaacatggagaaaccccagctgtactaaaaatacaaaattagcaaggtgtggtgacacatgcctgtgatccctgctactccagaggctaaggcaagagaatcgcatgaacccaggaggcagaggttgcactgagccaagatcgtgctattgcagtccagctttggcaacaagagcgaaatctatctcaaaaaaaaaaaaacaattactacgagtggtacctttttttgcattagtgtcttttatgtggcatcatgaaaatttctgatgaattaatttccctaattaacgtaattccattattcctagtgactttaacataattcctaatgatacttccataaacaacaggaccattgaatttttgagatttctctgtggttctttttttcctcaggatattttccattgaaatgtatggttgaaatttgatctttgaaaatctacttgatgtataattaggcttatttctatcagtttgttttttaagagttgttttgattttttcctttttatttaaccttggtttttaataatctaaaacttgtacatgattccaaaatcaaaactatgaaacaaggtacatttggagtattcattcctgtctgttctctatacccttttaacaaatgaattttaaaaattagtttttagtgtatgttttagtttacttatttctttttaaaagcataagcaaacccacacacatgcatatataagataataatatgaatatttatacatatatcaattcataaatcttttcccctttctacacaaatgtagtatactagatgcactctactggaccttgttttctcatgtaacaatacattctgaagatcattttatttcttttgatagctgcacagtaccatattatgtggctacataatattttattcattaggttgcacactgatagacataggggttgtcatatcatgctttaaataaatatttcccaagtggctgatcaggtaatctgaatgtctgtccattggtggttatatgtctcttggagactaatacctaacagaaatcaattttttgtgtgagttgaatgtaaaatgatatttatatcattttataaactaaaaaaatgtttagttttggcacaaccttgaggaaagcagtgtgacaagcctggtgccagatcccatggagaactaaccctggacagcctgggaaaactcctatgtaaacatggagaacccagatcaaagagtgtttggagagtgataacaatcacttaggacttaccttttctgaaaatcttaaaaattttaagattgtgaatttttaaaatagtgattcataaactatttaggtgacttgctgtggagccattggaccagagattttgttcaaaatgaaaacaacatgcagttaatcatatttgcaatggggccattgttgtctctttataggtttagttttaaggctggcattaaagagttttgcaaaattatttatttatttttctaattcctgggcactgcatctgccaccctgaaagaggccttcaggtaggtggtggtgtatgcattggtctcatgaactcatgcaatatttgccatagttttctcttgggaacaaagtgtgttattgggaacaaagagttccataatcaaataaatttgaaaagaactaagtttatttattgcaagatttcttagagcttttagtaactaatatgcatataacttctcaagatagggatgtaaaatgctggttttcacagacattttcctttatggagtctatttttcatggagcatgttttgggaaagttagatttaatggttaagtttcttataattgtgaatgacttagtgagttaattggagggagagagagaattaattgaacagagtagttgttatcatttctatgttacaggagaggaaactgaggcttcagtgttagtgacttgcctatcatggattgaagacagatttctagattgtaaattgttaacatcatcatatttaaagacttaaaggaagaaaaagtatggaaagggtttagtaattctcttaaaaatatccaatttatataaggaactcaattaactagaaagaaaacaaataacttgattaaaaattgggcaaaggacctgaatagacctttctcaaaagaatacatacaaatggctggcaggccattttaaacagggtatatgaaaaaacgctcaacattactaatcatcagggaaatgcaaattaaatttagaatgagatatcaccactcacctattagaatggctaatatagaaaataccaaagattacaaatattggcaagggtgtggagaaaagagaactcttgcacactgctggtgggaatgtaaattagtgaagtcattatagaaaatagtatggagagttctcaaaaaactaaaaaaagaactactatatgatccagcaatcccactattgggtgtatatccaaaggaaattagtatgttgaaaagatatagctgcactcccacgttcattacgcattgtcgacaattggcaagatatcaacctaattgttcatcagtggatgaatggatatagaaaatatggtatatatacacatggaatactatttagcctttaataaaaaggaaatcatgtcatttgcaacgacatggatgaacctggaggcaattatgcttagtgagatcaaccagactcagaaggacaagtaccacctgccctctctcatatgcagaatctgaaaaaagtctcatggaagcaaagactagaatggtggtggctaggagctgggggaatggaggaattggggagatgctgttcaaagggcacaaaatttagttaggaggaaaacgttcaagagacccattgtacaacatattgactatagttaataaaaacgtattgtatacttgaaaatctccaatagaatagattttaagtatgcttatgacaaaaaatgataaatatatgaggtaatgcaaatattagttggctcaattcagccatttcacaatatgtttgtattttgaaacatcatgttgtacaccataaatatatacaatttttgtcacttgaaaaaatcctagaaaggggaaaaaagaatattagtagaaaactgatataattcaaataatatctgtggtttacttaatagtgctatacttatgttaatatcctagtttttgataactttagtatggttatgtaaagtgtaaacattagggaaagctggggaaagggtaatttggaactttgaatctttttcttttcttttcttttttctttttggagagatggggatcttgttctgtcacccaggctggagtacagtggtgcaaatcatagctcactgcagcttcaaactcctgagctcaagtgattctcccagctcagcctcctgagtagctggaactacagttatgcactaccatgcttggttaattttttatttgttcatttattgtagagatggggtcttgccatgttgcccagtctggtcttgaatccctggccttaagcaatcctcccatctcagcctcccaaagtgttgggatttcaggcatgagctgccatgtgcggccaggaactttgaatcatttttacagcttttctgtaaatcaaagactttctcaaaataaaaagttaaaagtaaaaatttataccaacatatatgaaatgaattaaataaaaatgcacatattacatcaattgttattatgtaatgcaaaaaatttcctagtcttattaggatttttttttaagactaaaacattttctaggccattcagcaggagtgggattgggcttgccactggccttcccccttgctacggatgtgggcttatggatatatgtaaatactgtacatcagatggtgatgcctttgctcagagtccctgcaatcagaaccctgataggaggatttatcctgctttcaacttagcagagagaaagaattacttttactcttcagacagtttatcttttcagtcgttccttttctctgacatttttccccttgactagagtaaaagtagttatccttaatgtgacattggaagagagagatcacggtcatattttttgtacacaaaccgtctctacatcacatcacattgaccttctcctattcggggagaagggtatttattgcctgctttctcaccaagttctctagcttttgatgtttaaagttgttatttcatgacatttcatgaacttattttctatgaggtttctaacatgactttggcccattcgtacaaatgattccatcttggagctccccctgccagtgccaccacccccactttctgttttttacagaagatacatatgaagtctatttaaagagaagatattacaaacaaatatacagtactattcaaacattctgaaattagatatagttggattcagatgaatttattaaataaaaagacaaattcatgagtgacatttcttaacttggtatattcacagcatatcagtggagaagtaaggagatttacttcattattcacagcgtgatcatgatcttcagcaggtgttcaagaactctctgatgctgagactaaaagtaattcatcttcctaaagactttctatctttgggagggtgacatttcctgtctggcttttctgatgattcttacaacttaattacttttggcatgtccagttgcttgctttatttactacattgtataggtcaaacacttgaacctcaggtttatgtttgttttatcaaacttagagaatataattattcagagagtaattttcagattagcacaaacatacattttctactagagagtatctattcttaaagctcacttgtgagacattatatttttcctgttgtgaggatgagatggcattctctttgggatctaaattgcttctgaggcaggcacttttgtgtattgttatctctataccccgaagaacaactggagtgcaggaaaagcagggttttagacaaatgaaagtgggatatgccgtctgggctgatggctacgcttggcatcaccaaatgggagacttaagagccttctgcagtcacggctgcagtggctgattattcttccagccatgtctcttccttccttcttctcttctcttctctcctcttctctcctcttctctcttctctttttttttgagacagtctcaaaaaaagaggctggaatgcagtggcgcaatcttggctcactacgacttctgtctcctggattcaagtgattctcctgcttcagtttcctgagtagctgggattacaggcatgcatcaccatgcccagctaattttgtattttcagtagagacggggtttcaccatgttgcctaggctgatcttgaatgcctgacctcaaatgatccacctgcctcagcctcccaaagtgctggaattacagatgtgaactacagtgccaggcctttctttctttttttaaattttaagttcagtcaggggtatatgtgcaggtttgttacacaggtaaaaccaagtcatgggggtttgctgcacagctgtcatcacccaggtattaagcctactacacagtagttatttttcctgactttttccctcctcccacccttcaccctccaccctccagtaggtcacagtatatgttgttcccctatatgtgtccatgagttgtcatcatttagctcccacttataagtgagaacatatggtgtttgattttctgttcctgtgtttgtttgctaaagataatggcctccatctctgtctttcttgcttgcttttgttgagcagggggtgggtaacactgcccggtgattgtgtcacctcacactgtcaccccaaaatttcagattccagaataactaataaataaaagtttttccacagttggggaaaggaagataaaaaagtttaggaagcaaagaagatggtaatggggtttttacgagccttcccctctttgaaggccagcagggtagttgaatgtgtgtgtacagaagccacatgctagcaatagtatgatgataatcatagtagttatcattttctggcactcactatgtgcctgaagtggtgtaaatgctttacatgtcattaatgctgttagtttctttaacagctctgtgaggtgaatgtattgttattctgctttgctaatgagaaaactgcagcatagagagcttagtggagcaatctcaccaagtttacagttagcacactgcagaggcggaattctcactgacatgttttctactccattgtctctgatttgacccaggaggaatggtgatggtaggcacctgagctattgagtgttgtaatatagaaggcagactttctgtgttcgtaaggcacaagagtctgctaaggatttccttttttgcttcattttacattttattcaaaggttcaaaattgataagcttaattaaaatatcagttccttaataaagcgctctaaaacatatttaaacaaaatgccatacatcatgccttagttgctttactaatataatgttaaataaatatttcctggccaggcatagtgatttacacctgtaatcccagtgctttgtgaggtggagacaggaggatcacctgagcataggagctcaacaccagtctgggcaacatagtgagaccttgtctctacaaaaaaaaaaaaaaaaatagccaatagctgggtgcaaatacttgtagtcctagctacctgagaggcgtgaggattgcttgaacccaagagtttgaggctatagtgagctatgatcacaacactgcactctagcctgggcaacagagcaagaggccccgtgtctttatatatatataatatataatgttttctaacttttgtggttacataattatagaaatattagcaaaattaaaggaaggggtgagattttatatttatcaattgtatggattgaccgttcagtattggttgattgattgagacagggtctccttctgccacccatgctggaatgcagtggtgtgatcagagctcactgcagccttgacctcctgggctcaagcaattctctcatcttagcttccccagtgctgaggttacaggtatgagccaccgtgaatggccagtgcttttttttttttttttttttaatctctcttcttacacatcacttttgtttttatattattgttattcatatatatgtcttgtcacccccctattgagttggatgctctttgaatgttttttatttcatgggttctcaataaatatttgtgccacaaatgacttaatattacttgttactatgaaatttgtgcctctatatatgttgggtgacaattagaaaactaatgataattattgcatcaaaaataatttgagagcacaaatcttatagcattgtcatgtaagatgggtacatatagatttttgttattcttcatttgttgggcatgtagaataaatccacaataaattcaatagaagtaaagcttatttctgcatgtatatctagataaacataaaatattgattctctgttttggaaaaaaggaaaagataatgactaaaatttctttgtggtctctatgatggtttaatcacatgtctctcaaaaatctaattttctaagaatcaatctgtctgtgtgctagcagactgtgaaaacctactggtttctttaaacatcaaaagaagtcagcctttaaatatttggacgttttcctctgagatacggctgcactaggcaaacacactgacattaacatttctaaagcaggctcaaaataaatgagaataataaaaaaaaaactccttccaatacctaattgccattttaattaaagcttctgtttgtcatcagtgacaagagattgcctcagaaagataaaataagactgtgtgtctttggctttcatgaagacaaaaggtttgtgcaagaagtcaaatacccagataactttgctgttactttttaaattaaacaatttgctaagcatcaggtgaaccaaattattcataaattaacattttttttaggccagtacatctcaaatctagtttatggatggatttcctggtttgggtgcttaatctagtgtgtgctagaatcttatatcacaggctgttttatagagataaaggaatctggaaatggaaatcactttcttaaatggcttttgatttgaaattttatttattcaggttaccttaaggttataagatcaaataagaacatactacaaagagctttgtaaaagataaaatattacttgttatcttaattattattatctggaaaacaaagttaaatgcatgtgtttattccacccctccctctgacccaattaatgcatcaggaaattgggaatttgctttggtgcatctgtttaaatgctaagaactgggacttggatttgctgctcaagaatccctagcccagcttcctaaactttataaagtcaaataaaaatagggtcaccaggtaacatggaaagagcaggcttatctttcctctcagcttctgaatgaagttgaaaatgtgttttattgtagaacaggtaaaatgtgattcttataaatgggaacaaaagaataattttaatgatgaatttgaacctggaatctgaacaacagataaaatgcaatcagagaagcactgagactatgcagtgcatttgacacagaaaataccaagagcagcattagcacttttctgaggccttatcttaattaaacttggccagatgaagtttctttggtaaatgcaggttcttctcacaaagcctttcatcccttattgcagggagagccacattttccaaagaattgccccctcactggagggaacccagacagcaaaccccagaacttactggcatcaagagtgctccatgtgagggtaccatgaagacggagattgggagatattgggtgttctcaaatgcgacagattttaccagtaccgttttctcttgggatcagtataatgtaaacctcttgagaacggtatctgagtctctgtatttcctcacatgcctactatccaagaattcaaaacacatatgtggttgaatgagtacccttaagcccaaactgctgactgtaaccctttatccaacctcatcttgtttacctttgtgtaacattggaaatcacccatccccttttctgttggaaactttctttaactttcctgattctccgtttacgtgatttattgctgctgcctctttctttctctgggttccagtctctaccccctcaagctggctatttcctaagattctgtttccagccctcttctttatattctttggctgactgtgcattagaattgcctgggaggtaaccgcagcctgccctgtcctgcctcgtgtttctgtgtgtgtgtgtctgtatgtggtgcacacgtttctgtttttatttttttattttaaaaaatttgatttttattagctttttcttttcttattattatactttaagttctagggtacgtgtgcacaacgtgcaggtttgttacatatgtatacatgtaccatgttggtgtcctgcacccattaactcgtcatttacgttaggtatatctcctaaagctatccctccccctcccctcaccccacaacaggccccggtgtgtgatgtcccccttcctgtgtccaagtgttctcattgttcagttcccacctatgagtgagaacatgcgatgtttggttttttgtctttgcgatagtttgctgagaatgatggtttccaacttcatctatgtccctacaaaggacatgaactcagggatctagaactagaaataccatttgacccagccatcccattactgggtatatacccaaaggattataaatcatgctgctataaagacacttgcacacgtatgtttactgcggcactattcacaataacaaagacctggaaccaacccaaatgtccaacaatgatagactggatgaaggaaatgtggcacatatacaccatgaaatactatgcagccataaaaaaagtttttgtttttaatgtttgcaagtaagttacagacttcctgtccccttatacctcagtgtgcattttgaaaaacaaggacattctcttgtattattaccacaatacaattatcaaaacctaaaaattaacattaatagacttcattcagattctgctgattgtctcatcaatgtcatctctaacaaagggcaaaaaccaatttttgtggtctaggaaatcaatccaggatcacatgttgtgttgtgctgtcatttttaaagtctcttttaacttagatcagttcttcggtatttcgttgtttttcatgaccttgacatttttgaagtgtacaggccagttattttgggttaatctgatgttgtttaatgattagattcagattatatgtttttggcaagaacaccactgaaagaatgttgtgtcctttttcatgtctcgtcatggtatctatttctgcccttacttgtgttcacttaattaatgtggtatctgccatatttctgcactgtaaaattactctttgtcccctgtaattaataactatcttgtgggagacacaccaagactatgaaaataaatatatctattagtgttaatgacggtcagttttctcattgttgaagaagaaaggaattatagatatgaaaaggtagaatgctagagtgaacccatgtgctgttggattaagattagcaataactgtatgaattcgtggtttttatagctatgtagatcaatctaattgcctagctgtatcctctgacaggataaagaagcaatgataattcagtagcaattagcataagtagtaccattatcttggtttctaaatactattcaccaacaaaaatcaaccaagtcttcttccttgctggggcaggaaaagaacaagataagcctggaacaggtgttgttttttgtttttgtttgtttgtttgtttttggtttttttccatttgaaagtaagagagtgagcaaagaatgatggggacatgtcaaaaggacacacgagccagctccaaggggctcctactagccaaatacaggacaatgtgaccataaaaataaatggtagtaacagatggaataagaatccatgagtccatactgataagaacaaatagatgagcaactatgtaaaatggaaagttagttattcattacaatagaattccaacaaataaatgtgtgtggtatggctggatgcggtggctcacgcctgtaatcccagcactttgggaggccaaggcgggcagatcacctgaggtcaggagtttgagaccagcctggccaacatggcgaaaccccatctctactaaaaatacaaaaaaattagccgggcatggggtgtgcacctgtagtcccagctactcaggaggcagaggcaaggagaatcccttgaacccagtaggtagaggttgcagtgagccaagattgtgccactgtactccagcctgggcaacagagccagactctgtctcaaaaataaaaaatgtatgtagtatgattgattgaaaatcatcatttgttaactaccatagtaatggttgtttgaggcaagaatcatcaatgaattctcttttttaataacatagatttgttctttctgactcctccctatccattcagtgcacagcttttagcacacaattgccttggtcaaatctgttcttaagctgggcttccccttcccattgtaccatgtgtgtgaatatctaagaccacaaaatatgctgcttttccactactgaagtaatatcttacctcatctctgtttagattcttcacacattccaaggaaacacttagctaattttctattagtttgaattaagttgagatgctagagaagtttgctagaatcatttttcattgccagctaacataagtgcattttcaaacatgctattgataaaatctggataagttagagggaactatctgcttgggaagcagataaatgagagtctattgggggcaaatgagacttttggggttccttctatatcatagaatggatggacatataatttcatcttctgccttgaagacaggtgttgagaattgacctaagctgatttggtcattcatagcccttagtggttttttcctccatggttcatacatcaaaagaggtttgagctgagtcagtgttaggcactacacaaaactttgctactagtccataatgaaagcaagccagacaaaattctgctacacacagagaccattgattacataaatacttaacagcaagcaaagtaaaaaacatttttttacagctcgttatacaacttgttaggaagtcccagttctgctaccttgcataaaggttcttccaaggcagacagggcaacatcccagaggctggatcctgttacccttatcaatccagtgggcaatgccaaatcttcttaaatcaacaggtggacactgggccatttaggaaaaaacctcaggtttgtctctgggggagaggctctctggatccttatcctccattacactagagtggagaatatctctaaaatatttttgctactccacatactcttgattgtctttaattttactcgagagagtccatttctaaattcttcatattaataagccactagttttaccaattaaaatccattgctagcatacattatactgattattaaagtcttaggtgttaataaaaatcaggataatagaagtacttatagtgattgcttctggagtattgcctttctgataaaatactggataaatgtacagtcttgatgaaatacactgggagaacattacatactatagtgccatcttggaaattaaaaatgcatgttagctatttagaggttaatgtcctgcaataaaggaaagctgcttagttttgttcgaccttgcatttcccaaacttagttgaccccaagtccttttttccatcgcactcttgaaattagttattcctgggaaaggctttagaaaacattgctttagagattataggagaagcttccttcaacatccacttaactgacactcagcattctctttataaaattcgaggataataggcacctatcttaaatactctctatcaagttgagttctgtgcttacaaagagtcaattgagattttttccaaaacggttttattctatttgtacttgtaattacagttacataacttaattaaatattacataatcccgtgacttttgagtgtaaatataaagagttattgtttctttgaaaaataaactgaaagttttggaaagactctagaaaagaattgctgaaagtgttattaaataaggtgagggtaagacaactatgaaagatttgggaaaaatataaaaaagaatttctaatacaacttactttgtaagtatcttttaagttattgatgcattttcaagaaactgaaatgtatcatttttcaagaaagagttcaagcagagaacttgaattagtggagccatactcaaaagccttacatttaaataaaacatgtgaggtatatgtatgccaatttttattattttctgcttttactgaattttttgattaagtgactaagcataaaccttgtaagagtcagaaaagggcttttgttctagagagagagagaattaaagagaagacttcacaaagcaaagtgtgtacacacacacacacataccccttgtggcatgttttaaaatattccacatagattttgcccatatttcctcaagccaggctcagttgtcttcagaaccctttggcattcttgacacactgcttttgtgttttttcaactttattgtaagtctgtgggattgcttaataccttgttaaagaaaattagagttaaaaatctaatttctccctgggagtggtccatatatatatacatagttcatggctgggaacaaagtttactactagtgtattttttcagtgttattttgtagtaaaagttcttaaaatattgtgtaataaataatatttgatttctatctatgttctcttaggcttggtcccatggcagcctataattcaaggttaaggttatgttgttatttaagaatttttagcatctgtacttgtatgtgctgcataaacaaaacagttattctattgcagaccagtttttccttttgaaatgtagaatacaacaatcacttctcaggtttaattaagactgtgtttgtacagaggtctgtagtttataaaagcagttaagcaaagaaatgcttttgttatatacaaacagaacaaaaagggaaaatactgtcttgatcctttcattaaaggtcaaaaaaaaaaaaaaaagaaaaaaagagttcactcaattttttatctcgtgttttttcacaaataccagaaacagagctgtaagatagtaatttgttaaactacacattaagctggtatttgaatatgaaaaggtatttccaccccgtgcaatattgcttttttgaaatactaaaagcccttacattagggtggtaattgaatgactgcttaaaaacaaaccctgtctgcttcattttgacaggttctttatacatttttgtggagggtaaacatgtcaggatgtagcagactaaggaaggagctggtattgaacagggttcatagtcaaagtgacatagtttctcattctcaagaagagtagttggcatggttgttttgggacctgcaatatagtttttctagattcaacatggaaaacattattctaaactctagtgatctatctgcccatagcttatgccaagcagcatggattatacatttttgatacctgtagacgttttaggagccttcttgatgttatgttgaaatcttattcctgtagttatccacataattttctaccaaatcaccctgtagaactgatgcataattacttcttaggatttgtttgttactgtaataatgaaatattttcctgtctcttggtatacccatgtgtatactgtgttttttattttgtaagtcccatgaaggagaaaggacttctatttttgttttattggagttgaacacttcttgagcctccttcttggagattctcaggtttctgatcattcttgttatagttaactgattatttttgtttccttagatcaatttagagggtcacaatatagcactttcagaaaatttgtcagagcttttattacattaggaagagtagccatttaagtgtgcaaacacatcactcattgactggctcactgaacatctatgagtcaggtagctgctgagaactagagatgttaagctagatgagatagttctctgcaagattggtcaatattcctttttcagctgctatgttctagaaaatgtatggtaccatatgaaaagataattgaaatggagaacatgttatttgctagaatggggcaaacatatgtcttaacctacatgaaaaatatgggagtgacattgagattggagttagggagagggaatagatcagatttggacattttgtccgaagtagggcaataaattatgtcttaaatacgacttgataccaaatccaaaagtagaatggttgcaacaatatttcttctagttatacttctttttctgaatcttactttgttatggaaatcatagagcatgctgatattctcagcatagacgaggagttgaggagggtaagggaaaatataggcaaacaggacaagattttcatcccgtggacattagtgcatttgaaaaactggctcttgggcttcatgttttggacagtcaggacagaggtctcacaggggttatttgcaggttttgctttttttgaggttgcagccatcctaggactatcatgactgtcatgtggtgttgagagaaaggaagatagaaaaaagatgctttttgaaaagcttttccccaagacctatcattgggtcttctttctcctggtggagataggggaggagaggcagagaggaacccagctgtcagcaatggtgcagtgggtccaaactgcttctccttggtgggtggaatttccgttctagaggaggatctgaggaggcttatgagcttccctgggaattgctttcttcttccagcttctgaaaggttctcttcatttggccccaggaggaatgaggaacacactacaaagctttccattctacaggctctgtgagctgagtggtgaagttgcacattttctaattggagaaaacatggtcccatacattttaggttggctaagaagaaatgcctgagattcatggattgaagtgtgccttcaattggtcttctgctagagtttcatgtagaaactgatagatgaaacaatacatttacccaaatatgtgaaccaaaggactatgtgaatagagagggactgattgtgtctactcagtaaataggccaaagaaagggcaacaagcgaatcacaaggactgtttaaagccctggccaatggggggttgggggaattgtgtcttttgcataagttgctcccagtttgaaatcttcttagtacactcccaaagctgctctgtggctgccagcagtgttagcctgagatctcttaatcctcatatagatcagcatctctctaaaataaatcacttgactgttttctgcctaacattgcaggaatggcttgggagactaacccttcggtttgaaatgtctgaaaactgcttctctgttttacaatcttgaattttacttagctctgctgctctttttagctttctcagaagtggattatattttgctacctttgccactgaagtacaaatataatcgttgttattttcttgtctcacagagtatattttgaccgaaataagtagacaatgttctgttttctaagttccaaccacagtgttttttttgtttgtttgttttacactcagtaatccacatattgttatttctaggtaattatagaatttttcagtcagtaatttactaagcacatgtcatgttttcagcactgtgtaaggaactgaggcatacaaatgaaatctgaggcatggttcaagtcttcatgtaggttacagtgtttgtggagaaataaaaccaaatcagaggaaacaaagaacaattaaatgttcaactgtgtagtactcatgataggaatctcctggaagtaaatactgaatatggataaattaatgaatgaagtgttcattcaaggaagaaatcattgtggactagaatgtgtcattgaataggtcggatacgaacatagccatgaaacataaataggactggtaagtggaggagagaatattctaggtgaagagagcaaaggtaacaaggttgatgatggagttgagcatggcatgtgttttggacaataagaggagaccaggtgacaaaaatcggtatgcaagagaaacaaaaaaataaagttgggtatccccccttccttgataagtgaacctcaattttgtgcctatctgcaagtgatgaatcatgattggtctaacccattcatgatgattctatcctccgcctttccagtctcctttggagctagggcagctctgtgatcgtgttctgccttcaagctgaagtctgctgatggcatttctggaaatgtttttgttctttgataaaatgttggcacctccttttcctctcctccttgccttgaatgaagatgcaaggtctgtaaatatacagcaaccttgctgttatgaggaaaaggcaaagagttattgtttctgatactgctgaactgctaaacccacaccaacagctgtctacctctggacttcctgttatgtgagagaaaccaacctctgtttatgtaaaacagtataaattatggttttagttgtttgcaatgttttaacattattttagaaaggttaatctgcaatagcacaccagctgaaccggaaggtgatgagaattgaggtggtggttttagcaatatgggtcttaagtgaagaagttctgggcaagacttgtggccaggggaataggaaggaaggcagacatctcagagaagaagcaaaagtattcagtgcagattcagtgaaggatagaagaagccagataacctcaaagtttctaatcaggaagataagtgggcctgcattacagctttggggataggcagataatggtaaagacgagttctgtcttaaggtatgttgagtttgagattatgatgatggaacatccaagtggaaatattacgtgcatagtcagaaatacaacatttgatttgaggcgaatctatacaatgcctatgaccttgggcatggagaaacagaaaagcaataaatgatgccaccagttatttgagaggaagaaaagaggtcatttgcataaacagacagagaaaggagataatacggggttggtacagggatgaatatgtcatcatcagtatccaatgatctagagagatcaagaaaggtgaggaatgaggagagaatttggtaaatctgacaaaaagtgaatctggtaaaaataggacaccaatgatttccaagagaggatatattggctgcccagatctgagcagttaagtgggaagggaagggagtccaagatgaaagtggtagtgacagatcattcattgaaggagctgggaattgagaaaggctgattcttgcaagggtggtagacctagtaaaagatggttttaaaaacagtgaaaactgggaggaaagaatttcatggaaaggcccaacatttaaatggaaagaaaggtataaacacacagagaaagttaaagaaatgtgtaatgttggagaaagactttagtttcaggacagttcagatattcctctgaaattggaggcagggatgacaaggaggctctggaatctaatgagtggaagcaaatatacttgtaaacagctgtctctactgggtaggtgaagtcctgtgttaggagctggtctagtggtagggagaagtgaaaggggagctagccacttcatgcagttacaaaatcatgcagccttgccatcaacgtggcaaggattgtcaagggcaaggctgcgtaattttgtgtctttctcaggcaggaccatagcggagaaccagaagctgaagaggagacccagaatcaggtggaggttcatagggagttgtgaaggtgagagaatctagaacaatgctcctggagagggaggagaaatctagtgttctcaggaagaggttaaagtccaagtgcagattgtccagagaacaggtttggttgggggaggtggcagagaaggggatggtggcttgagcagagtaagtccaaatctcagacagagcttgaaatggtgagatccaaaaattgcttctgagtacctggacacagcagcttgttacaagtagagatttaattcttgttctttttttttttttttttttttttaaatgagaggctaatttgtcacacatttcttttactttctctgtgtatttgtacctttctttccacttaagtgttggtcctttccacaaagttctttcctcccagttttcactctttttaaaactatcttttactaagtctaccacccttgcaaaattacacaacatattttcagtatattctagtgcattatttacttataaataaaattgaggccaagtataaataaggtacaaatgtactgagttttatctcactttggtgagacttcttaaatacgaaataaaaagccatccatgttccaattctggcaatatattccccttccacacattcaactaccctcttgctgaactcaaccttgggtttctacagtgttactgaaacctgccatccattcacagtggcttctcctagtgatttccatggagcacaattttttaaatgtccttaaaaaagcatgctactttaattatatggcagatggtgtgttgcatggtttcctaactggtgttacttccacactgtacttgaactatataaagaactttgctctcaactcaggaggaatcctgcgaagctcaagtttgtattaacttagagaggaacaatttctgtaggttgggacaaattttaatgtatatgttatagtactaattttattatgtaaaaactacacataaaccaaaaccataggggtttcaaataatcattgcaaattatgattaatttagtaagactttaaactgttgttttcttctgatttttaaaagtgagtcattatcatgtagaaattttgaaaaatggagaaaaatagaaagaaaataaaaattgctcttaatctcaacttcctggagatagtcactcttcacctatttttgggtgaggggaggggcactttattttttaaactgaatcatattaaacaacctttgtttcctacctcaataggtcaattgacttttaattctggtttcattttctgaaaactctgtaaggtcagcaagcaaaggtgttagaagtaggtagcatataacataggaattagcagatagcttatttctgtgggaaatagaaaggctgactaatctgtgacatccagtaactttttactgagaaaaatgtggttgcaatgagtaaagtctcccatgtcactattctgtagaagataaacaatgttttagctttattatgatttataccgtattcttttcaggattaactctaagcgtagaacattttagttttataccttgattagaatcatttatttatatcccaaaacatagaaattaatttggggtgataagtccttttgttgtcaagttatttttctcttaacatttgtatatagttttttgtattatgtttcctaatggaactcacatgtccattagagtcaactgattattcaagacagatttgctttaatctcccagtgtttattcagtttcatttaatattgtacttttatgagggttatgaatcataggaatgtagataatatgaaacatattgcattattttagatggaaagttagactttgtaatttagataggttgtcctcattttattacatagggcattttcactattatcttaactgtggaaatatttgatgagtcagttcatcttgttttatagaatttccaaattgacatgaaaagaaataattgttttgcattaatttatatttaatataagcacttgagaggtaaccaggaatgggaggaaaggaggaagacattcatggatatgcattctagagtaatgaatttcaactgccggaaatcaatggctctgccagattcatatgttaatttttaatgagtagacatttacttagaaattgatttatttggactcagatgaaaagcaaaaatggctgaaaattgtcaataatagcatacaattgcctctttaggtttagctgtgattatttttgaaataaaatcctcagggatgttggaagtgagccctaacagggtacacatgtaccattttatttgacagagatcttcattgcatatatcctaccacttttcatttcaatgtaacgagcaatcaaaaactgcttgttgagtttgaataaaaagggtgactggtggggggtggtagtatttgtcccttttgatgttttcatagtttaagtttgaggttggcaaactatagcctgcaggcctagtccagtttgccatctgtttttgtaaataaagttttactggaacacagacataatcatttgtttatgtattgtttatagctgctttcatgctacagtggcaaaattaagtaattgcaagaggagctatctagactgcgaagcctaaaatattagtatctagctctttactgaaaaaaaatttcaactaagtttagttaaacttttcccttatagtactgtatttcttaaacctgatggtatactattgtttaacatgtcaatatggaatcaaattaccaagatgctaaaggagaaagaaacctggccgaataggaacagctccagtctacagctcccagcgtgagcgacgcagaagacgggtgatttctgctttgaaaaatttttcagataagacataaataagtaaaacagagaaagatatatcactttataatcgagggctaaattgtatgatagtatcaaaaaacccttttcaggctcagtggctcatacctgtaatcccagcagtttgggaggcccaggcaggtggatcacttgagctcaggagctcgagaccagcctgggcaacgtggtaaaatcctgtctctacaaaaagtacaaaaaattagcccggtatggtggtgtgtgcctgtagccccagctacttgggaggctgaggtgagagaatcatctgagcttggaaagtcaaggcagcagtgagctgtgattgagcccctgcactccagcctgggcaacagagtgagaccttttctttaaaaaacaaaatcaaaacaaaaaaccaaaaccttcatatattctgtatcataaatatatgtgaattgaaagtcactttaatgtggtcagagtcagagttctaaagttctcaaaattgcaatgttagcatactaatgtagtaggatatgttttgatgttttcgtctagaaatgggaacatcaacttagtgccatatagttatatggttgtatctaggttagccagggttctaaaggaatctagagcttttctagaaattgtggggtcagaaaggatgatgtactaggcttgcttgagtatgaaccaggagagatgcatgtgtgtgtatgtgtgtgtgtgtgtgtgtgtgtgtgtgttttgttttgagagggagtctcacactgtcgccaggctggagttcagtggcacgatctcggctcactgcaacctctgccacctaggttcaagtgaatctcccgcctcagcctcccaagtagctgggactacaggtgcacgccaccaggcccagctagcttttatatttttattagagatggggtttcatcacgttggctgggatgatctcaatctcttgatcttgtgacccgcccaccttggcctttcaaagtgctaggaatataggcatgagccaccacgcccagccaaaagatgcagtaatttcaggtagttctatgatcagtatatagggatgccaccacaactgtttctgaagaacacaattttaataggacctaggtagggaggcttaggattaaaacatgttgaaaatctgtcttcagggactaaatgaagctggaataaataacatggcacacagttgaacatatattggggaaaagggtgatcttggaaggggcactagaagcaattataaattggtgtgaacttatatgtgaacataaataacacaagatgatacattggtaacttgtatcatttacatttggttttgtatcttgagtgtcttgcataataataaagcagatcccagctttaaagagtggagtgtttctgctctatattgaaataactatcagagggcagggaggttaaaatcagaagtaggtacgctccttgcataactcttccatgcgagtggtggcagattaagaaccttctgtagtagaaccattttgttacacattgccaaccacaaaatttcatagagtcaaaaaataaaaataaaaaaagaggtcaatgtggtggcctggactaactgggaaaagctttatggagaatattggattttctctcagtttctgttctgagtaaagtatgaagctgcctttataaagaagcaagttggtgactctgggatttgaatgagtttcccagtcctgttggggtactataataaaatacgttaggctgggtaaattatagtcaacacagaaatttattgttttacagttctagatgatgggaagttcaagatcaaggcaccagcaggtttggtgtctggtaagggcctgtttctcatcaatgataccttttatgtgttctcacatggcccaaaggggcaaacaagctctcttagacccttttataagggcactgtattagtccattttatgttgctgtaaaaaatgcctgagactgggtaatttataaggaaaagaggattgacctggctcacagttctgcaggctgtacaaagaagcatggcaccagcatctgcttctggtgaggcctctggaaacttccagtcatgcagaaggtgaagggagagcaggtgcatcacgtggtgagataaggaacaacagagagggagaaggagagagagtggggaggtcccagactcttttcaacaatcagatctcatgtgaactcattaccatggggaggacaccaggccattcatgagggatctgtccccatgacccagacacctcccactaggccccatctccaacattggagatcatatttcaacatgagatatggaaggaacaaataaccaggcactaaccatattcacctcctagcggccccacctcccattaccactgcactggggactaagtttcaacatatgaattttggggagcataagctttcagaccatattcagcaatgagcatggtttgtgtagaagaagaacttgggcaaagtgaatggcttatgcctcaagttgagcagattagttgcgtagtaagaaaggtgaggggagataagggtgggagagtgatggaacataagggaactaaggtaccacttgggtcagcctagtttctgtgattccgttacattatgggattgagtgtttaatgctcagtgacatctcatagaatgaatcatagggagaccaagtggtgtgcacaggtctacctggtttgggaatcactgagattgttttgctctgctccaagttgcaactgaagacaaatcacattcctggagggaaaggaacatcaagtgactaaaatgcaacagcataaatcctctctcataatagacagcacctgtagccttttgaccctttgttctaaatcttttatagaagagtgtaggatgtagataggaaataaataaaattgcctcctgattttatgtcactatggagctggttgggagtctctttccttttcagagaagccacagagagaaagaagaaaaagcaaaggcaagaccccttctcttacatatcccaatggactttgagtgttagtgttgctttttaatgaaggtggatggcagagagagattttcaatatagcttaaccataaattttcttaagggggttaggtggtgctgtccaatactccagggtgtggtggtggagctggcagaggctacaaaaagcagcaggtgcctataggtctagaaatccccagctcattagaagtgctgtaaatcatagcatccttcatgtctcttgagtgaaacttggcacctccagcttacaactgtgtggtggtcacactgtccctgacttcaataatgttaacagatgacaacttccattgaacgatgaaactgggtgagccagtgccagtaatgatggattgggtggctgaaagtttctgcagagaggacagcaagaggatgccaaggaagctggtctgtgtgtaactaaaagactagtaaatatgagaattgatgggcacatctatcacccatggggccactgtgtcctgaaagaccttgtatgaaagctttgagaaaggctttggcaaggataaatgccccagcgcttagacaagtatgggtctctgcaggccggactggttgaagagggcaacgaggtgaggtttcgtgagttggaagttggcctcctgtagtgtgcagtctgacacagaaaaggttctagctcacagttgcctggttggagcatggaaacagctccagcttaatattcaggacatctgtctgccgaggcctgttttttttctgtacgttttcatggctgtttgtagacagtggtaggtgagattggaagaaataagagacttgaggaaaacagagttaaacaagaaagtaaaagtaactcttcaatacccagtacatggttaatatgtagatacttgaggatcctttatccctcttatgtctcaggagatggggtgctggggttgtggggagggcaggggaggagtaagggaaaaagggaaaagacaaagaagatatcatctatttgagtaaataaaatggagatgtagtaaagatatcattttgggaaccttgagattgataaaaaaaaatacacaacttactagaactttttcagttcaaagctgaatgctaaaaggttgttttgtgtgctgtatgacagacaaatattttaaaatatgtctcacaacattcctttggcttaggtggtgatatttaagttaagacttacatatatcagttggccagtttgacagataggaaattatttggaattaaaaattccccttctagtttttcccctaaaaagtccctgcttaattcatgattgttctctcctttgcctcttctttcctaattctttatcttctcccatatccaaaagaacatctggcaactatctctttagaggcatctatgatcctggattgaatttgttatccagtcagcaccttcgtgagctgtgtttgattttctgaaattgggtttccgcaaatggtcatatttcaaagtgctatgccatataattatttgaagggaaaacattttaacgtggtacaatgacaacgtaaagaatgaaaattgtgctaagtgagttctgtctctttcaagttcaaattggtaggttttcctggcttgaacacaaaatgaagtcaaattgaagggtcagagatacaagaaaattataaggagaacaaactcattagaaagggaactgaaaaatggataacaagaggaacaaatacagggattttccatatctagggaaaaacaatccataggttctatggggactttaaaaatatagaggattgagaaaaaaactttgtattttgcaacaattttaggttaatagaacattcgtaaagatagcaaaaatagttcctatatactctatatccagcttcccctaatgctaacatattacagttttagatttttaatggttatgataaacatgagtctatgatttatagatgtcactacttttttatagtattagaagaaaattagacatataattttctacttgaaaatttatattcttgtttacactttaagaatatgtaatatcttccaaccacattcatatcaagaagaacaaaaacaagcaaacaaaacccctgatcatatcttaaaaaaacagcccttctctgagttatttacatttttagcaggatgcaaaactttatgcccaaattttccaaatttaggtatgttaccatggcattttatcctggaaaattgctttgactggaagtttctttggcaaatctcacttttatttatttattttattttatttagacggcgtcttgctctgtcgccaggctggagtgcagtggcgcgatctcggctcactgcaacctgtctcctgggttcaagcgattctcctgcctcagcctcccgagtagctgggactacaggcatgtgccaccacggccagctaattatcattattattattattattttttgagaccgagtttcactcttgttgtccaggctggagtgcaatggcgtgatcttggctcaccacaacctccgcctcctgggttcaagtgattctcctgcctcagcctcctgagtagctgagattacaggcatgcgccaccatgcccggctaatttttttgtatttttagtagagacagggtttctccatgttggccaggctggtctcgaactccctacctcaggtgatccacccgccttggcctcccaaagtgctgggattacaggcgtgagccaccgcgcccagcccctaatttttgtatttttagtagagacagggtttcaccatgttggccaggatggtctcaatctcttgacctcatcgtgatcctcctgcctcggcctcccaaagtgctgggattataggcatgagccatggcgcccagcccaaatctcactattttttagattaaaatggaactgttgtggggtataatgtaaaatttatgcatttttaaaaagcaagagatagcttaaaatgggactctttggtggtctctggcagtgtgcagactttggtggtatgagttcactctgttttgtctttatagctatagaggttgaaaaaaaaaaaaaccattaccttacactaattgacataaattttggaagcattatttcagcaccaaccaatacaggtttcccatagtccttattggatatcatagaatttttgataaatatttgtgaaatgaagcaatgagtaaaaataaggaatgtcattttgaaatgtggggccttttctgtgtctcctcaaatcccacctgggaagtgctcactcattccaggtaagacaggctttgctgattctgggccttggactggcagggaagaagggactgactaggttaagtatctcctcaaggtgctggaggcctctaaataaaatgaggtacctcccccttcattcctagcctggaagaagactggagcctcgagattacagttatagtctctgcttattatataaaagtaatcatatgctatatatagcccatgatggtataaatgttgtagctgaagggcaactgacaagagaaggcagtggagacttgggaaaaagtgggattttaggtctgagagaccttcaagttctagcctgggctgcaggatagaaccctaggtttggtactttgaccctcggtttggtacttatcctcttgaggccatatttcattatataaaatgggaagtcagtaatctatagtgagagctacatgtaagagtgaatttatcttatgaactaatcattggccttttttgctgtcagatctattccttttctcccacttcattatctgcatggctgaaggttcaacccctgcaggctgatttcctagctctttcccagctgggtttagccaatgagaggcactggcaggagatgggcaggcaagcacagctgctgtgtttgctttgtggctccagcttgtgtaagacaggcccactgtggttccagctttttccatgactctggccctttggtgctggtaataccatcctctccttctgtccctccagccaaggagtggtagtagctacctgcagttgttagcctccgggttgcctctttattctcttttggcttcttagctcttttagcagtgatgtatctaagtcactgtattacattccctctttttagaatgttggagtggttcctatttccctcattggacccttattgatccagtccatttcggtaatctagctgtgagctgcagtacttcaactaggctggttgtgatagaaatagaaaggaaggagagacctgccaaaggagaaagagagcagtaacctattagatggggaaaagatcaggagaaataaagcaattcagataattgtgactgccattgttgaagacaggcctttggaaggggaactggtttgggtgtagaaccaatgggttttgtgtagagcatgtcaaagaagataaacttcatgatttcactgcctttcccacttcagtgtattgcagctgcaggagtatttatggagttgcctttctctcttgggaaagggtaaaaatgttcagaggaaagagatcaggggtagctacacttatgtcagataaaaatagactttacgtcaaaaactacaaaaagaggcaaagaaggtcattacataaggatacagaggttaattcctcaagaagacataacaattgcaaatatgtatgcacccaacatcagaacacctaaatacataggtataataatgtgattcaagtccaatattcacacatttacacataggtgtaaaagtataattcaagtccaatatttattgattttttgtttagatgatctgaacagaaaatcaataagtgttggacttaaattacattttcaaccaaatggacctaacagacatatgcagaatactccatccaacagcagcagaatacaccttcttctcaagtacacatgaaacagtctctaggattgatcacatcttaggcgacaagacaagtcttaacaaaattcagagaggacagcagtgtgtggcccagaagggaatgccccctggtggcttgctaagcctggaacacatctaacaccattgactccagccccatctctgtaacttttttgggagtagaataggaacccattctttgccagttgggcagcagctctttaccaagggaccaagatgagcaggctgttccttttgtcagtgcaacatttgcaagaggagtgctgtgggaggagataaaaattgacttccaaatggccagcaaaatttcagagacatttttgggactggcttttaggttcagacttaataagtaaaacagcagatacttaagattttgatttccctgtgggttaagatagttcatagtggggatggccaacattgctacagcaagctggaatccacttcctcaatgtactggggcattatggaaaataatgatctctgagggagagaaatgattccacatctttgggaacaatatctagatatattaagaaatgacctcagatgaaaaacaaatataaaaacattttggcaaatcagaaggtgcacattatatggcattcatgatgttttatatagtatatgtgtgttgggaaagaaaagaagagtctaataaatgaagacaaacaggaaacccttcctaaactctcttcccaaatacttcttagtcacgttgtacaggtcgaaggttctgggaagaaacagctagtgctctgacctgcattctgcaaatataacgtttcctgttttgtaggaacttggggctgaaaaatgcataaaccaattgatttaaactcttaaacccataatattcacaaacctcaaggactgctggtcaaagcctctctctctctctctctctctctctctctctctctgtgtgtgtgtgtgtctgtgtatgagagagagagaaagagagagagagagagagagagaaagatctattgcagatgttcttggagtattacattacatctaatttccagatagtctccagataactgaataattgattcatgtgaatcttaaatacatcaatattctgtagtttctcaaaccttttattttgttttttttttttcaactctgagtgaattaggtttagttggagaaaaccgtttatgttatgtacttctaaaatatgatgaggtgaagcatgaagcatggttctccttggaatgatgtttacattaataaggctttttatctcacaacgacatagataatataaaattaaaatcaactgctgatctcagggagcaaacagatttttatgataaggattgtatagccacctttacatctttttctttccttttaaataaatgatgaaagctccagtgctgtcataaaatcacatttatttgtagtgatagggatgaaataatcactgtttcatcaccgtgatcagcggtcacatacacacaatggaacctgacatgctggcagcctcagctcattacagctttccaaccaacctccaagcttatggctggaagtcaaatggggtgggcaggttccaagtaggaaagaaaaataattggctttggagataaagggattatttaaatttccatatgaaatttccacaatttcttggcttcaaattgagagggagttacactaagatgcctgtgtttcaattttaaaattaaaagcattcaaagaagtggagaaaattattatagacaacaaccatttcaataacatttctctgtcttcatgttgtttatcacactattaattacctgctaattaaaaacaaaacaactggaaaattctagcaacagaatttttcatcaggaaggcttttggtttaataatttttttcttatccttacaatatcaagttgttcccctcccccccataaggattgattagtttaaaagattggtgtttgatcggaatgcaaacatcagtgggacaaagtgggacttttctggtactatgtagtttttggagaccaaggcctctgagtcagacagacctaggattacatttaagctatctctcctttgagccagatttgaatctcaatttatctttccacttcgtgatcttgggcaggttacttaatctttcaaagcctcagtttcctcatctgcaaaatggtgataatgaaaccaccacgaagacctgttgtgaggggaaaataggatcgtgtgtgtaaagagcttacataacagagagcctagcatatagattcatagtagctgttttttaacaaaattatttttgcactattttcttttgtgactattagcatttggcagtgtgcttaccgcattactaaattttgtcttgatagagcagtccctgagcgatggttgagacctcacagtgtagatagacctgttgaagtgttgggtgttgctgactttgatttgcacccctggacaccacattcagcacctggatagctttagcagcaatggcaaaagatgaattccatttcaatcaacgctatccacaaccttgatttggggtttttgaataaaaatagggttttatgcttgaggatatagcacattttgagctgctgagtgagacttgcacttggcatgtgtgggtgccctggtgaaaactcagggagctttgcatttcattatatttttaataatgcttggcaagtagcagaattaaacttgtgaatcatttgaacaaccacttttcttaatggagatgagcctctttatcttttaggagtcaatactctgtggttctaaattagagtcctcgatgtgattgtattcctctcaaacagtattaagaacttattttataatggagaggttcataatgaaagcagtctggggaacgaggcatcctaggctcttgatggtgctgggttgaaggacaggaggagctggtgaggatgtggccaggacctgttccctggtgtgggggtagtagggaggatactaacctttttttactgtgtactagatgctttgtacacattgtttcatttagtcttctcggtacacctttaaggcaggtattgtcatgcccatttcaaaggtgcagagagatgatttatccaagattacatagtgaatagaaaagcagtaataaaaggaggaaatatcagttttggttacccagtatattttgtgaaaatccatcaagatgtatatttataatttgtgtacttttctgtatatatgctcacttcaataaaaagttacttataaaaacaaacagatctgcctgacaaagtctatgctcttttctatcatactaccaccaaaaaagtatgatgcatggaactccaagtgctttacaaggaatttcctctgtcagtcacagctaggcgtggcgagaaatagtgctactcttattaactagacctgattttgaaagacttgaatatttccaagggaagatacacttagagaagtatagtttcctaaaactgcagatgtctatgtgttagacttagaagattattccaaaatcgtgttctgaaaatgcatttagcttgttgcagagttgttcatagtaatgtaaaattggaaaaaaatagaaatatccatcaaagagggattcaacaaataaatactatgtgacttaaaacttacctattttgaatgatgcctctgatatagtgtggagtgaaaactggttttcgaactgcagatatagtatgatggtatttttgtagttgttttttctttatgtaacatattcatataaataaatggctggaaagatatttgccaaaatattaatagtgatacctctgcatttttgtgatactggttgaattttactttccattttatgtccttctgtatggttggttttatatagacattgctttcctacaattctataaataaaattttaatttttaataaaacagtacctttaatcaaaggctgcatcccaaattaaatatatcccttctcaaggtgtctactgtaaaggaggaagaattcattttagtgtatgagtttcgatacatcaaaataatattaaattatagtcaaatcatagaaaagaattttcaggaataaaaagtgccatttaataagatcaaatacatgcaattaccagactgcttggcttctgtaaacatttttaaaaaatcattttgagggatatagtttataaaagtaacaattataataaacaattttaattatattaataaatataattaagaactactttaattatattctatataagcaagttgctctatctacctgtaccagatatcatagcaatctaaaagatagctgttttacttatccaaatatgtgtcttatatagataggtcagtttcaaaaattctccgttctttttagattttagtataaagacatatgattgctttattttattttattctatttcattccattttagcgattccttcaatcaggctgaagacagaattaaaattatgcacattaaatactcatgcaaaaacagattatagagcaggatatgactttcatttttgtctttttcttaaagatttccaaggaactaacctaagagaatcctgagtacatcttactgtgggtgtcattgatatatactgtttcattgcctataacccccaacaggaatcatgagctctagctgagttcatataattactaccccctgaacacttagcagtcctgccatttgctccttctggataagcaggttccctattctggctactctcctgtattcttgtgtgactttatccatcagagaccaactcaagcttttggggcatagccaacgctcccctccaaatgtgtatacctatgaaaagggacaacatgacctgacaaaattctctttctgatttgtgagttgatacatatgaaaagtcttagagcatataaaaagaaatcaaatatttaaatttgatgtatctcattattaaaaaatatatgaagaatcaggatgttattatctggaaacatctgtttggtttctgtatagtaccagtaaagttgatttttatattgtatgttttacatactttgaggtagaaaattatctttaggttaactatgcctgacagacatcatctcttttacttaggcaaggcatttcatttgtggaggaagaagtactttgcttgacagagaagaagagaccgcgaggagcctggtgtagttggaagaaagtagttttggcactgagggacgagaaagctgagagaggatgggagagtgggttcagccaagctagccccctgcctcctctacccaggacacacacactcagaattttaagtacaatcatggagtttaattatgtgtggatttctcaggaaattgggaaaggttctgaattctctgttttgcaagcagggaaacctttgagaatagaggtagcccaggcaaacagagtaggaaagagatggcattttttgttgcaggaattccgtcgatgcacggggacagaggggctttgcgctgtcttgggctgtggaattggagacaggccatgtttaaactgatctctaaaggtgtcaggttggcagggcagcgcaaggttatctggctgcatgaggttatctgactgcacatactgttatgggcctgggatgtcccctccctgtgtacaaatgcaggagccacaggtgctgctgacagctcacaagcttctgataccctactgaattcgagtcctttgaaaaagaccactagttggctcttctcacttctttttcattaaaaatgaagaaatcagaaacgaccattcacttaaaatgtggagaaacaaaacctttgatagtctgtccattcatttcctgccatcttcaccgctgaaaagtgtactaactttaagtgactacggtaatgggcagtggaacccaattcaaaattcagcagaaaatttatgatctaattttgatagagatatgtgaattatcagtgagttgaagttgtctctgtgttaagtcattacagatgttaaatttagcaaagacatataaactcctgggtgtggagagtgctgaatgttgtagtgttaaacacaaatgtactgcttgttgaattggtctcagatgaattttcctgctgagctgacacagtacctctggccgagttggaacatttcagtcctacagttcaccatcgtgctgtcaatttgtccatgaagatagtttatgggaatgcattgacacacatgtacatgctgttggaatcttgatggatttctttctttccttcctttccactgccccaaacttttctatagaactttttgattagcatagttcaaatttatgttttgaaaataattaggttcaattaatcagagctttctacctttatatcactgtttgtttaaagaaataatgttgattttttttgttataaaatagtggtagatgtcatcccttgaggtgacttgaaaaatgccaccttcctttaaagtaccattaagtaaaatgaacataaggaatgttaatcggattgtctcaggatcaatgcactgatattgatgtgttaaatattgtggttattagctgaaagtatttattaaccctaataagccagcaactctatggaactttctatttaacttttctcataagctactttgggggtaaacaaatcccaattggaagtaaggactgcaaatcaacccagccaagtgtaatgattagcaatggaaatatcccattgtggaattctagttccatatgctcgtgaaaaaaagattacagataattataattaggaactcagtgtgtgggagtgaaagtaatgattactgaaagccactgatcatggtgggagtaggggtgtgttataaagatgtgaacattttatctaaaacgtgcactctgttaattagtaactttcaatacatttatatcttaccgatacaatttctattgtttcttgaacactaggaaatgcttgaggtgtgaatattgttttccagtgtgatttgtactacctacacattataaagggatgttaaccgttcgaatcctctttaacggcccccagcagtgaaggagggtgggcagggagaggaacagctgttgcctaagaggggaaggaagggagggaaggggaactagagaagctggcttcattggtatatgatctgggataatgggaagcactgatttaggaattatcaaatcattcctccattgcaaatgtatcgtcattattattattattattttgagacaagtctcgctctgtcgcccaggctggagtgcaatggcaccatctcggtttactgcaacttccacctcccgggttcaagcaattcttctgcctcagcctcctgagtagctgggattacaggcatgtgccaccacacctggctaattttttgtatgtttagtagagatggggtttcaccgtgtcagccaggatggtctcgaactcctgacctcatgatctgcctgcctcagcctcccaaagtgctgggattacaggtgtgagccactgagcctggctgcaaatgtattataagggtcaataggtacgttgattcttactttttcctccatacacattacacaatactgagaagaaatgtattccatcctgtctagcacggcagtggttggactttaataaatgacggctcccttcctcttcatctgagtacattgaactgctacaattcattagtcagaaatttgaattgtttaggacatggtaagattctggagcctaattccaggaaataaagtgaaattcaaaggaagccccagactgctccaaatctgcccttcaaattatttgtctcatttacacgttatttttttgaaatggcaaagattatcctttctgataaattttgtgcattaaaagacaagttttatctattctaggggagctccaaatttatacaagacaattgtgataaattttttcttaaaggaagaaatcctttattatgcaaataaagcttctttattaacttctgtatatttgaatggaggttggacttttctcagttacctacaatttatacgtaactcaattatatatacttctctagaactgcttatgtaaaataatatttcttaacacatttaaagtggtgactccctattatattgcaatacccttcctctttttttctgaactaacaatggaattaaaattcaagtgctgaaaaaacacggtttcagtatccttatattcttaacatggagccatcatataattaaatgcaatgtctagtttttttcataagtgtatgaagttgaatattctgatttggtgcagtgttttcaaattttcctgaccataagaatcacttgggggtgagcctagggtatcatttgttaaaaaaaataaattcctggcctcccccctttaacctactgaatcagatgtgtagaacctgggaatatactaagtcaatgagctatctcaggtgattcttataatcaggtaagtttgggaccaatgatgtaatgcagtaaaacttaagggtgtatcagaatcacccttgtcttattaaaacccaaaatttctgaaccccacccccagatccagtgggtgtagagtctgaaagtctgcaatttttaacaaggtccttggtgatgctgttgctggcagtccaaagatcacactgtggggaccactgatgtagtggaaagaatgtagtcttgagatgagacacatctgggttccagtctcatttaatagctggaaattttttagtatagttacttaatactatactaagtacttaatactatactttactgagttttttcctctttattttcaattttttaaaatatccttaaataaatttatacactcatacatatatattatgcttgggtttaaatgctaccttgaataaatatggagcacagatggaaaccgagaagaaggaggcagaaatgagagcaaggaggaggctgataagtaggttcaagggagagtgagtggtctgcacagtaataactgtgtcctagaataaccagaacccagcaaaacaacataatcagaagcaaactcaaagtgaatgtattaaaagtcaagctaactgtttactttgcaaggagaagagaaaggtcacttggctgtacaagtatgatagcattgattaatttgaatgctttgtctgaatcattactgttgagattctgaaagttcagatactgaaaagaggaaaataatgttgacatggagaaaccaatcatgtgagagctgtttttcatgtcagtgaggataaaatgattgctacctgctctttttacacacatgactaatgacatatttgtaaacttagttttctaagaaagaaacatagccatcatatttagggttcataccattatttaaatttgtatactgtgttccatcagcttttcatgggaagtatttttatcctctctgatgatttgaaatagaaaagccaatttgggtgtaaaatccaatgttcaggcagaagccttatgtggagatagtgttcccacagaattgaactcctggagtactggttaagagcaagtactccaggagtcagatatctgggttccaatcttgctttcacctcttagggcccgttctgttgccataggaatgttcaataagctagtaatcattatagtacatagctatgggatttctacaaacttttattcaacaagtatttattgactgcttgagaggtgccaggcatggtggcaggtactggggatatccactctcagggagctctgggagacaggcaagaaacctgtgaataagaaagttcatataataatagtaggtgttaaggatggagcaattaacaaaactaaaacataagtccctagtcctccaagttccattatagtgccttatatcctagtttgtttaccttccataagctcatcaaaagtcaaatgtgacttagatttactgactaggttactattttattcatcagattgagctccttaattcgggaatttaacagaggttagtttgcaacttaaaaaaatcttcatttctatcctgtcttaggcattaatagattttgtccatattaccagtgcaaataacagtgaactttatgtttttattctctatttgatatgcttgtaatttaaggcttagccacaattaaaatgttcactttataatctattagaaattctatataatttaataattttcattttgttgaggtcaaatttaactacaaaatctaggaagctattgattcccactaaccgcaccattgttatagtcttagtatgtttgaaaatttaagtaaaatttgtttccagggccaaaaggagagtactattttagttttgtggaactttgccaaaattgtattaattattaactgtgattcatttatgactgtacttcttctataggattttaactaatttaaagcaaagactgaatgaaagtctttatgttttgcagacaagagagcacccatttatcctcagcaaatgaattgttggagcaaataatttcagtggaccgtttggtatagggaagcttatggagacagaagcttgtggagacagaaaattcaagggattaggatttttgaaatacagaataagactgaggggcagctaagatttatgtagtcttcaagaacatagactatgcaaatacacaaacctacattctgtagactgcattgtagggaataatggacacactcaacatcctctaagattaggatagagagaaaagctccactctatttgaaggaagggaaatttttagcaaatcagaataatattaatctaagtttttcattttctttggtggtagtcctttctggattggtttagttgccaccttgccagaatactttaggaaacttctttaaaaaaacttctttagtccaaggggtactctcaatccaggatgagtaaggctttcaactttccagaccaaataaataagtcagaaagcttttcaagtctaaataacttaattcttcttacagaattctctccaccaattgcttgataaatgtcaattcaatgaaatgacatgcacattcagaatcatggtaaatttttgttttccatatccttcagaatcattttttaaactttcccaaatctttggcttatcaatgatgcattattctgtcaccctattaatgtatgtttcctttgtcattcataaaacggttgtattgtttggccttatggaaggatgttgattaagtgcctgtgaatgtttgctttattggcattgagaaagaagagaaaatgatttgttttgccaacaatgaattattgcatctgtttgtggctgttaaataatttaatagaacttaaagggcctattttcccttgattaaactacaggaaaatatcagtctctgcctcaccttggatacaaagttagatgtaaaacatgtttttaatttgccttttgccagtttaggtgttgataagacactgagggatttttatattatgccatttttacatttaagttgaatatctctttaagcttgagacaaggaaaaagtgttatgaacaattttatttctaaatagcttgttcacttttattatataatattagtaatcgtgtcaaattcctaattataccaaatatcaagggttacaaattattattactgaaaatttcaaggaatataatttatttagtggaaatcctgagattaccaataccactattttccctctcctttgttagcttttctcctaaccaagctcaaaatgttctgcactttcaaaggtcactgctaagtactcttctctttttattctgccttctttccttaagttatctcattcagccccatgattttgaaaaccactaataacctgacagttcctaaatcccaaatttttaccttgaactcagggtttatcttaggatctagttccttatttacaattgtattcttaatactctagagccacttacaaatctgttccttctatagacttctctgtttctacaagcagctcctccagcctctcagttgcccaaaccagagatctggggatccctctctccctctccccattgctcccaacccagttcatcagtagctcctcaaataaatccacttttctcttgttctcaccttagttcagtatactgggaactctcttgcaatcaccaagtggttactccattaatttgtatctccaaatccattctctagcagctagatatattttttcttttgaaaatgtaagaactttcacttctttgccttaaaacctccatagaataaattccagatttataaaaaatggcttttacagccccctgccacagcttcatttcatttcctccctcctctcctatgcatttgctgtaggggcctgtgttagtggagtctcctcaggatcttcccgtgctgtttcttctgcatggaatatttttcccacactatttgcctggcaatttgcctagcttgtgttagttcctcaggggatgcgtagtaccccactccagtctaaattagttcccctctacctaaaatactccatattttctttcagagcagttcttatcattttaaattacatgtttgtgtgattatcctttaatatatctttctcctacaggtgccattacagtatatgcactatatatccagctcagtgcttgacactaaattgggactccataaatatatgttgaagaacttcaaatattccaaaatatgaagaattttccataccatgtcctcttttttgtggccctctttttttttttttttttagagacggagttttgctcttgtcacccaggctggagagaaatggctcaatctcggctcactgcaacctcccctcccggattcaagtgattctcctgcctcagcctcctgagtagctgggattataagtgtgcaccaccacactcagctaatttttgtatttttagtagagacagggtctcaccatgttggccaggctggtctcgaactcctaacctcaggtgatccacccgcctcggcctcccaaagtgttgggattacaggcatgagccaccgcacctggcctttgtggccctctttttgagcggcatttttgccaagtaatatagcactgttgggaagagataattagtgtaagtaacagttcttttttttcaacattcagtgagggaaaatatcaataatggtaaaacttgtattccttcccgtagtgaagggtgagaaaatacacttggaactagaaaagcatagtagtaaaatgtagaggtagtataaacttaaaggaaaaaaatttcaccaggactagaaatacctgggtttggcatctgactctgccactgatttatgtttttggcatgttgttcagtctcctgtgtcttgcattttctcatctcaaatcttcagagatgtcaacagaaaacaaatgtggaaaccctttgaaaaaattaaaacttcttagaaaggtgagatgctcttaccctccttattttgattttcatttttgaacacaaagtggttttacttggaggttcttaaagtaataatgaacacagtcattctcatagataagactagctgtcactttctctcaattcatgcaagtgttattaagaaaccacctagggatgataatatgaaattaagtgtagtgaattcattatggattgcctttctcattttttacaaggtttcctgatagcaaagctaataaagtataaatatgttgaggtgtcaagtattttttttaaagagattaattagagctcagtccctaagctatttgtaaattactatactttttcattgtaaagtgtttagtggaaatgctgttttaataaaatgattatagattataaatggtttcattaagtactttatttccctgtcactataccagttctacagaaataaatgactttaacgttctttttgctgataatttaaatgagatctaaaagatgaaacattattttgaaacaaatttaatttaattgaccctgcatggcttggaatctttgctgcccatgatccttttatgattaaatactaaagaagaaagtgtaatgtgaatatttttcttttatttctacatcatgggattcacacttcctgaggtgaaatatcttattcttttcagataatattagtagatgtattagaaatttatcctctcaggggttgtgctggtcagtttcatcaacaaatggaattcaagatcccttagtaaaacgaatgaacttatgtaacaaccacaccctacacacaattcaaatgtgtgttaaatatctttgtgttcagacaaattgatagcctagagatcagtatgtgctagcttatagtcctgcaaacaagtgtgatgtttattccatttaaaaattgccactgaggcgggcttacgcctataatcccagcactttgggaggccgaggtggacggatcatctgaggtcaggagttcaagaccagcctgaacaacatggagaaaccccatctctaataaaaatacaaaaaattagccaggcgtggtggcaggcgcagtggcaggcacctgtagtcccagctactcaggaggctgaggcaggagaatggcgtgaacccaggaggcggaggttgcagtgagctgaggttgcaccactgtactccagcctgggcgacagagtgagactctgtctcaaataaaataaaataaaataaaaataaaaaaataaaaaaaattgcctagataagcaaacataactactcaaatttcataagattttgtaaacttctctcagtgccaagaaagtaagccacctggcagtttttttttttttttaaagtgaaccaacacacaaggatatgcaccagagctgggcacggtggttcatgcctgtaatcccagcactttgggagactgaggcgggaggatcacttgagcccaggagtttgaaaacagcttggacaacatggcaagaacctgtctctacagagataaagaaacagcctggagtggtgatgcatgcctatactctcagccacttgggaggctgaggcgagaggattgcttgagcccaggatttcacggctgcagtaagccatgatcccaccattgcactccagcctgagtgacagagcaagaccctgaccaaaataaaaaatatgcactagaattgagtgttaatatttcacctgaatttggctcagatttacatgggctatgagagcattttttattttagttaccatttcttattacttataattatattctcattctgcagatattctcaggaggcaataagcctggtggtaattgagcagatttagttttttgaaaaaatatattgacaactatatttttcctgagagtgtaaaaatgattcagaaaatatctgctattttaagtaacattttgagtgtaatattgcattcattagttgaatgtcctgagatttcacatgttaaatgtagagttaagtacaattagtagaagagtattttaagtggcagagatgggcagaaattattttgtggagtgagattagttgagttcagataaggaccctctattaaagaagaaataaaggaatgtggattagaagacaatgaaagactttttggtgaactaatgtatactttctgaagatttgggagtgtgttgcggggcggaatgcaaaggcaaatttgtagttacatatctagacatgaaaatagagggataggccaagttcacctgatggagagcttttaaggctacattctatatttgatgattgtggttgaaattttataattattaatagtatgtatgctctgaaaggtaaaagaccttgtaacctatatgtaattcttactgagcccaatactttgggatatacttaaatcctaattcaatatagcagatttgaatcttattatcagtggagtgcatttaattgaaatcaaattgatttaaacatctagtaaggaattctcaagtttaaccttcttttccacctctgggtacattcatatgcttacatctactctcaaaccttagaggtagaaaaaatttgatttaagagaagatacacattttcattcaaattgattgtttaaatatttataagactaattttccagatacattataaaactgaattgtgctttggacattcttttcaccacagctaactaatattattagttctaaaatgtaagatactaaaataatttccaaatcagaggtctgacatgatatttaagggctatttttacatattgtattagaagtgcattgaccattctcaagaataataaatatttcaaatattgtatttaactaaaataacaccagtgtaattattttaataaaaataatttcaaaagagcccttgaactcctgggctctttgaaattttaaccgttctacttatgactcaaaaaagcttaaaaaagatggatgtcattaatctctacaaagtgtatctattgttctgataattcatgaggtaattataggactaatgctttctaattgtctttaatgtgcaaatatctttaatatgttttctcatagtatatgctaatatatgttaattttaaataatttgagcaatacagagaaagaaaattccataattttgctccctttttctagagataaccactatcaccaattggaatatattcttccagacttgtcataggtaaatggtaagctctcaagctctcatattatactataagtactcttctgttatctgctttttaagtatgcacacacacacacacacacacacacacacacacacacaatgcattttaagatttataggtctgcatcacccattatatgggctgtataggatcctgttacatgtaatgtaccataatttattttgccagtccttggaatggatgtttagtttattagtttatacttactttttaaaatatcagcagcatggcagtgaaccacctcttacttatatctttgctcatttactcaagtatttccttcagatttctttaaattcctaaaaattaaattgctggatcaaagtagatgcatctttaatgttttaaaatatattattacattaccttccagaaaagttgtacaagtttatattcaatgtactgttgtacaaaaatttccatttccctacctttagtaatctgataggtaaaaatagtcattttatttgtctatacctttgtaaacatatatatatacataatgtataattatttgggcatctttttatatattctctaaacagttatataattttgtgaatttgtcttttccaaaatttgtttgtgaacaatttttataaattaagaaacacatagcaaatatttccagtttcaattttttaaaaaatatcaatacagttttaagtttctatatggtcaaatctatcaatcttttcctctatgctttctggtcttaatatatttgttaagaaaaggtcttcttcacccaaaactatacaaatatactcttatagtttttcctagcatttctgtgttttatttaatctttaatctatttaaaattattttttgtctgacatgaagcagaaatctagcttttttgttcaaatgaatactcaattcgttaacactaataattgaataatgtattgtttcctttgttatttaaaatgcctcttacaactgcatccattgaaactatcccattgggcttttcattacaatttgattgtatttgtctgctaattagtgaagaatttgaattttgccagtagtatgtttttggtaatttttaacatttttatttatttaatttttccttttaactttaagtgaaataaaattatataagttttgcacatatcttgttaagtttattcttgacttgtttataatcttaattactgatttgaatgggattcctctcacccccattcacccctgccattatgtttagaaacaggttggcatataaggcagctattaatttttctatatttatattatattttgccactatcacttttactggttttaataagtttttcatttgatcttttgggattttctcggtaaatagttatattttctgcaagtaataatgatctgtcactttctttacaatattttacgcttaatttcttatctttatcttattgctttggcttaactatccaaaattatattaaaatataaagtaaataaatagtgggcttttttgttttgtttgctttttgattttcatgagaatgcgtctaaatcttcagcagttggtaaaatgttttctctaggattctgaaatggttttgattatgttaaggaagttttcttctcttctcagtttactgagttttgttgtgaattgatactgtattttgtcagatgtctttggggtagtttcagttatgaacaattgtttttctcttttaaccaatttacttattgaattacattgatggactgtctcatgttgactcattcctacattcctggaataaatctgactttttgaagaatatatttctttaatacattgccatatcttacttattttcataaaaagatctataattcacttctctggaattttatcagattgtggtctatgttttacaaagtactttagcatgctttatttccttttttccttgacacagccctatgaatcaggctaggaattatatttttttgacaaataaaaattatagacatagaaatttgctttgcaaaaagtcatgcaagtaggtggtaatggtgagtaaaatttattaatctctaatccaatactttggtttggagagaaggaatttaattagttcagtaatttctatcagtacgatatttatggactttgagttttattatctcaaataaaaactatgcttatgtagttttcttttacatttttctaagttgagagaatgaatttgtttccattttgaccatggaggcttcactgggtatgaatgggggtgagggagagttcaccctaaaggagtccctgagctgagaatattcattctctgatatctgccatctgttccttgaacatgagcagatgctgatgttcagttaatcagaggtaatgcaataaggattaaagtgttagatagttctaacccattccggaagttatgggtaaaacttaaaacctttaatcagattcatcttgacgttgaaaccaagttggctatttgagccaaaggttctgtatctctatgatagctagtcccaaaggacatattctattattgtcattaagagaaaacatattaaggatgtgtttgcacacagcattgggtcaagataattgacattgtattttatatgtggttcagagatctgtcttatggaaaactcagagattgctttaaggggtttgttgcaaaagaaatattcaattaggcagtttaaaataatttaaatgtcagttttacaatacagacttaatacaaatgcaagaaggagtccatttgttgatatatacaccaatttattaaatggtagaatagacttctccaaatctagagaaagatcagtttagactattaatgtattatttcttaagtttgaatagaattaggttttttaaaaattgaaattgaaatttagtctccttgtcccaagtgacatacatttataaaatgtttttaaaaagtaaattcactgtttttaaatcttctacagaatattttttgtaatgaaaaacctacatgtatatattactgtacagtacaatagaactgatttcatttctaagaaataccactagtcgttatatattttatgtcattgagttgaatttgtaagtgatgcatataacctggagttttgtccttaccaaatattgcatagaaaaccataaattcctggaaattgactatttttcaaactatctcattaatgaaaatttatgctctgaagaaaggctaattatgtctcttatttccacttaagctggtataactgtaaatgattttcttatttttataaatcacatctgttctaaaacttagctccaataacactctatgataataaatggcaaaactcacataatattgaagcacattgggtatttccttttcagttttaaatatgcttaattcaaatttagatgattaaagaatatatttggactccaaagtgactaaaatcaatgaaaataatatattggtgtgtcatagttgggggtaaatattaccattaaaaactgaaaagtcgagaatggtgtgaacctgggaggcggagcttgcagtgagccgagatcgagccactgcactccagcctgagcgacagagcgagactccgtctcaaaaacaaacaacaaacaaacaaaaaaacccctgaaaagtcgcaaggaaggaaaaacgattctgtgaactcactacataggacacaaagagaggtgggaaattttgtcaggaatgttcgtgacatgaactctatttaataatgtcttattcccgttgatattttaatttttcagataaagtattttaagtaaatgtgcaacattaattagaataaaatataaaagtatgcgtctatttgaaggcctacctaattacatataattttctgatgaatgccctaattaagcatcaagttatatgtttatacctgtgaaataattggagcattacatttaatctttataacaatacattgaaagagaagtattagccatgtaggtattaaaggtatacatttagctagacttcatcattgactttccttttaaagggacatgacatcctgttttccatcaagagaacatcgaattaatcctcacaccagaaacaacagtcagtgctggcataagctccgccaggattcctgggccctgctgtgcaggggtctcctgaggaaggacagaatcgtatctcggtctccaagcccacttggttcttggcacttctgctaagagttgcgcaggctacctattaattttaaatgtattgtttttgaggatgaggcagacatctgtcttagagggacaggactgatagccgcaagtcgttcctcagaggctgctgaataaatcgtcagatgacctttattgttgtcaccctcattttgttcaaattgacgcagctaaagcacagtattaacaaaactacgcattgcatgcagcagtgggattagtgaaaaggaccatgttgttgactagagaaatggaagttcacgtatctcataactgcgtacgaagcagtggactgggaaggatacaagaggagaatgacaagattaaaataagagacaaggcctttacatgaaagcagctgacactacaaaggacgtagtacttctgtttaataggcctcatcagccttttatgctcccttgtgggcttggctcatgaacatctttaatgttatttaaagctgtttttattgtttatttagaaacattctttatacattttgctctaattattaaatttgatgatctttgttcttatttactgatttaattagctacaaacattcatacattaaaatttattccggacaacattagtgttgggattaatgattttttaaagaacaaatcacttgtacaatgcatagcccagagtaggggctcagtcaatctttgtgtaaatggaagttgtatttgaaataatccattggatgtgtataataagaatcattcttgcagaaaaaccctaactggatggaaactatacagaagaagagcttgagataatcacttttatttagattgtcccttcttaatgagttctaatgagcaaatgattgcagtgaggtacagcacagtggaagcttcttctgtttacaaaaacaaatcaatggtactaactacccactctgaaatggactcttttttttttctcagcactctatcactagctttgcctgtagaacatcaattatttttgcttccaagtgaagagagtcatttcagagaagatgtgtaaaatttagagggtcactggctgcccatattttaattagtatcccatccccaccacagcgtatatatcagtgtgggtttcctaaaggagatggctttagtgcgttttattaaatgaatcaccttttataaataaaatttaatggtaaattcagacatagaacttaatttggctagagaaacttgcatgcatacacttagcattgcctttaattaattctgttgacttagaagatggtgtagacaataaatgctttttttattgatcataaaataactgttcagatccttaccaataagggacccactagggaaggccagtggtttacttgggttatgcttcagctacttctcaatagtggccattaggacctccactcccactgcatcacagtgaccctgggtaagtcacatggtattaaccataaataagtgcatcacctgtttgtgtctctgcattaagtaactggagttgaccatgggaataaaacttgggaaaatttaacgtgaaattaatggtataattctatagttgcagacttcccttttctgaaacttgaaggcaacagatacagtgatgatcccatctctcccaccatcttgaattttgtgtgaactgttaggccttgtgtatgggtaagggttttctccagaacacttaactgccaaacatggatgtgattttgagcataggcccattggaaaggcaaaatgtatgcatcagaactgaattccattctgtgatcacaatccaggttagtggagccaacatttttgaggatagccctctcctggatttattactctctgcctctgcctgttattcggtctcatttggggccactttatctcacttagtatatggtagtagccatcctggctgtctttcccactgaaggacttttgttccttccctggaaccctttactctcagtcttgtcatggcagcagtttgggtctcatttcgttctctatcctaggcatcttaaaaggaacaccatcatggcacatgtatacatatgtaacaaacctgcacgttgtgcacatgtaccctaaaacttaaagtataataataaaaaataataataatttaaaaaaaaaggaacataagacattctcttgcccaagttagcagtaactgcttaactgctgaattcagtaagcttatcttcagatcttaatttccaacacgctttccttttagtcttggcttctgtggaagctcattctcctggttttcttacccctcagctcttcttttcttttaggtcttctctcctgcccagcctctaaatactggtgttcctctgggtttagctcatctctaactgcttttatttaataggtgactgtactatgctcaaggttctatttatccctttacgggtataacttccaacactgaaactgcagcccagacttctccctggaggtttgactcatatatccaactttccattgggcaacttcacctagatggcccatagtcatgtaaaatccaccatggcccaaagtaaacttagtttccacttcaacttcacttcccctgatatttcatacctcatttagtaatatttccattcacttctcactcaaaccaaaaacctagaagtcatcctttactcagtcaagaagttgttttacctcatgtttcttgatatttcccactcttcttcatcctttttattaggaacctacctaatcccttcatcctttttattaggaatcctttttattaggataccttcctaatctacctaataccttcatcctttttattaggaatctagctcaggccatcactatctctttattgtaatgctgaatgaaatagtcatctaatgtaccatcttcagttttgtccgtatcaaatccctttagcacatatgcagagtgatatatctaagataaaaatgaaaccttatcagtttcctccaaactctgtaatgtgctagactttgtcacagagtaggtacctattcttgtttgtcaaatgaataaatgaagaataagaccagaggcttctcagtatccaaggttggagttatctggattctagattgtatattgtctaccatcctttgagaatgtcatgtatcaaccaaatttttgtttctcagttttgcttggaacttcacaaaaccagaatgaatagcatatttttatagtgtataggttgtatatatgaacagatagggtctgtatggtgaaaatcaaacctatgtgcctatatgcttatcttttagtataatctattaaatttttattaataatttcttaagagaacttttcaaatataaatctttccctcccttacactatgtagctggagttcagtgttatgaaacaaagattccttctcatcacagtttgacaactggtgttttgatttctagtctttagagttgtgtaaatttgttctaacaaagaatcattttagaactgtttgcttaaaaaaaacttgccaaaacaccaaaaagtatatgtgatgatataattagatatttaaatatgctcatgaggtcaaaggcagggaagcttgggcttggtatttcctttactcacttttaaatttttgtacaatgcttcagtgtgcattttttccctgtgtgttaaaatatacataacataaaagttacaatttaaccatttttaagtgtgtaagtacacttaagtacataaccatttctaagtgtataagcattaggtagattcacattttttgtgcaatttcagtatactttttcctgaatttatattgaaataatttgatattttcatgattgagatccaaaacttgtattgaataagtagagttttctgggggcttatcaatgtgttttgaagaaaaatgatttttttttaaattttgattaaggagcttgcattatatccaatcttattgggcttagggagagcaaatgtcaatgggaatttatggaaacatgtttattaatttggcttatctgaactttgtttccaattttagtttaataaaattattaaatattttaatacaattattaaaaatattaaatatttaggaagctgaaaatattttgctgttgtgacgagtctcatttaatcatgattggtatcctattcctaacagtagtagataagcaacagtgttgtagaaaataatttaaaaattaaaaagacatttggccattttccccttgtattttgaaatgatttctgagtttagaaatcagacattatagcataagattagatagaaattatctttatgatataaatgtaatagaaacagtgctcatagataaatcaatcttgtgttgttttaacaaaaaagtatttgtctattgctttactagttcatgagactcttcttgattctgatgattgaatcctttataagatattgaataatttcaaaagacagtagatccaaaatgtgaaatattatttagagatgttcagagaccatataaacccaattttgttaattttttttaatttaacttatttaaatgtgattcctttcttgagaaatgataatttggagacttatgcatagaatattaggaagtagaaaggattgaattcaatgtctgactaattattggactcaactacaatatgaggttaagctttaatttaggggacagaggcatgacaatgcactatttatcttaataaatttaaagcgtttgttgtaagctgctcaaagagagactttggttgtggggcaggagttgggtggaaggggtattggtacttcagcctcttgccttcattctcatgtgaggagagttagctttgaaataagctgaaagaccttgtagtttataaaaatctcctggaaagatgttatggtcattggaatcagttcagtcatctaatgagctacacattggctggagcacacctgaactgataataaacttggtttcttttggaaagtgccaaaagtacccatcttcccaatacatacataacataaaatttaccatttaaccatttttaagtgtatagttgaattgtgttaagagagaattgactctcattcaatcatcatcatcataattatgttttgtatttaccaagaaggaaaactgatactcaaccttcaactttttctagtctgtttaccttaatattcctactttctcaccatcaatctgccaagatcttcttgagggaatacagatgtaggggtgtaggactctggtggtggtgaagcttagaaggagatttggagtcgtccacccttcagtccgctgaggcaccatttccatctcccctcctcccaacctgtcagagccaatagcatggctactgaaagaacagcgtgattgctctctgaatccagacattgtcctttcctatgacagacctggagaaatatcagacaactgaaccttttccagcgtattttgaatgtacgtaatcttggctgtagtcatcagcagacaagataattattcgttcacacatgctctggccaagttttagctcatttggagacttgtaatgactttggattctgtcctttgtaaaatgacaacctaagaatcatgtctttttactggttccaagttttaggtgggattttgatataagttttataatcatgtaggaattgtgggtcaaagcaagaaataagcattatgggcaggtggattcttttgcaggctagatgtaaaacatgtatttcttgaaggcttggcattctaggagggaatgtcttgatttaaggagatatggcagagaagagccttgtaagagaaagctattctgacatgagtggttttgttcttacaaataaacagtgactcaagtcagtagcagggcgatagactgtggagaacgctagcataatatcatacttggggtataggaaccatatacattcatttagagtagcattaatttcccatttaatatttgttagaaactattagagattttatcactctgctgacaacaattctatttggaacatgagctgcttatataaaaatcatttttaatgtgaaagctctcattagcttaaaaggcaaatgaaatggttagctttaaaagctgagtcacagtctcatttaccatcagaattcacagttttcttctttattttaattagtagattaatcctgtctcagcaatgccattaggtgcctgccttgatggtgtggaaaaatacacacaaacatctgatatttctgagcatttgggttgtgacaaatttaaatgtgttctaatagatcatctgtgtataaatagcttaagatttatagatgttttttaacttaaggatgaggaaactgaccactataggataattaaaaacagcaactctttgtaaatgcaggagctaagttgtcaaatgccagggcaccaacaggcaatattctgtaatctaaattgggtaatttatatcattgtcacttgaagatctgatataaattggagtcactgaatcatcccaccaacatctcataactaaagcaaattttgtttccttttcatgggtagggttttagtcaattgaataataaattatcctgtcttttctgaatcataggataggcaagcttctgtaggcagaactgatgaaatgaggccccaaagaagatattttaccctgttttaaaatatttccaatgaaggatatggtccagactactttggttatacttttcaatatttgaaatagtaatcttatgtggttgtttgaaaaatattttcaatttatcaccgaagatttgtctgaaatgttcggaagtcaggaatgaattaacttctatataacacccaatatcctggtcagtacctactcatagtcctacagttactgggtgtaaaaggcaatgctcctcttcctttgaaaagcataacctttcaagcgcttacagtttataaagaacagtcacgcacattttctcttttcagtctcacaatgacactatgttatatgaaaagattattaattcctatcagaaattaagattgagagaggttaagtgactcactcaaggtgatatatttagggagtggaataattacaactcaagaacatggtggcacgttcctgtaatcccagctactcgggaggctgaggcaggagaatcgcttgaactcgggaggcggaggttgcattgcactgaaatcacgccactgcactccagcctgggcaacagagcgagattctgtcaaaaaaaaaaaagttatttttgctccaaggacaaggtactttgcactctacattttgctgactctttggcatgccctataaaattgggcatggtaaacatgcattacgactcttttggaaaatttgttcctggggcaatcacgtgaattgggatgtggttgggagcatcattaattgagtctgtggtcagaacagagactagtataaagaaatacccagtgtaagtggcatcagtcagatattcagtgtaaatgaattgggaatgatagacacagtgaacggtccaagactgaaatgaaatctatcatctcatgagtattcaggggactggaactatattttaggaaggacgataggtgagaaggcctagatacaatcaagaaggaaacagcctcaaaaaataataaacctgcttaagataccctcttctgaatggatggagtttgatgatctgttggccctgttggtcagggaagggtgaaatgggctgaggaaactggaattctgtaacactaagatccaaggacacttccagaaatggcatttacaaggtgcaagtgttccctgtaaatcttctggcaaagggctttgaaatttaacttatattggaagaaccttaaaaagttagtagagccattcatatttctgtttggtttaagctgtgcctgctaataacattgcactgaaatgcaggcgtgaattcctataatgttaaaatcaaattgtttacctcagtttgaaaatttgctcaaatgagagtgattggctattgttagctctcaatttgactttcaagacaccttgaaatagcttcaggaaaaaaacgtgatttctagttaagctgttcagttaagcactttgtgatacaaagtatgttaaggtaaaaccttttatttaaatcaactttaagaaaacctctttagaaagttgcagagtataaatgaggaaacctttaaaaaaatacagctttatttcttttacgtatctattgggaattgagctaggtagtcgaggcaccagcatgaggttcttaagaaatctgctttaatgaacaaatcagagtgatttgtacttaatacttgattttgtttcaaaggccacataggcatttgaaaaataagtttttgcctgaatcctgtaatttcagctttcttagcaatttctcttttctgaaacagtgaaaatgtaaactttagggtagcctctgttcaaataatcacaatatgtgaattgaagtttgaggagttcatagagtgttactgaatttgtctgttttctaaaggaaattgattcatttttttcaaattattttacaggatccttcaaaccaaaaatgtggtggaagaaagaaaaccgtgtctttcagcagcatgccatcggaaaagaaaattagcagtgcaaatgactgcatcagcttcatgcaagctggctgtgagttgaagaaagtccggccaaattctcgcatttacaaccgttttttcactctggacacagaccttcaagctcttcgctgggaaccttcaaagaaagacctcgagaaagccaagcttgatatttctgccataaaagagatcagactggggaaaaacacggaaacatttagaaacaatggccttgctgaccagatctgtgaggactgtgccttttccatactccacggggaaaactatgagtctctggacctagttgccaattcagcagatgtggcaaacatctgggtgtctgggttacggtacctggtttctcgaagtaagcagcctcttgattttatggagggcaaccagaacacaccacggttcatgtggttgaaaacagtgtttgaagcagcagatgttgatgggaatgggattatgttggaagacacctctgtagagttaataaaacaactcaaccctactctgaaggaagccaagatcaggttaaagtttaaagaaatccagaagagcaaggaaaaactaaccacccgcgtgaccgaagaggaattttgtgaagctttttgtgaactttgcaccaggccagaagtgtatttcttacttgtacagatatctaaaaacaaagaatatttggatgccaatgatctcatgctctttttagaagctgagcaaggagtcacccatatcaccgaggatatatgcttagacatcataaggagatacgaactttctgaagagggacgtcaaaaagggtttcttgcaattgatggctttacccagtatttattgtcatcagaatgtgacatttttgatcctgagcaaaagaaggttgcccaagatatgacccagccattatctcactactatatcaatgcctctcataacacctatctaatagaagaccagttcagggggccagctgacatcaatgggtacattagagctttgaaaatgggctgtcgaagcgttgaactcgatgtaagtgatggttcagataatgaaccaatcctttgtaatcgaaataacatgacaacccatgtttcctttcgaagtgtcatagaggtaataaataaatttgcctttgttgcttctgaatacccactcattctttgcttgggaaatcactgctccttgccgcagcagaaggtaatggctcaacagatgaaaaaggtctttggcaataaactctatactgaagcacctttgccctcagaatcctacctcccatcaccagaaaaattaaaaagaatgatcattgtgaaaggaaagaagttgccttctgatccagatgtgttagaaggagaagtaacagatgaagatgaagaagctgaaatgtctcgaaggatgtcggtagattacaatggtgagcagaagcaaatccgactctgtagggagctctctgatttggtgtctatttgtaaatctgttcaatacagggattttgaactatctatgaaaagccaaaactattgggaaatgtgttcatttagtgaaacagaggccagccgcattgcaaatgagtacccagaggattttgttaattataataagaagttcttatcaagaatctatccaagtgccatgaggatcgattccagtaacttgaatccacaggacttttggaattgtggctgtcagattgtagcaatgaattttcagactccgggtccaatgatggaccttcacacgggctggtttcttcaaaacgggggatgtggttatgttctaaggccgtctataatgcgagatgaagtttcttacttcagcgcaaatacaaagggcattctacctggggtgtctcctctagctcttcatatcaagatcatcagtggtcagaatttcccaaagcccaagggagcttgtgccaaaggggatgtcatagatccctatgtttgtatagagatacacggaattccagcggattgttcggaacaaagaactaaaactgtacagcaaaacagtgataatcctatttttgatgaaacttttgagttccaagtaaacctacctgagctggccatgatccgttttgttgttctggatgatgactacattggggatgagtttatagggcaatatacgataccatttgaatgtttgcagcctggatatcggcatgttcccctgcgttcttttgtgggtgacatcatggagcacgtaaccctttttgtccacatagcaataactaatcgaagtggaggaggaaaggcacagaagcgcagtctttcagtgagaatggggaagaaagttcgggaatataccatgctcaggaatatcggtcttaaaaccattgatgacatctttaaaatagcggttcatccattacgagaagccatagatatgagagaaaatatgcaggtaggagaaacactcacactctccttccctatccctgcttattcctacccgtataatgttttattaataatctgatttgcaaaaatttatcagaaagattgtttaagtctgggtgtggtgactcattcctgtaatcccagcactttgggaggctgaggcaggtggatcacttgaggccaggagttcgaggccagcttgggaaacatggtgaaaccctgtatttctaaaaaacatgaaagttagccagatgtggtggcgagcacgtgtagtcccagctacccaggaggctgacatgggaggattacttgagcctgggaggtcaatgatgcagtgtgctgtgattgtaccagtgcactccagtctgggcaacaacagaacaagaccctgtctcaaaataaaaagaaagaaagatgtgtaaacctgtgtaccattgaactaagttcagtattgtctgtgataaaacagatatattttatgtttctaactgtgaatgctatgttaagtttggactgaactaagatgtagcaaaatgctgtatattaaatatccttagtacaaaactgaatcaatatatggaaatgtgcatctgaaacaatgggaaccaagtagaatatacaatatatgtgtgtaatacataaaaaatttatacaaacatacacatactaattaccagtgtatatataacatatttgcatatatgatcatgaaagaatttgaagtgatataaaacaagcataatgtctattaggttactttttagttttaaattaggtataatgacaacaataataaattactccccacaagaacaagtaaaactaaacaaaaaaaattggcactcaaactggttgaaaaatatttaaccttgtcttagaaatgtggtttaattgaaagaacatgggttcttgatcaaatctatccctgtgcgatcttgaacaaattatttcaggtctctgatcatcaatattctccatataaggtaagaaaaatagttacacttatcgcaaaattattattagagtaaaattagggtatatggaaattgactagcctgaacatttagaaattcaatattaagttttctttccttcattaatgcttataatctgagacagtggtaaacttaaaaaaaattacttaatatacttattaggctagtgttattgagatgcaaacaataacagatattcaccgagtacctgcaatgtgcaaagtggatattattcaattcactttatttctttagctgatgtgtttataataatcctcaccaaaaatccctgttttcaagatagataataaatttgaaaatgttaatgcatttcctaagtattgcaagttaacagatagcaatgttagcctttaaatccaggactgccagtatttaatagaacaacagggtgactatagttaataataactgtacattttagagtaacttaaagagtctaattggattgtttgcaactcaatggataaatgcttgaggtgatgcataccccattcttcatgatgtgcttatttcatattgcatgcctgtatcaagacttttcatgtaccttataaatatatatacctactatgtacctgcaaaagttaaaaattaaagaaaataaatccaggattgcctaataccaaaatccatttccattatcattcatgtgcagaaccacaaacccacggcacagttaaatacttgtggtaggttgtcttagccaccatttaaaaaatagagtcccaatatcagcatattctatgtaactttttctgacataattctagtactattataaatccctatgttagattagttataaaccatttctgcacttaactttatagattagactttacatattttatataatcttgaaatatgtactttgcatattttatattatgtatttaaaatacatagaagtgttatagataaagtgtatccaggtagcgttgatagttcatattatcttaacataaagtctttggggttaaggattatttggagtctaatcagaagaaaaatgaaggtgatcattgtcatgaaattcatgagacacctaataagttaggtactgttcactgtgggtgaaatgtaaaatagtcataatttctatttcaaatgaattttttgaaaagactgtaacatggacaaatgtagctctacatgaaatgtgctttcagtgtgtgtgtctgtcaggtgcctttctgatgaagtgacaaaggaatgccattgattagtcagatggagggtggtgagcagtagcatcctgctaccttgaggaaaaaagcccaagtgaaatgcactccagtgtacaacccctgccattctgttttcctgatcaccatgatacaaatcaaacatgacattcatgatcagccagtacttagttgtgtgactatcccagtggtctgctttgaaaagcactgcatagccttgtgtcccactctgctttgctttcatgggttgtttgtggtgattgctaaaaattgagcaagatgaagtatagttatgaattagccctctattatcttttaaaaatgaatgtacttttctgtaaacctgggagtgctggcggtgatgtgtcaggtggtcagaagtgtgattccatgttttcttcctcacagaatgcaatcgtgtctattaaggaactatgtggactccctccaattgccagtctgaagcagtgcctgttaactctgtcatctcggctcatcaccagtgacaatactccttcagtctcacttgtgatgaaagacagctttccttacctggagcctctgggtgcaattccagatgtgcagaaaaagatgctgactgcttatgatctggtaggaaattgcgactccatatttttttacgtgtgtgtgtgtgtgaaatcacaaatagcagggactcctctgtggaactccaatgaataacacagggtgactacctttgaaacatggattggaggtagcatgcagagccggcccattcagcttctgctaagtctcagtggaaaactctgagaaaatgacttgaacctggagctgcacaggttataagtggaaaactctgctttagcaaggaatgaattattaaaaaaccctcaaaaatatgtacactcatcatctaaatgactttagagtgcaatataaccatttaattatatacctatgggaagtaaacatgtctcagtgctgccttatgatggttgagacaaaatttatatagaatctatatttttcagctaattcctagaatgtaccccttatcctcatggtccaaaatgggtgctgagctccagccataatatctgcattccaaccatcaggagtgatgaaaagatgtaagacatagcttcttcctttaaggacgtttctctggaatagaatagatcatgtttgcttttatttcatcagcctggagttgacatatagccacacttagttgcaaaggagaatggaaaatatcatttcaaggggctatatgctaaatgttgtctcttctgttactaggaaataaggggagaatggatattaagggacaaccaatagtctgctacagaggtgaataggcaattcacttaccccccacccaataacaatgaaaaattaaaaacatttaactttaaaataagtttttaattagaaattaagaaaatatagtaagatattcccctcaccattaaattgacatgttttttctctttaaaaatagtacctctgatcaagaatttaagcaaatggatactctcattcatctacttctagtggaaaaataaattgatatagtatttcttggagaaacaattggcaatacaatttaaaatgcttatgagtttgatctatagagttccttttcttggatttattctaagccagtagagagaagcataaacatttatgttaataattcaacatagaaagattagctaagtgaaatataataatctatattatagattcctttgaagatattaaaatcatgtgttagaagaatatgtaatggtatggagaagtccttacaatgttttgtagaaaatttgattacaataaaatgggagataggatttaaattacatttctatgaatatgcccctaagttgctagcaggttattaatagtgaatgtttttatataagagtgaattttattttcttatttatgcttttctgtattttttctatattcaccaaactctttataatgaacccaactaattttataattgcataaaataaaccttaaggaagaaaagatgaagattttgtcattaaaaaacaagtagaagaaagatattggagataaacattctacgaatgaaaaagaaaaatttccacagggcatgttctgcttatgaatgaccatacctgttataaaatgtacttcatggttgctagggggaaagtttacctattacctgtatctcatttttcatgaaatcaactttttcatcataaaaatggggactgaaagctattcagtgaataggtataattgccatctaagaggtgaaattagggtactagttgccatagagacagacagtagaaatcacttattcctccacttctcttttaagctaagaaaaagaaatcattcatggccagggaggtccctgaagctggcctgtaataagcagaaggatacctggtctggggctgggcaattgccatttcacacccccgagtgtctgacagtgtcttattttttgttttatctgctgaagccaagactgaaatattagccttttctcatctgtattattaaaatgcaaattgtaattgcaggcagagcatggttttcaaagattaaaataaaaggctacggtggaagcagaaatacttataatgaagtctttcatgtacagttctctatggaaaaccattttgggagggaattgagtgtaaatatccttataccacatggtaaacttggtagaattcaaaaatgattaaaaacaccattgacatctctgttgagtatttatttgggggatggggtgggtagggacagatacatgtaatgatgatattggccttgaaattaaaacaccatttttactttctaggatttgcattgtattggttggcatctttaatgctcttagtgtattactgtgtgttaattttaaataggtcttctaagatctcttcagatctggagtgaacatttaaaaacatagatcaaggggctggattacacttgcaatcccaggactttaggaggccgaggcgggtggatcacctgaagtcaggagtttgagaccagcctggccaacatagtgaaaccccgtctctactaaaaatacaaaaattagccgggcatggtggcacccgcctgtaatcccagctacttgggaggctgaggcaggagaatcgcttgaacctgggaggcggaggttgcagtgagccgagactgcgccatcgcactccagcctgggtgacagagcaagatgcaatctcaaataaaaaataaaataaaataaaataaaataaaataaaataaaataaaataaaataaaataaaataaaataaaataaaataaaaacatagatcaaatcaagtcactttcctgcttaaaatcctccaatgggttccattaaaataaaacggaaactcctgactgtggctttacaaggtcatttatgatttgcccctgcttgtctacctcacctgcctctccatccttgcccaatctcactacatctcccaacctcatccgcctctcacaacctcacccgtctctccagcctcactgcctctcccaacctcacctgcctctccagcctcccctgcctctttagttttacctgccgctcccaactgcacctgcatctccagcctcacctgcttctcccaacctcacctgcctctttagttttactgcctctcccaacctcacctgccagtccagcctcacttgcctctctcacctgcttccccagccccatttgcctctcccaacctcaccagcttgtcccagtctcacctgcatctccagtctcatctgccttttctagcctacctgcctctccagcttcacctgccttccccaacctcacctgcctctccagtctcatctgcttctccagcctcattctcacaccctctattttgctcactctcttccagccacactggctttctttgcacatatttatggggtatggtgtgatatttccgtacatttatacaatatgtaatgatcaaattagagtaattagcatatccatcacctcaaacatttatttcttagtggtgagaacatttaaaatcctctcttctggctattttgcaaggtacttaccactgtaccaccgacaccacctcttctagctatttggaaatatgcaatatattattgttaactatagtcactactgtgcaatggaacaccataatttattcctccttatctcttaattcttagctcaaatgtcattttctcagaaaagccttccctaactactctccccatacattcctttgtcacatagccatgttttatttccatcttcctgcttagaagtattgaaaaatactttgcttgaactttttaattgctgtcctcttttactcctcaatttgaatgtaaactccgtgaggttagatcctatctgtatatttattactgtcacctctggcacccaaaacaatgttggcacatagcacgttatcaggtaatgttcactgagtaaaaacaataaataaaagcatctattgttggtgaaaatcgtgtagtttccatcctataactgaacatgtttgatgataaattattaaatccccttgattttacctctctgacaccacccttgctgaattgttccctatcttatatttggctaaaaaacttacagagtaaggcaaaactatggagacagtaaaaagattattatttgccagggcctttgagtgggtcagggagggatgaactggtggagcacaaaggatttttaaggcagtggaactattctgtatgaaactgtaatggcagatacatgtcattatacactagtcaacaacctatagaatgtacaacacaaagagtcaaccctaatgtcaactatggactttagctaataagaatgtatcaatagtggcttgtcaattgtagtaaatataccacactaatgcaaaatgtaaacagtagggaaaactgggaggtgggggtagagttagagggtgaggactctgtactttccatttactttttatgcaaacttgaaacttctcgtaaaaatacagtctaaccacccccccaacctaccacagactattaataaaaactgatttggatgaataagggaaaaaagcaaatccaagatttattgcctagtggtgtggttggtgtggggagaaggtattccaaaatgaacagcttgggttcaatttagacttaagttgcttaaatttttggatttcttgaaaatggtaatgaactgtgtagatgccatccaagaggaaaaattgttaccactaaaaaatgcagaatatgtttagaataaaaacaacctgaaatctttcctgaacagatacaaatgttttcttttttcagtatggaaagaaagaaatcaggcaacttggtagcctacatttgttgaaagcaaacttgagtgcatcaaattatactattatcaagggaaaataaaataaaatattctagaaaacactgaccctgagttcatctgcacagattttttcccctaaatttagctttccatatttattacccactataaataaataaataaataaatcccactatttattagtcattaaatatttgaaaatatttcctcctgagggttttaaaattcagtcttaaaagtcattttttttctctctctctttttgttttggaaacggagtctcactctgtcgcccagactggagtacagtggcgcgatctcagctcactgcaagctccgcctcctgggttcatgccattctcctgcctccgcctccccagtagctgggacaacaaacacccaccaccatgcccagctaattttttgtatttttagtagagacagggtttcaccatgttagccaggatggtcttgatctcctgacctcgtgatctgcccgccttggcctcccaaagtgctgggattacaggtgtgagccaccgtgcccagccttaaaagtccttttaaattagtcttgcaattataattccattatagcaactgtgttggtatcaagaaatcaaaaatcaaatgtatttgtagcaaaatgggcctattgacgtggcagaatttcagaagaaagggaaggcacactctcccctgtcttagcacatcttacttaaagtatacgttttctgtctgcttcctgggacttgaaatttcaaaattacaaccagttccctagggttaagactttttatcttttttaaaatgcagcaacatccctgtgagtaataacacactgggttatcagtaattcattcttactttcgagtaaatttagcagatcctgttctacaagcaggttttaacctgggagaagcgagagatggtaatgacagagggttcaccaagtctgggtaaggtgaaggtggggttgctcaaagaattgcaatttgcttacgggcagccctgtttactgttaccattaatactctcaataggatgttgccatgtaaatgcctatctagtattttgtgcaactgaagcagagatgactttgctgatataaaacgtgtcacggctggaggtgggaagtgtacagcttctaaaacagcactagagggaactgggagcactatcaatcaataactctggcaagtagaaaaggctctaaaagtcgaaggtagaatggatgcctctttcgcaggctaaatacacaaagagaagagctgttggcattggattgttcaccacagtgccatttcagtggccctctgctcatcaggaaagttttccagaaactgtccctggagcttaatttgaaatcagaagaccatttctaagtgactcttccatttattttactgcgattcttcttcttttttggctcaggtctctgaaagagcaagcatcacttccccactctggatttttactttctctggaaaaatatcccactgaagtaggtagtatagtcacagagtcatcgtcttttaaggctgataatgtcatataattatattttgcaaataaaagtaatatgactttttttcatttaggattcatcttaaattgggtgttgttaagagtaaaaattggttacagaaagagttacttagtgttatagccagaaaatggagatgtttaatttgataaacattttctgaactccttttaatgtgcaagccactgcgttaaatgttgtggaaggttcagcagatcttgtgcttcagcagcttaccagcaggagatgtaacctggtgaggtactacccagccctaggagtctactattggggatgtgaatatgttactcatcatttaacatggagttgtaatagcaggggattacactggaaaacattttgtaattttagtagggcactatcaaaactagtttgtttgaattggtttgacttttttcattctgcaatcgtgtttttatgcatgtagacttagctccagccctaatgttttactctagtcacatttctacgttttattctgtgtaaccaaagatgaataagcagagacggaatcagcacagatagtcatgatagaacgaatgacagttctgtaactcaagagaaataggaaaatgtgtaggaacacatatatttgccacttgtaaaataacattttctcatttgatatgccattttgtatatgtctttaggcttttaattattcaactaaacaagaatattttggatgcctactatgtgcaaggcagtgtgcaaggtgctagagaaagaaatagtatgaagcaaaacttctgtccttgaggaatgggcaaccctgatgggaaaggaggacttacacctaaaaagggaagtagtcacacgcagtgttcagagagttgaccacatggtattttatgtccttagctggagtcttagatcatttagtcctatgatagacttttcacagtgacttataacacacttcttctaccacctctgccacctggtactcagcagaattttatttccaaatacatttgaaagaaaaatattatctgactttatatactttcttctttagatggccgagcttttccttttcagtgttctcacctttctaatttttcatgcagtcaagaagtattttcctaatatatttgatcatttccattattttaagttgttatgaaaaatatttgggtaatatcttaaatatatcattctgaagtggaatagctacaggaggttgcaactgtaagaaataagcccaaagcattctccaaggtgacttctgtgctaccttatttaacattaacataaaagttaaaactttactatggtaagaacaattttttttaaatttgttgttaaaaaaaggaaatcaaaacaatctagagaacataagtcaagggttatttaatcttttactaagtcagttgggggtgatttggagagcagttgatagtgctagagtgagcaggaatctagcaaaaaagagctaattgctgtctaatcacgcttgcaatggaatgaatacactagtaagtattacagttaagccaggcataatggttggcttaaatacattctgttatatcagtgttataaccagtatatattcagcctcaggatgggaaagagttgtagttatgtctatagttccccgatttagttttgcttattgaaatccatttaaattaaaattggattcagtcaaagatagtctcattccatcactgtctcttattgtgaagtttgtgtggaactctattagtttgcatttcaagaagtatctttgcttgtatagtaatagaacctaaaaaaagaactgtctgctggcatgtgcccaaacagagctcggtgtttaaaaacaagatgctgtattcttggggtatggaaacttccttcacatgtgggtacagcaatgtctttggacacattttctgtgtaaggggaaaattatcagcatcttgaggagtggcaaaatttctacttggtaccaggatctctaggaccatggatatcagagatacatatccataagcaagtatttcaggttggcttttttttgtggaattttgtccatgcatactcaaagctggctttgcattcttgaatcctcaggctttgtaacacttttggttaaaggtagtaaggtagtcaaattggcctgaaaattctggagaaggtttactaaggctactcatctggatattttatgaaggagttaaatcgtaatgacagctggataaaaacaaatatttctaatgactactcaaggtatagctgacaactgtttggggaacaaaacaacaagagaaaaaaaatgatctgtttatgccaaaagggccccctgaagtagattttgtcaccattgtgaatgtggagacaaacgtcctctgacttgctgtgtgcaagttcacttgtcctgcgccattacaaatcaggcttgcaaatgtgatgcattagtcccaggacagagagctctgttgcatacaccaaaggcagtggacttccagtgaacttgcaaatattctgactttacacttgtttctgtatgaccgagagttgaccacactgacaggcttgattgcttaaaaacaacatgccaatctattagcaatgcttttatttgtttcattttaaatatttaaggaacttgagaatgaaaggaaataatcttcattctagttagcaaatatatatgtaagagcaatctgatttacaaatgtaccaagtttaataaaagtcatcttgttttaaatgatctgaaaagatgagccactgcagaaccatagaatcgaaacctagtttttttgcttagaaggaaagtaagagctagaggaattattccagtgttctgaaaaggagaggacaaaaaaagtctagagtagattagctttttattgactcacattttctcaagcaatagcttctccaaagttcctaactccttcctgaaaaaacagaggactcaagtaaatacatttcttcctatgtttcatatgaaaaaatgtttatcatgattgatgcatgttgtgaattagacttggagggaaaagcagtcatggcaaaatttattttcatgatgcttaatttgatgaatgttactttattgtttattaccaacttgcacttgcaataggaattctacactttaatatggtctgctcctcaagaatgcctagattctagtctaaattgtttcactagctagttgtgtggctttaagcaagctaagttttagctcagggttttcaactataaaatgtggttgtccatgatagactgtctttaagataacttctaagtagaaagattgtggttctaggaatttaggtctaattcaggataaaatgggaatctatgcaagatttttgagtcctaatatgacgaaagtgcatcttttcagtattattaaataattacattgactttgcaatgattctgggcaattagttaaacttcttactggtaagagctggaaggatagtttcttcacaaaagctggacaatttaatccatctttgagtaacagtatcactgcccccttcagtaaagttttctttttaaagacataattttactcttaactggtaactttacacacccctgctctggatacatctaatgcataaagtaatgtcaacctttatctgggcaagtcctctattcttttagagacaaagccctgacaaggaaataagatccattaggagatattcatgtgacagaaccagagaaaagctctttgtattactacaacaggcaaaggcaactagcagctcaggctgagacatcagatatgtaaatcaggccactgccagattctatcgactgaatcaacccagccgtcatggctgagtcgtgctgacttcccggctcagggattatctgaggacatcttctcaccttctctgcttggcttttgcgctttgtattttatttccatcagtatcatttagagatcttggaaggaggtgaaactcaaatcgaccattttttctccctgacaacttagataaattacttagttgagaggaaaatttgaaatttttgacttaaattgtggtttggattattggtacattttagctattcatctcatttgttttttctatagctactaataattgaaagctgactgcagaaaatagaataaatttataattctcaatacaatagaagctgttgacagagagaaaaatcaaatccccttatgaaacaatttcatatgagcaatgattttatgttctgagaatattaatgataagatatgtgaggacacaatttgagacttttattactaaaagatttctggttatttctgaggaatctcaaacagaagcttgttttgaggtaaaattatactcgattatctctttatgacgtttattagacaatgggaaaaacagaaacaacttataccatggggttaacaaatatttacttgggggcttttgagaagaacttgaactataaggttttggagtatgttttgatcctaaatttattttacctcaaataagcatgtaataaagttttaacatttgttttactttctgatgtttgagtattatatttctacaggggtaatcctattaaaagctttatgcttatttttcagtacttaatttgaaagagaattaagagcatacaaaattacagaaaaatgaggaagcctaggaaaaataagagtggagaaatctagagacaaaaagagagatgggagttcaaaaagataattacaagtttgagaagtggtcagtaataaataaaatgttttattgcacacacatatgtgggtagcagacagagagaagaaataagtatcacaaaagcaaaacggggaaaaaagtgattatgtaaatggatggatgcatctgggaatacaaagctgaataagattgagtccctgctctactggaattacaatttactggagaagtaacaagatggaaataatataggtaaagaataaatcataagatagaaaataaaaaaattccatgaacagatttaaaaaaatagaatgttttgggaatatggggagtgagaaggagacagaaggggaaatcaggaaactaatagaggagagggcactgaagtgagctttgaggcctggcaggattttgatcagggcagatggcttaagaaagtttccctaatagaaagaaatgtgtgggaggaggaacaagtagggtgtgtttagagaagcgtgattcatccatgtcaactgagacttaggggaactggaacaccatagttctaggttagaaaaattttacttcattcagtaagcaagggagaaaatgacaaagccaggaattagtactgtagttttggatgatgattctggaagtggtacttaggaaggagtgagatcagaaggaccagaacctactggtagctgagtgggacttcaagcccacctttgagtgctgcttgagagaattcggagaagataggagatacttcatttttttggtgggagtggggtgggggagagacagggaggataaaatggagcagataatatttttaaaggtgactttgctgcctctggaaggataaaaaaccctattctggttctcattgctattatgttccaataccacttgccttgatattgcagtaatctttgatgttaagggagtggaattaggtatttatgaatatgacctgggacataaggaatgtatatacatttatttgacagctacttatttggtgcccactgtgtgccaagcatgttacacaagagagtaatcataaggaaggtgacactagcctcagtgttaggatggatgggggttggaacagagcttatccttctccctcccatctgttgtggtgagactatggcttacttttactggaggtatcatgtgggtctctctgtatgtcgtcttcccaatgagccagttcaaggattctgacaaccacctttttgatgtttattttgtaacagatgattcaagagagccggtttctcatagaaatggcggacacagtccaggaaaagattgtacagtgtcagaaagcaggtaattgtttttaatttttttttctgttttttttttctattttgtttggaaactataataattcttggtagatttttttttcagaaactttctgcttctcttaaaatgcagttattttatagcaatgcttaactatactttaagttacactttagtctttgtttagtacagacgaaatccaagtgataataggtgggttgtatgtgagcgtacagggttggggtggtgtctgaagaagtctagagggatgagggtttctgaatctagttttgtggtttggaaccccatcaaaaccttctactgctggtattgaagctatggttccatacagtcccttaaaacccacttcaattttacaattggaaccaaaatcctattaatcttccaggcttttgccccattactagtcttcactttagatttagatttgttctttctttttaagtatgggatgagtcacatatctgtgagagtgtacttgtttatttctgttcaccttcatccacacccttgtgctttcatctcctggatccacaaccttctctatccacatacccgataatgattatgacgaggaagatgacaatagtagcaactgcttgatacattgcatatgctataccaagcacacacactatcttactcatgacaactctgcaaagtaatcatcattatatccgatttatagatgaggcatctgagattctgagagactgagtgacttaccctaggtgccatatcaacacgcggtggagctgccctttgaatccagaccaaacttttaaaatggtgcttttcactggctgaccagcaggcttagatatttctgttgacaggaagcacaaaaataataatacctgatacttacatgatgccaggcactgctctgagatctttatatgtactgattgacttaagctttacctctgtcccatgaggtaaacccacttgttaaccacatgtcacccgtgaggaaactgaagaccagagatgtcagggtctttccgagactcacatagctagtaagtggtagagctgggctccacactcatgttctttactatgtgctatgtttgtgatgttagcaccaggaaagttaacgtggtcttaggctgcattaataaaaatataaaaactagaacaaggagaatggtggtagatccctgacctcatgtaggcttctccaagcccattttgagtacagcgttcactcctggaggcaagttcccacagagctcagctccaggaaactgggcaatgcagtggccttgcctggatgccatctttaaagaagagtttcattggcaagctgaatatgtttgaatggttaactgagagaagacttgaagggattttacccaatatctttcttcaaatatctaaaagcttgcactgtagaaaagagtttagacctttttggtctgtgtccagctagcaccaaggagtagaagttccaaggaaggagatttttggcttgatgtcagtcatagctttctgaagatggaatgagctgttcataagagaatatgatttccatctttaaggtgctaagacaaaggctgaagaaatgtgatggtgatggttttcataatcttcaagctcgagcagatggttgagctaaaaatactttaaggtcattcccaaatctgaaatacttgggtgtttcccaaaatgctatttttaaaaaagcctttttatttttagccaacattactgattactcattgttatctatgtgggttccaggacctactattaagcgacagggatggttcataaagaaaaataagacatatgcattcctcacatatggttgccattgacacatcagaccatttcatgcataaaccaggaagaggacaaacaaggtccatgtaacctgttggaataatttgcttcttacttatttacttattaaaattttttttaatttttaatttttgtgggtacataggaggtgtatatatttttggggtacatgagatgttctgatacaagcatgtaatgtgtaacaattatatcatgaaaaatggggtatccatcccctcaagcatttctcttttgtgttacaaacaatccaattatactgttttagttacttttaaatgtacaattaacttattattgattatagtcatcttgttgtgttatcaattactaggtcttattcattcttcctatttttttgtacccatagaatttacttttttccttctcatgtcattttctatggctcctggctgttttaaatacaatttagcctaatgcattgactgttgtcaatttgtgcataaggacagctacttggtgggatgaacagaatgaaaaggataattcaatttagggatttggaaattatgagaagacaggaatgtgaaattatattttactgataatattttcattataagatgcccatttttctgagatatatactcagatttcttatgcattctttcttcaaagggatggagttccatgaagaacttcataatttgggggcaaaagaaggcttgaagggaagaaaactcaacaaagcaactgagagctttgcttggaacattacagtattgaaggtagatgaaacactcagatgtcccctgtgcctttacttttcttctcctcatctctccaatgtgtagagaaatgtaaaggattaaatatgatggtttggatttttaaaccttcactttagattcagggttacatgtgcaggtttgttatataggtaaactgtgtgtcgcggggggctggagtgcagattattttgtcacccaagtaataagcacctagtatgcaataggtagttttttgaccctctctctcctcccaccctccatcctcatgtagtccctggtgtctgctgttcctctctttgtgtccatgtggtctcattgtttagttcccacttataagtgagaatatatagtatttggttttctgtttctgcattagtttgcttaggataaagccctccagctccatccatgttgctgcaaaggacatgatcttattcttttttatggctgtgtagtattctgtggtgtatatgtaccacattatctttatccagtccactattgacggacatgtaggttgattccatgctttgctattgtgaatagtgctgtgacaaacagacatgtccatgtgtctttatggtagaaggaattatattcctttgtgtatatacccactaatgggattgctggggtcaaatggtaattctgttttaagttctttgagaaattgtcacactgctttccacatggctgaatgaatttacattcccaccagcattgtataaacattcgcttttctccacaaccttgccagcatgtgttattttctgacttttagctattctgactgtgagatggtatctcactgtggttttgatttggatttctctaaggattagtgatgttgaacacctttttatatgcttgttggccgcgtatatgtcttcttttgaaaagtgtctgttcacgtcctttgtctgctttctaatggggtgtttatttttttgcttgttaagttccttataaattctgaatgttagaccttcgttggatgcatagtttgcaaatatcttctcccattctgtaggttgtctgtttgctgtcttgatagtttcttttgctgtgcagaagttctttaattagatcccactgtcaatttttgtttttattgtaattgcttttggtgtctttgtcatgaaatctttattaggtcctatgtccagaatggtatttcctaggttaacttccagagattttatagttttaggttttacatttaagtctttaatccatgttgagtgatttttgtatatggtacaaggaagaggtccaatttcaatcttctgcacatgactagctagttattccagcaccacttattgaatagggagtcctttctctattgcttgttgttgttgactttattgaagctgagatggttgtaggtgtgcagcattatttctgagctctctattctgttccattggtctatatgtctgtttttgtaccaatgccatgctgttttgattactgtagccttgtagtatcgtttgaagttgggtcaagtgatggcttcaggaatgtgtggcttgatctctaggttcatactctaggagatggggagctgcatactggaattaacatggtttttgccttaataaggcaatgaggttttcggtgcaggcagggtacagcccatgtgtgagattaatttgcctggtgtgtgtgtgtgtgtgtgtgtgtgtgtgtgtgtgtgtgtgtttactcacatgaatacttacgttcaagtcaatatggctgttcttgtttgtggaaagaataatgacaaatgcttctggggaagattccaacacaaatgattttgaagagacaaagtacaaaatatctagggccattgaggatttttattttaagaacagttcctataaatacatttctttttgcaaataactttggaagtcattttcttgagattatgatttgctctctgctgcacatgaattttagaattttgaagtaaatatgccactttttatattttcttacatgaaaaaagaaatgatttaggcagacaatatattcttgacagctaaatgggagaaaaatagctacaaacaaaattaataattgctgacatttaaagaacactcattttgtgctaggtactgttttatgaggtttatatgaattaacaatttaatactcacaccaactcagtatcgttattaatctcattttacaggtgagaaaacggaggcattggaagtctgtgtatatttcctgagggcgctcagctagtaaatggtgtaactaaattttaagctcaggcagtctggctccagaccctgtgtctttaacctgtgctgcagagatgctgcacatgtttatgtgaaagtgttaggttagctgtaagacatattacaaatgtctattaaaaattcagtccacaagtgataagcccctactatgcattgggctctgtgctaggcactgggaatacgtggagaacatgagatacagaccctgacctcatgaagttagcagtctgagtccagtggaggagggggatggataaggcatcatttgcttaaggagcagggatgacctagagctgtagtgttaaagaggtgcttattataaccctagattataatgtggcagtgtgtaccctgatataaacattttatgttcagaagattttatatgggcttgttaatgtgcctgtcacagaaaggtgctagggatacaaatatcaggaggattacctgggtctccaagactagtctataaggagagacagacatgtaactaataatggccatcaattgttcagcacttattttgtgatcagcactcaaggctaggtactttatgtacatttcccctttcttccttgccacaacagtgcaatcttgcaacatgacatgctgactctgataggactctctccatctcacaaatgaggaaattgaggcttgtgggggttgaaatttcttgcctggagtcacacagctagtaaatagccagcctgcaatttttaactcacgcccatggttctatccactacactgttctgcctcctctaaaactccatccatgtggctgagtccctgtattagtcttttctcacgctgctaataaagacgtacccgagagtgggtaattaatttataagagaaagaggtttaattgtctcacaattcagcatggctgggagggccacaggaaacttacagtcatggtgcaagaggaagcaaacatgtcctttttcatatggcagcagcaaggagaagtgctgagcaaaaggtggaaaagccctttataaaaccatcagatcttgtgagaactcactcactattatgaaaacagcatgaggataacctcccttatgatttgattacctcccaccaggtccctcctacaacacgtggggattgtgggaacaacaattcaagatgacatttgggtccaaaccatatcagtcccattgggtccaggcagcctagtgcaggaataagaatgcaggccctgtgtgattacctgatagtggtgagactagccaagttatataatctccctcagggtggtaataatacctacatctcagattttgtgagaattaaatgagataatacatacaaaagatgtaagtcacagtgcacaaaactagacagcatatatgttagctgttatttgtttgtttgccaggtgaggataaacatggagaaatgaggtttttgttatttttatttctttgttaacttctgacttaagcccacttagtgttgtcagagatttcttaatgtttttgtttggtttagtaacagaagctgattgttagatgtgattgagcaaatgctgttcaaattattccaagagagagcttttcagacagaattgattttctattattataactcacatactagctgctggtatttcagcttgagcactagagtagtggactactactaaacaagagtagagaacatttccacacttccaatagctcctttttctcctccattgagtttggggcctgttaatctggtgtcctttccccaagagctggacaaatgacctcctttgaatttgaattattagctgagagaaaaagagcctgggctctgttggagactttttattccagtggtgctgctctaagaagatatctttttctatacgattcttcctttagttcttatgcattagatctgaaacacttgattcccaattaattctccagacttgctattgattttcagagctcctctaagtattttaataaatgctctttgtttataagtttagtagattcaatttaccttgcttccagttggttgaatgattaataaccatcctggaaagacataatcactgaattaggaggctgtggtacaattctgcgttgcctactgaaaaagtttccttatacatgatttagactagtattccctactatctagagagagggagtgggaattaaccaattctggttaaatgtgttggtttgtatttctaaaaatatttaattccagtgtaatttccaataagtaaggaaggagctggaaaaaaatgagaaatgtgccctcagcaagttgggggattgacagcatggagtggtgcaaaggggcattggctttagagtaaattgagctgagactgaaaaataaattgtttagtgttttctgcagttcaatattacatttatctgatattaaaagctggagaaaaaaattgcagaaagaaaaatgactaacgacaatataatgaataagaattataattacagtgtccaaattgttgcagagaccaggacttagtatttagcaaggaaactgaaatcaaggtgcttctggaagatcccacacttgtgtttttctttaattcatattctagcacctacgtgggtccagtatagggacttgtttagcgtatcttttgcatttttccatacttttgccatatgtctatatccaactgtagcagtcaatttgctcttcctttctttctttttcactattgtacatgaaattggtctccttacatagccattgtgtttatttaggatgataggatgattcagtcctcactaccttttcaagacaatcactggatcaaaataactccattccattccaccctcacatgttaaaagacctttccctctgtttcttctccatgatgtccttcttgtgctgatataataaaatacctgagactgggtaatttataaacaacagaaatttatttctcacagttcttggggctgagaaatccaagatcaaggcaggagtggatttagtgtctggtgagagcacagtctcttcttccaagatggtgacttcttgcttcgtctttcagaggggaggaacggtgtctcctcaaatggctgaagggaaagaaaggcaaaagaaggtaaaagggcctagctagttccctccagcccttttacagggcactaatcacctcctaaaggccttacctcttgatattattgcattggggattaagttccaacatgaattttggaagggacacaaacattcaaactatagacatttggttgttaacataatattaaaatctcaaaatggaaatttttcctgttttttaaggctttcagaaagggatactacaacttcacttacgtagccaacatattctagtacattgttagtaattttggaagtgtttcactcatgagagttctgaagatctcttgggagcaagatgtggaattacactatatcactgataaaatgctatttgcaatgaagtggaattcatctaaagtcttgaactctatccagagtgatttgactttttaagtacaaaaagaactgcattgtaaaggtgatcacatctataaaactgaaattagaaagaacccaaggggagcattttagtgagctttcccaatatatatttttctaacttgtcctgttggctattttaagaaactaaattttattactttgtgtttttaaaagttttatgtaaaaatcaattttagcaggctggagaagtatcaagtagagatatataaaaataatattaaagaaatataattaataaatattttattacaaaggaaaaactatgaagtaggtaatcactagagcttaaagagaaataaaagggttaagaagtagctgcccttcttatttattcatgactttcattgattacttgttgaataacaggcaataaataaaaaatgaatataactattacctcttcaatggtcattcctattaaatatgtatttacacttttcctggatagatttccaacttataatttaatgcattccaatgtgtgccatgattctgggctgcttttataaatttatgtttagtatatgtgactattacttttccccataacgcttttgctttttatcactacttaagcctttgctccttctgcttttatctaaaacattttcaatttccgtgggaagagcagagattgaagcttctcacttctccgtgtgtagttatgtttctaacccaggcagattccctcactgaattcccgaatttcaggaccttacagttctggggaatcttgctacaacagaggaaattacatggatgtcagtgtagaaatacgctttcaattagagcctgaaaacacatttgaagtctctgttcattgttgagagacaaaagaaaggaaacagatgatgggctaatgggaaaagaagtatgaggagaggcatccatctctgaaagctgagtgagagtgagaagtgggctacccttcacttactggccatagatatttaaaatcattctatgagatactgtggagagggggctgttagtgtgaatgttcaaaccaggctcttccaacagacatagtgaccatgcctttgggggctgcctgagggtatataaagaaggaacatgcccagtatcatccacattgtctattgagaacttttccagtggtgtctctggcatctgccagctgttgttgctgtagaatctagagaaaggctaggattccttttgagtattcagaaaaaaaagtatatttacaaagtgtagaaacagacctccaaacaacaacaataatgcattaataataaaccatccttaatattgatattattatactatcaattattgagaaacagcaggcaaagtgattaagtgtacagacgctgcagccagacacttcctagctctgtgtctttgggaaaattttgttttgtctctatgctcttgtatcagttggggtatgctgggttgtgctatagtaacaaaaatctgaaaatctactacaatataacacaatggcttatttcttgcttgtactacatgtccatcacaggtaagtaatggtcactcaggaacacaggctaatggggactccatcccagcaaatacttctacaatcccagaggtagggatgcaaaaatggtctttaaaagcttctgcccagtagagtcacatgtcccttccactcacatttgactggtcaaagcaagccacagtcaagtctgatttcatggagtaggacaaatgtaaaccttctcagggaagaggagcagatattggtaaatacaatctaccagtgacaagttcttcaactaccccttataatgtggactaaatgagtaaatatatataaagcagtatctggcacatgctatatgagtgtttgttatttttattattaaaaatgaacattcagtgcttacaataatcaagtgatttttacacaacattttaattacttttaaggataaccctgtaaatttactcttattatacccattttacagataggggaaatgaggctcaggaggttaagaaccttcccattggcatacaggaagtgagtgatggagcaaggatttaactctaaaggccatgttgtcatcccactatgctatattgtcaaaatactgacagcaccataatagtaatggtttgtattaactgagcactttctatgtatcaagtatcctaccaagtgttttatatttattattttacttatctaagggagtgagtgtcctgcccatctagcatgaatatttcaatcaccttgacagaatatgcctactgtcagtagtcagtggttagtgcagaaagctacagcgagagagtgtatcttgagaataatttatttacaacactatatttacaaaacaactctcttttctcaatctggtttcccaggtacacttttctagtggaaaatagaatgaattgaccaagtggtataactagttccatctgcccagtagtcacatttctctttgtaagtaaatcagttaacttccttttttatttgtccatctcctatgagcttggttagcatgaatcagcttcccagggcctgatcacccctgagcgaatggatacagttgagtccttggacaggtacgattgggaatcacggaagcaaagcaaaacaacaacaacaataccaaagcagaagaccagacccaggacccctgagagcccagccagcctcctcttgtttctcttggacagctttgctattcattggcttttagtctggacattgctagctgccatttcttgatgggacagaggaagttcaagagccatgcctctagcaaaaactttacaaaggctatactcctttcatattccttcctcatgccccctcctccacagccacagttctactgttcagacctacaatctgtcctttatcaactgaggagttacagcagaatctattctgtgtctcctctaggcaacatttacttcttcaattttcattttgttgtaaagtttatttcaatttttttgtctattaaacgtttaaaaataatgttggaattttggcaaacagttacggttaacagtcatgccagaaacatttggtgaacgcaactgggaggggcaaaatagggatgaagccaaaattgagggtcttattccagtggcagccagtttagtctcgctcaacctagtaagccctcaactcacttggaatcttagccagctgctttacaatggatatcattgattaccaggaagaaggtgggtggcagaagggagagaatggatggatcacttctagaaaaacagcttgaatctcatatgtcagtaccattatttttatacacaaaagaaaatattattaagccttataaagtgtagagtatacatttagaaggcatagcatctatctgggggttataaactaagtttgatatatttatccgtggacgaggtatctgaaaagatactcctagacacatttgtagaatcttgttattgtttggctaattagtgcaaaataaagacccttctctcccacctcaagaaggtgatgttatttccacactgacatttataaataaggaagtgcaatgcataaatgaggcttataatccataaattagcaaacaataatttaacaaatttttatttcattttatttttggtgaaaccaaatttattaattcaacaaatgtatctgttacgtctttactaggtgacaggctttgtgcttgggaatgtactggtgaataaaaatgtggccttctggtctcagagctgacagtctagtgggggaagctgtcatttaacaagcacatgatgtgtgttaaatttgtccttatgatgggtgccttaaaaaagtgcatgacactatgagagtgtgcaatgggatttgacctaatgggagaggccagggaagtattccacgaggaaataccagtacagtggtgagtaaatattccagcctttcatggattccaaaaccctgccttgtatcttgatacttgagtgtggttgccaaaacaatttgaaaataatggtgaaaagaaaacacatcaaaataaagatgtgccggacctcttcaacatggtctggggagttctaaaatttctgccttgctcatttaattaccactcattagcattatggctaatttgttattatatcaaatctggccatattaattacaaattaatttaatcatccaccttctaaaatataatctgcagcgaagttttataaccatgtgtatccataaaattcatttaatagcttatagttgcagaggaggatgttataaggttggtttctgagaaatttctacaatttaaagctgaaaagatgcagagagagagagagagttatataatatagaatattagtattagtgttagatatatgggtaaattttttgaagtataattgatgcatctataatttaaaaaaagccacaagtttaaaacattatttcaaacagctcttatccaacaatataggacagtttaaatagaatgttaatgcttcttagcaataggcagactggttacatggtgtccagatttctgccttgggtggctgcatcccagctgtgctgcccaggagtttagtagagataaaagccgggctgttgacatgattatggaagcacacaccactttatctccagtagaactaaatttagcatctcttggaggtacacttttttttttcagatgaaagctgcattttataatgaatctgaataattcaaaagtggcaggatcctaatgaatagatgcatcatagaccagaggacttggctccaacttgtgaagttattgaaggtcttacttttctttcaggaaaattttccttagagaaaatttgtttcttacacacagagttttagcctaaggtgagttgtagcttaagtgagtttgatgtcttaactctgcattaagtatttcttacagtgatataagtggaaagaaaacattgataaccaaattgtttcattctggttccttacagctcttgtaggttttatactcacaagctccttttctgatattgttactcaaggaagacaaaaatgggctacatctatctaatttccttattgttaatccaaatcagagcaaaatgagttcacttctctgaatgtgtgtgtgtgtgtgtgtgcatatatatatctatatatacatatacatatatacacacatatatggtatgcacacagacattgtcaaataaagtcaaatctgaatttagatagagaatctgttcaaaagaattatcacaataaggagaggggactactgtgataggggaactattgtaatggggagaatgctcctaccttaagatctgtaagcatttgaaaggccaggcagaaaggatttttcttttatagggaagggcacagaaggtcagaaagaagcacatatgagggagtgggtagcgtgatcccacagttgatcctacagtgaggaaacatctttcctgtggtcagtcctttcttggtaagaggcgattaaggagaggctgtgtgctgtctcaggatgagagtgggtcaaagttccagggcctaaggggaagagagaagcctaattaaagtttggccaagtccaggtagtaggtatcaatattttctccagattggttagtggacacaaacagacaaacagttcagctagtcatttatgaggcaagaaagggaatttgaaaggtctgtgtctggccatgtcacagataaacaagggagattccatgagtcttagccaagtcctatggggaagaggggttctttgcagtaagtaaggtcttttgaggaacacaaaaggatgaggggatttcttaaccatccctgatttcctggaacacagggctcagataaagttgagcattgtcaacatatgcatttatatattgtattatgctgctaataaagatatacctgagactggttactttataaaagaaagaggtttaatggactcacagttccacatggctggggtagcctcacaatcatggcagaagacggaagaagagcaaaggaatgtgttacatggtggcaggcaagagagcttgtgcagtggaactccatttataaaaccatcaggtctcgtgagacttattcactaccactagaacagtatgggggaaaccacccccatgattcaattatttctgtttggccccgcccttgacacgtggggattattacaattcaaggtgagatttgagcgaggacacagccaagccatatctcatatataaaaaatttttatgaaatataaaattattaaatatataaaatatatacatataatatataaaaatatacttattaaatatataaaaatagatacatataaatatataaatatacatgtatatataaaatgttatgtgtgtatatatgtatatgtgtacatacaaatatgtaaatgtaaaaatctaaagaataatttaggttaagcataatgaaattagatgctacttttttaaagtcatattgaaaagatcgtgattatggagcagcaaaaaagttaccctggagtcataagtggttattttccagtttaattaaacatttcttatttcaagtagatacaatgtgctcaaagatacatcaaatatgagattacatactcatagtaataggccaggaggataaatctttttttctccttatttcccactttttgtaaaatgattttgtactattaattactctccatacattattgatacttttagtatttgtggtaagtgaagatacctatctatgaatgcaggataattaataactgaattttccctttaaggaaaaactcatggccttatgagattaattatagattctttgaaaaacgtatgcccttggagttttaaaaatatgcttaaattcataaaaatttacacataactcttcagataactacttgaataagacaagaaatacggatcattataataattttattaatgctttgaaaaaaggtaacttccagaaagaaaagactctcacagaaccatgacttagaattaagtattagacttttgcatcattgcataatattatggaaaggttaacaagtcgttatgtagaagctccagggtttcagagacaaagaagagaatccttccctatgcagtgaaatacactaacccctcatgatgggatttgtaaatctgccaggacgaagctatgtgttctaaaaatagctaaagtctttgagtgtttatttaaaagataactattctcaatggatttttgagtcagttatactgagggatggaaagttcttaaattgctttacaatgtattccagggaaaaaatattgcaattcaaatctctcagagggattccttaatcaactagaatattctggatctcccagttgtcagctactcagcagctggccttatgaaaaaaactagaataaaactggttcatgaatgtgttgcctgggaattttccttttcttgggtcaaaaaacattcctgatcaattacaaataaatctagtctcagaaagttgagctccttttcttaagcatgtgttaagagacatatttttcatatacatttaaaatatactggatgccctgaaaatatgacttgggtttcagcaacaaattctgatttccttgggtcagaaatatgggtctctatcagtcattttctgttttttttttctttttttttttcagattcaattgggcttcacttttttgtaagcaaagatatatagaaagggaaggttgaatgtgttagaattactcatgttctctggtggtacattattgtaacagaagtttattcctccaaactgcttggatgggcacaatttgaacatatgctgaaacagtcctatagacacttgagagttccatacagtttatttgctggtgaaatcatggatggttacacaccgcttcctcattcccttaccttccagatggctctccacacttaccacacatgttgcaggaaacaggttcttgtttatcgtgggtttgctatcaaccaagaaactgatatctaagactgctaaaaaacaaagctagcgtataaagtcttgtataggaaaagtatgttttagaggtaactatgtcctagtattaaatctgagtaggtgagactgaagcttcttaacaatgtatattgtgtatcctctgagtcagcccatagagtctttacatgtactctgaaactagagagggaaaaagccagcaacttccttcctgttctcctttatcaatagtacattttagcctgggagaggaagaataccatcaaaaggaacaattatatgtatgcatagtgtgtgcttgtatatgtgttatatcataggctcgtttcttatattaaacaactcacttattaaaccctgcttattgtaagctctgtaataatacatgtagatatgataataacaataatagaggaatgaaattttccttggaggctttggttaactaaatgtattctcagctgttcttatgaaaaacataaaaatgtgtaagcaatataataattacaaatgccatcaagatggaaattacaattttaaattctgaaaaatatagtctttgctactgaatcacagttttatcaaccatactaaatcattcggtcatcctctacttaataaccaccaccttaaaaattgctgggttcatctcaggaagcataattttgttctagagattcttctctggtcagaaagagagagagggagaggagagagagaaaggagcaaataataaagtgactactactgtccttcctctttaaataacagctcctgggaaggtcagatcctttggctgttttgtcaaagatactcaggaaaagttttcatagagatctctgaactacaggagacttgaaaattaattacatgaaactttatgaattttcattgaagttaaacatcagcacaaccagtattattttcctggagcttttgattagacatttctataccagtttgtctgtcatttcttttttgcagcataaggtttaacagtctaatccctgaattggccagagctgctgcatactcctatgtcaattgtgcactgcacaaccgtagggggtgccattcccactgaatgcatgtgagtagtgtcctctggatttgtcatgtagttaccatgaagttgtcagtctaagcatttttctgtctctaaccttttgttctccatgaagttttgagtgcctttaactattattacattaattataattattgtctaatgtagtgattttccctactaaggtttacatttaggataaatcttcagtcatttcaaaaggattcatatacagtagtgtgtcttcatgtgaaactattgttatttgtgtattgaagcacagtagagaagcccaagaatccagagtattacatacatcagatgaggaaaatgtcaattgtaactcagctagatcttaactttgattggttttgacaaccaaacatagttgattcagtttgtaacttgacaacagaaactgtaggcatttggaaaataatatcaagtcctcttttcaaatctaatacatccttcttgtgtaagaaaatttaattaaattcatttaatcttctgaaaaaaatgctctaaattcatttaagagagttaaaaataaataaatcttttaaaaagcctaagacttgagtgagagaaatgatttgatgttagtctgttagcttcaagaaaaaatgccaagttcttgacctggatagaaggtcctctgtgatgggggctttgcttacctccgtgtcttcacattttatattctccaggccctcagttctgtttcttggaaatatcaggcagttttgggattccatgccttcgcactgctgttcctgccaactgtgatgttctttccctcctcagtcacccaccagctcctcttcatcactcacatccagcactagtgttatccattgcctttccagggaagccttccctgctcttgtccctccatacccctcaccctccaattctcatcaaaaccaaattatctcctgtatagtgccagatctgtagcttatacacaattttattcccatgctcaccaccctgactcactaaatgttaatgatgtgtccctatgtctttttctcatacaaaatcctgctccttcagggtggggactgtgttttagtacagtgctgagatttaggagaaagcagaggattacagaagctctgcaagttgttcaagatgatgcgactaactagtaagccgtggggatggatgcacaccttgatctatgtgacaccaaaacctgtccttaatatccacagtcatgatgtccaaggtcactgtagatgcctgtgtaccaaagcttgttcttcatattgggcgttgtgtccaacgtcaccattggatgcctatgtgtcatttgggaagatgggcgtttctgcagttcttggcagctccgttttctcatggggttgaaattttgtcctgtttttcttacttcaacctctggggagtttcatttttcctggtctactcttaaaaaaaataatttttgtgggtacataggtgtatatatttgtggggtacataagatgttttggtacagacatgcaatgcataataatcacatcatggaaaattggttatccatcccctcaaggatctatcctttgtgttttaaataaaccaattatactcttttagttatttttaaatatacaattaaattattattgactatagtcactctgttgtgctatcaaatgcttggtcttattcattctaacttctttttgtacccattaaccatcctcatctcccctcattccccactacccttcccagcctctagtaaccatccttctactctctatgtccatgagttcaattattttaatttttagctcccacaaataacttagaacatgtaaagtttgtttttctgtgcctggcttatttaagttaacacaatgacctccagttccatccatgttgttgcaaatgacaggatctcaatcttttttatggctgaatagtactccatatgtactatcacattttctttatccattcatctgctgatggacacttaggttgcttccaaatcttggctattatgaatagtgctgcaataaacctgagagtgcaggtaactctttgatatactgatttcctttcttttgaatatatacccagaagtgggattgctggattgtatggtagctctattttcagttttttgaggaagctccaaattgttctccatagtggctgtactaatttacattcctgccaacagtgtatgagggttcccttttctccatatcttagccagcattttttattgcctgtcttttggatataagtcattttaactggggtgagatgatatctcattgtagttttgttttgcatttctctgatgatcagtgttgttgaatacctttccatatgcctgtttgccatttgtcttcttttgagaaatgtcttttcagatcttttgcccagtttttaatcagattattagagtttttcctacagaattgtttgagctccttatgtattccgattattaatcccttgtcagataggtagtttgcaaatattttcttccattctatagtttgtctcttcacttttgggttgttgcctttgctgtgcagaaactttttaacttgatgtgatttcagttgtccagttttgctttggtttcttgtgcttgtggggtattacttaagacacatttccccagacaaatgttctggagagtttccccaatgttttcttgtagtagtttcatagtttgagggcttatatttaattcattttgatttgatttttgtaaatggtgagagatagggatctagtttcattcttttgaatatggacatccagttttcccagcaccattattgaagagactgtctcttccccattgtatgttcgtggcacctttgtcgaaaatgagtttactgtaggtgtgtagatttgtttctgggttctctattctgttccattggtcgatatgtctgtttttatgccagcaccatccagttttggttattacagctctgtcttataatttgaagaacctggcctactcttttactcagtttcatcttttcctaccagagtattccatcttttcagaatacaggcaggctcccatatgcactggactggcaatttgcttttggctttttctctcaataggaccagtgcccatctttatttttctcctccttctggtggccatcttttgactatcaggcaactggtgactgttctcagggttatttgatataattgcacaggtttctagatcagtgcttcagctccttcaagccatttccctcaattcatgctgtgtacaggcatccatatacatatgtacacagatatcctgagtatacattatatacaatttttagtggccctattctacattctactcttctagtgcccatgtttgattttttgttgttactctagaagaagcacacaaaatgtgctcaagatgtgaactgaattatatgaatttaaatctgtgaaaatattaacaattatcccagtgcaagaagacattggtcactattgcctttggttgctcataagaggataaaaaaaaagacactttaactccctttaggtttattgtctttttctagcatggttcagatattaacaatcaaagtgactgaactttagattttttatatgatcttttcttaaaatctgggtaacttttatctttgagtttcttccttcctttgtgaatcatcaccatcttcatcactgccaatctttaagtatttaccaagaactcatcatatatctagtgccataaatatatgaaaatgcttttagaaaatgctctcctccccggtattcacttatgctccaaattggcaaaccctttggtctcagttacacttttggaataatcctctcatcttgagatcatcattatttctattcaataaactagagaattattgtaaaacaaattgggtataccagaaagaagtgggacattttagagaaaatcagaatattcaccataaagctggaattaagcatatgactgattggaactgaatttgttccagttttaaaatatatttttaaaatgtaaaatacacttaacaacaaataatcacttatagttataaaatatgtattctctctagacagtgttctaagtgttttgtacttattaaatcagtaaattctaatagcaattatgtgatatatgtacacactattatgatatccattttctacaggagaaaaccaagggacagaaaggttagctaatagctaatgagtggcagtgccatgattgaaacccaggcagtgtggacccgcagtccttgtccacagtctgacaagactgccccacctggtccatagctgtttcatatacaatgaatgaaaaagctcaataacaatggtaaatccacacttcataataacaattaaactcctgaacttgtaaatatataaaagcagagagatagatgctcatcttcagtggggagggaagggtttgttattcatgttacaataggcaaactatccctcaattttaaatacagaggattctagtgtggttggctgtagataacaagtccacttgcaacagagattggaacattaggaggggttgactgttatggacttgatggtgtccccttcacaaatttctatgttgaaatcctaaacccccagtatctcaggatatggctgtatttggagatagggcctttaaagaggtaactaaattaaaatgaggtaattggtggggcgggggataatccaatatgatgggtgtcattataagaagacaaaatttagacttagacaggtacagaaggaagaccatgtgaagacatagggaaaagatggccatctatataagccaagcagtgaggtctcagaagaaaccaaccctgccaacaccttgatatgggacttttagcttctagaattgtcagaaataaatttctgttgcttaagctacagagcaaacctcgctccgtaacctgttaggaaccagaccatgcagcaatgagcattgctgcctgagccccgcctcctgtcagatcagcagcagcattagattctcataggaatgggaaaccaattgtgaactgtgcatgtgaggaatctaggttgtttgctccttatgagaacctaactaatgcctgaggatctgaggtggaacagtttcatcctgaaactatgcacccctctccagccccccagtccatggaaaaattgtattccatgaaaccagtacctggtgccaaaaaggttggggaccctggcttaagccaccctgtctgtggtgctttgtcatggcagccctagcagactaatacagggacctaggaggagaaagctaacgtttgagtttcctagtgcaaaactcatcaggacacaaacttaaaactccacaattttctcttgatctttggcagaaaaatgtaatttaattaggatgcatttttatgtaaagtggggtgcccttggccacatgacttgttctttatgtgggcagataggacagtctccttaaccagcgtgattagaatttcactagcttatcgctcaacaaatacacacattgttactccactggcttctgcctttcccagatatacctgtcataatataatgtaattaaaataattataattgtctgaccttgaaattactaattagcatgatggtcagtcctttgataattttctccagaaaagtcttgttaaaatgggcctgcataaaaagctgggggcaatgaactagttataaaaggataggctaatttttggttaagttgactattccttgccagaattaagaagttggaagatgaggtttcttgggggtggttagtcatagtcctgggaaattgggacctaggctgaggggagtaggaattcagtggcactcaattaattttttcattcaaaaaacacaaacaaagcctttgattcaacaaacacaaacaaaatcttgctttggccgggccctgtgctaactcctgggatgcctctatgaacatgatagaagcagctactgcattcagagtttatgttcttatgggagatacagatgttacaaagtacaagccataattagttattttggcttgtactttgtagagaatgaaaaataattttatttaattcattatcttgctgaaggttggcactttttagcccgtgctgtccaatgcagaaagcactagccataggtgtgctattttaagtaatacaaaataattacaattgaataaaattagatattccattcctcaggggcattcgtcacatttcaagtgctcagtagccacatgtggctagtgactaccataatggacaacagagatacagaatgtttctgcactgctgaaagtttcaccagagaatgctatctgggctctagagttgtgccagacctgcaaagtcaagaaagagggcccttagcttaattccttagagaacagaagatatatatatttatatctaccaaaatagtccacttttggctgcaggccatagtataaatctcatcttagtctggccttcaaaatgaagaatgggctggttttaaaccaaggacagatttcctttcctcttagtcttatgagtattggggttttgcattttgtgagtgctcatttttgtatgtatgagcaatttgtccataggaactaggggatttttatattttttccttttatttaaaatatatgactacataaaataaacaacatgtggtttacagatatgaggagtattggaatctgttactttaaaatagtatagcaatgtttggacttttcacagctgaaagaattaaattcagcttcagtaccaccaattcccattttttttcaagtacaagagaaaaaagaagaaaagaatatgtgggtggagaataaggaaatcagctgtgttggtttaatacccttgaaggtgacattagtagaagactttattaaaacatgcaacctgaagctgaggattataaaatataatatgtcatggtgggagatatgctttggctgccacacctaaaggtcactctttgaagggagctgagacagctgccaggatccattgatttctttctagtactaaaacatcctctggcaggtgtcagcctgggtgtgtgaacaaaaaaatatggaaaattaaagagtaagcaaaaatgggccatgggatcctcctagtagaccgagcagaatgctccagtgtttgttctgaacagacgtgtaaatttttgctttagcgacacaacagatacatgaagtgttcaaatattagtcaacatatattttctttagtggaatatagcttctcaagtctctaggataacaaagttttaaaatcctgtctaggtgtatataattctttaatttgtttctagtggggctactccctcaggttaagtaggacactttccctacaatagatttcatttttctttgattagtttccacttactccttctgctcctaacatggccatccctctgcagttctccaaatatcccatgtgtgtgcttgcctctatgtctctgcatacaccatttctcttctgtgcttaccccccaactcctctacaatctagaagactcagccttgagatctttttgaacaagaattgcatttatgatgataaatctgtgcctgtcctacaaaaaaagcccttgtctccttctgaggtgattttgcttagtggctaatcttttcaactttttgtctttaggttttgcagaaaatgagaaaagatggaaagagtgagaggtcacatgatttgctgcctgggctgtggggaccacccaggggctgtgtggagggaaccatccctacgttagcgctgagctcataaccatgacctcaacctagattccaaatctaggtgctcacattcatttcacaccattagcaagttaaaaatgatagagccaggccaagcgcggtggctcattcctgtaatcccagcactttgggaggttgaagtgggcagatcccttgagctcaggagttccagtccagcctgggtaacctggtgagaccccagctctacaaaaaatacaaaaattagctgggcatggtggcacatatctatagtctcagcttcttgggaggctgaggagagagtcgcttgagtcttggagggtgaggctgcagtgagacatgattgcacctctgcacatcggcctgtgtgacagagtgagaccctgtctcaaacaacaacaacaagatagagccatttactaagcagattggcaggtgagggacgctggttttagctagtacagtgaatgagtgtgtgagtgtgtgtgtgtgtgtgtgtgtggggggtgtattcttagtcccttttacactgacagttgaaaaactgacctttgcccttctctctcccatgttatttctgatgttagtaggcagtttgtagcacagcaggatggaagagttgcaaagggaattgtctatggggtgaaccttttcaattgcccttccatccacataccctctttactgtgaataatcataaatgcataatgataacattttccacatgctaaatcatgctaatgacccctaccaagtagaggaaagaatgttgtcttataataccaacagattatttaaacctgagagctttacatcatgttagattaagttgtgtatattaaaattttccaaacagtaagtataaagatactgtcttatacatataagaggtatggctattttaacatattttttaaattatatgaaataaactttattggacatagttttacgttaccattttttctctctttcaccaaattgtgaaagcaaatagctagatatgctttctccctttgaagaggcatgacagtttcaggttttgctaagaaagatagtttccatctgaaaatgtgtgtacatagtgtttacttctaatttaaatgcctatttacacaggttggggatacaccaatgttttttgatgatgtggtaagttttcaaaatctatttgaggtcatttttatatgcttagaatgacttaggtgcaaatctacatggaagcagaggaataaaccacatggttttagaagccatttctgatcattggagcacaagctttttgtggacagcaggcactccctacctaagtccaaagcaggggagccacctgctggacagtgtgaaaaatcttcattttctggaggtagtcatccctgcttttttacttttaagtttaggtagatttacttacatataaatttatgtactttttattttgctgagtaaatttctcacttcacacaaataaagcggctctaaaataaggagaaaaaaattaggatgctatgaaacacaaatttgaacaacgatcagtactagaagtagaggcttttagtcattccattttgtattttgtctttttcctttcattcgtagttcagcctaactgcatttatattgtaaaccaaaaataaaattctaagccccttaaccgactgaatggacctgtcctatggggacaaggggattccaaaaaattccaaaaagctagttcaggccatgatgggaacctgatggtgtaaccacccagttgggttcacctttcatgctacctagaaagagctgattcatctagacaggggaatcgcaatagagaaagaataattcgcacagagccagctgtgcgggaatctggagttttattattgctccaatctgtctccccaggatcagagtttttaaagacaatttgtgggaggggaggggcagtgagtcagggactgctgattggctgggtcggagatgaaattatggagaggaaatcatggggcgttactgtcttcttgcgcttagtccgttcctgggtgggcatcacaggatcagatgggccaatttcttgatatggtggtgccagttgatccgtcaagtgcagggtctgcaaaacttctcaagtactgatcttaggagcagtttagggagggtcagaatcttgtagcctccagctgcatgactcctaaaccataatttctaatcttgtggctactgttagtagtcaagaaggaggtttattttaggaaagggatgttattgttcttgttttaaaccataaactataagttcttcccaaagttagttcagcctatgcccagcttggaggttagaggcaagatggagtcatttaagttggatctctttcactgtctcagtcataattttgcaaaggcagtttcaatggtaaaagggaattggatacgctgcattatactttcctccctttggaattcaggctgaactgatcggccttaaaattaaaacagagatcttaagacacagtaggctctttgtagcaataagataccaaattccaacctgactccagtatagcatcacatgacagatagcaggccctgagaaaaatcaagtattttaccccaaaatatatttctttgacatatttttaaatggccctgcaaagctatctcttgtgggggaaatttacctcctttagagaagccccttccctttccaggtctttttctgatcctgaagagtttagctgagagtctggtaccttttaaaggtatgaataggaagcatttgccatctattgcctctaaggatggccacctataagacttcatctacataataagaccgttggtctccaacaacaccccttatctttgcccagacactcctttctattgattccaggttttttagataataacttaaacccttcaaccaattgccaatcagaaaaatctttgaatccacctatgacctgtaagtctcctgcttcgagttgttctgcctttccctaccaaaccatgattgatgtcttatgtcctcctaaaatttaaaatatcaaactgtaacccaacctccttggccacatgttctcaggacctcctgaggctgtgtcacaggtcatggtcctcacatttggctcagaataaatctcttcaaatattttacagaatttggcttgcttttttcatcaacaatatgtatacaaacgggcttttctaaaggactttcagccctccttcagctcatctccttcctctttctatctcctcgcctacatagtcaaacttcttaacagggttgtttatacttgccgaatccacttccttacctcccactcacttcttagccaactttaatctttcttcttccccgacactccattaaatcattctcaccaaggtcaccaataaccaccttgtcacaaaatctcatggacacttttccagtttttatcttttttgactagttgggaacattctacgtggctaagcactccctactttttattttttttaatttttttgagacagggtcttgctctgtcacccaggctggactgtggtggcatgatcatggctcactgcagcctcaacctgctgggctcaagcaatcctcctgcttcagcctcccaagtagctgggactacatgcacatgccaccacaccctgctaattttatgttttgtagagatagaatattgtgatgtttcccaggctgactccccacttcttgcaacactgcttctcttgatttctgggacaccacccccttctctcttcttcctacatctctgactctttcttcccagaatcgtttgcaggttccctttcctctgctattctgttaaatgctggtatttcttagggttctagcttaggctatcttctcactccaccttctgtccctgggggacacagttcatgcaaagggttttgattatcttcaccatgctgtcaaatctcaagtgtgtatttttggcccaggtgtcactctctttatctcttgatgatccctgctcatcctcccatatagtttatatatcaaattacctcccaggcattgtacctgggaggtcactcagccacagcaaggtcggcatgtctccagctgtgcttatccctatccatatgtcctgcttatcctcagtgacacctctggaattcctgcttgaatgaataaatgacaactcagagttatccaaacctaaatcctgggggttatccttgatccttttcttaactctccacctctaattggttagcaagcaccgttgggtcaacctccttaatacctccctaggaaacttccattcccatagccgtcaccttagttatcttcatttatcacctgagttagtgaaaagtcatttctcctctatccttttcccactccatagcatagagctggagtgatctttttgaatgtaaagctggtcatggccattctcccttcctaaagcccttccagggcttcccacagctccttcttaacttctcttctgaaactcattgtggcctgtcttctcagctcccctccttcccctccagcttcgtctctcattgccttcttcttccatgcactactccagccacatggaactttctccacttcctcagtggcaccagggatgctttcatgctgagtagtcacatggactgtcccttcttccttgaaagtgtgtaaccctgcttgtacccctgctccctgggagcccccatcctgttgttttcacactgcatggggcactgttatctgtacttcaggtgtttgctcaggtacggagtcttcaggatgccttcatggacacctcaccttctcctgcctcccatcttcaacagagttaggtatccctgtacgtattcccacagaactctgctattccactatcatagcactttaattgcttttttatctttcacgagacagtctctattattgtaagcaattaggtgatgaattttaacatagcaattttaacctgagccccaattaataaacagtagacatttagcatatgaggtcaaatcaaagaacgtctcgtcaaatccccatgttttggagaaaaggaaactgctgcccacaggagttagggacatttccaaagtcacaaagtcaattcataacttattaatcattcttcccactgcagacatcagccataacccctattctttctatccttttgactgattctggttttctctgcaagaagcttgaaagccttagccaggacatggtttaaactctattttgccttggttatcaagcaatcaaatggtgtggttaaaattgtagcaagcctgtcatttctcatttaaaataaaacgggactcattcaggcttcttgaagtgagactgcatgtgacgatgcagggaacacatctcctagaaagaagaggagccactgaatgggcagcctcatggaatctcaggatagaagacccttcacatttgaagcaggctttagaggactgtgttatcttttccttttccatttcccctttccttgccttaagagcaagaattgtagattttcactctagtgctgtgggcttacaggggctcagctctgctggtcttttattcctctctatattttctagcacttcattctgttcacaaccaactaagactcttagaatttttcagtttcagtctcagaaagagttaatccaattggtttgtctaattgctgtcattactgcctggcatcaggacatctcataggtcactggtcagctactgattggccacacttgggctgtggtgaatccttggtccaaccagttttggctgtggtggttggttcttaccttttagagcagggccattccaactcaaggtcagcgtggggctgttttctttaccagaggtctgtggacatggacagcattgcataaggcctgacaaacttctggattctctacatggtgatagtttaaagtttctttaaaaatgtgtttttttgggggggggagtccacatattcaaagttctaagaaatctcaactactgacatattaaggaattgaatatgaatgtcctctcccactagatactgatagtttgattttcacagtaagatattctgggaagaaatctggataggaaggattagggaggccttatcatgacactcacaaagttgaatgggtttggtgaatgtatggtgaattttttccaggcatatatacttacaaagttgatttaaaaataagaatgtagattctggatattagccctttgtcagatgagtaggttgcgaaaattttctcccatgttgtaggttgcctgttcactctgatggtagtttcttttgctgtgcagaagctctttagtttaattagaccccatttgtcaattttggcttttgttgccattgcttttggtgttttggacatgaagtccttgcccatgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttgttaaatagggaatcctttccccattgcttgtttttctcagatttgtcaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgcatattctcactcataggtgggaattgaacaatgagatcacatggacacatgaaggggaataccacactctggggactgtggtggggtggggggaggggggagggatagcattaggagatatacctaaggctagatgacgagttagtgggtgcagcgcaccagcatggcacatgtatacatatgtaactaacctgcacaatgtgcacatgtaccctaaaacttaaagtataataaaaaaaaaaaacttccaagtaaaagaaatctaaaaaaaaaaaaaaaataagaatgtaagagtgatggtatttgacatttagaagaaatgttttgacaagtgcatgtgatgatttaatggtgcatattccataaagtcaacaggagtgaagctgtggaaatgtttgtctttctgagtgagtggtatttactgctgtgaatttgctgttccatttcccaatacactctccctcactcatgcttttactctaacttcacgtaactgagttgctattttcaatgatgctagtaattaatgtgtgtttggattctggatttttaaaaaagtaataagatgttttgggacaactggggaaatttaatatgtactgtatatcagatgcaattcctgagtgaatgttaatttctttggggttaataagagtattgtagttatacagaatgtcctcattttcatggtctgcacactgaggtatttagggtgaagtatacattgttggatagatggggataggtaagttgatcaagccaacacgacacaatctgaaaaattgggaaatatggatgctactcattcaacttttgtgtagggttgaaaaatctttaaataatataaaaagttggaggaaaaagtgtaactagtagtctgttggtgtagatggcttgagtctgagatctgaaattggagccagtctcagattagagaaaataggtcttgactttccttgcagtaacattaatctggtgtttaaatgaatgctttgctgaatctggggcaccgagagtgaatatctcattaatgaccaaatctccaaaccagtcattgtggaggaagctgagttggccacatccttgatttaactaagaagtagcatgttttattttatagctgccttagcctcattcattaaaacctgactcattgggcggagggtggaagaagttgcccctttagaaatatcttgctaataactctttggccacttcagctaacacagaacctggaactcatgccagcatagaagggtggctacaaggctatgggatgggccagccgtacacatgccatgattcactctcaaagaggacaatttcagcctctttaaaagcattatgatttagcagagaataaagaataaatgtccttggtaaaaggacatatctagaccagatgtagtacaactgtcattggctgtagggaatgccatgcacgtagaaggcagggtgaattgtgcccttggaattgtgtaacacgggacagatgtcatgaaaaacaatttacttgctgaaatccagcactgtggaggtggtgaagcagctgaagccatttttgtgatcagttcactctatggtatactgttgttattgtatttgcacttttgttctggcatgtttgcagaattactttttggacggatcaagtaaccaataatttgagcaacaatttaacagtaactttttagagtgaaaccttaccaaccaaataccagaatgtatttaaaaaatattttgctaatatttgtaactatcttgatagcctttgctctggggtttgggccatcctctgtctctcaagctgttataaatgatattttttgaaatgggaatagcatgagttggtcaggtagagatttctatagaagctccttctgtattcggcttatgacactcatggcggtagtatgaattcagatctcagggtcatttattatccatggaaagttaatttgagatgttggaacttttaaacagtgtttgtttattgtgctaatcacgatctgttactaaatttcatttgaaatgcaattaattaccttcatcaccttgctaaagattgacattaatattctgtcctatcctattagttctgttgacacagagggagatgatcacaataatgggaaggaaagagcagagagcaagggaataaacaagcagtgactgctattattttattgaatggttcttttgtcaaaatgactgcaagaaaattcttagaataccagtatcatcacacaaacctaaattcataaggcttcctgcagttgaatcatatttttaaagtttagcttggggttttctattattcagctcactggtgttgaagcaattttgttgacattttctgtaagtggattaggcttgcagtcatttgcccaaagcagacagatggcttcttaaacagagcacccccgtaggaacctatcttatggtatcttcagaaataaaacaggtctgtcacaaaagataatgtttggcattaatttcttttagtgacaaatgatttcagctcatttttactttctctgctggcttaaatgaaacagctgttttacattttttattccaatagtgagcaacgctttggtgtttgacactgaacaatgttgtagcctctaaattatgagtaagaaaataagcttttgagaggggaggatgatgccttttgggatcccccaaggaaagttgccacattaatgcaattgtcatttttattttaaacatggggtctttttttggactaatgagtaatgcaatcctggcttttattgtcgcattttattctctccactttgtcaacttgtctttttaagtttcaagatgtttttgtttcctcacatttttatgaggcaaaggacagtggacttatctacaacattgttatttctgtttatataatagaataataattgctaacgatcattagagttttccatgtatggcaggcattgttctaaagaatttagaggtattatctctcttaatctcacaaaaaatctatgaggtgagtacaattattatagccattttatggatgaggaaactgaggcacccagtgatcttgcccaaggtcaaaaagctagtaagtcttggagccaggatttgagcccaggtacagtaagagtggagcttatgctgtaaattcacttataagaatggcaatatggttacgattcaaagtctctagtctagagactagagactagtctagattgttattctaagagagaaatgaggaatccttagaatcagatttattccttcatcactcctggggttccactcgtcagctagtgtgttctgccatcttgggcagccagcttatgtggaaggcttgtgggggctcatgggtgctgcaaggagaaatcagtacaggggccctgagaattgactgatgaggcctcacattagtagcatccttcaaaacgttcagtggatgcctgtcatgaatatgattcattaataatcttctttttggatctgagccatcagggcttatgacgatacctttgaagtgaaaaccagtccttttttccagcacttatcccactcatgaatcctctatcattgcttttgtatttcagttttccgaaaatctggctcagattaaaattattaaatgcttccaaaccctgtacccacactgaagacaaaagttagaaatcaaaatatcagcacaaggatagtatttatgtctgggacatttgtgaagttctatcaagaaattcttttataaaccaaagaagtcttaagctagtttttcttttctatttgatcaaatagatctatttgatgacatgtgcaccatatcatgtaatgtacctaaattaaataaaaaaacacaaaaaaacaaataaacaatatagagattaagaaaaacaactcttggcctgggaagccggcattattcatttccttcacacttatttctcgtgtgaacctgggcaatgtatttttttagctttcctgtgtccatttattcacctgaaggttataaaaggagtccttcgaatggctcgaaaatttgaaataattactaagaacggttatttagcagatctcagtgatactgtcactaaatgacactttattgttttccactttcagtgtttctttcagtataaatgtcaatgaaacaaaataaatcctaaatagagaaaacgtaaggaaaaatggaatgtattaggcaatttggtgctgtgccataaaggcggtaaccttccagaacactctcccataccatgtatatctgtatctgtaagactggaggaggattcttgcctctcctccaggcaagcataaaaaaatccttgtactgtgtttcactgatcataagatgccaagaaataaatgaagatgcctgctcatcttgcaaatcattgctttcttgttactttttatggggaggcttgtctaatctcctagtcctcacagcaatacattcttttccctcaagtacttagcataatttaaggttagatataactttatttttgtggttattttatatatacctgtatcccacactagacttaggttccgtaggggcagggatgatgtctgtgctcacttttgtaacccccagagtccagcctggtgattctcaatgggtgcagtactgccccctaggctgtgttctgggaagttgtagaggtgattgggaggattctcctggcatttagtggaaacagacaggaatatttgatgtcatgctctgggcagggcagtacaacatgatgaaaaatgtcctgtgtcctgcaagatttctgttaagtcctgcctgagtaaaccctctgtattagtcagttgtcatactgctataaagaactacgtgaaactgggtaatttataaagaaaagaggtttttttgttttgttttgttttgttttctcagtccttcacgctgtacaggaggcatggctggggaggcctcagtgaacttacagtcatggcataaggcaaaagggaagcaagcacatcttcacatggtggcaggaaagagaaacagctaaggggaagtgttacacactttcaaacaaccagatctcctgagaacttactatcacaagaacaacaaggaggaaatctgcccctttgatccattcacctcccaccaaatcccctcctgcaacaccagggtttacaattcaacatgagatttgggtggggacacagagccaaaccatatcaccctctaaaatacaaatcagaatactttagtatatgatattaattaattattattattttttacaagaagttgtttgaaggccagtacttgagtaaaaggtagttattgagaggtaagtctaaatgaaataaagacattgtttccaaattattgaataatttactcaccttgggtattttgtccacttgaccatataattgctacacagtaatattggaacaaattgggcagtcagataatggttttaacctgataccttattttttattattgataatccatggtgggcatccgcctgggccccacaaagtatcagctggtattatcaatcacaagaacaatgacctttggagtacttttaaagatttggcagttttgctgggcgtggtggctcacacctgtaatcccagaactttgggaggccaaggcaggtggatcacctgaggtcaggagtttgagaccagcctgactaacatggagaaactccatctctactaaaaatacaaaatcaactgggtctggtggcctgtacctgtaatcccagctactcaggaggctgaggcaggagaatcgcttgaacccaggatgtggaggttgctgtgagccaagatcgcaccattgcactccagcctgggcaacaagagcaaaactccgtctcaaaataaaaaaaaaaagatttggcagttttgatgtggtgtatggacattatttacttcctcatttatgggattatcagctttttctttccacagtgagggtttgtatttgtcttggcatgttatgccgaccttaattgaggttgtttctttccttcttttattctatgcaaatacaactagtctattgccattatttgttttcatactagtgtctgtctctacatttgcattatcattttccattaaatatgtattttttgagtggaatggcatctgatcttatttctctttcatatctaattgcattcatattaagtacaggcatctgcctacttcaggtttctggtgtgcctgcctgacattcacatatggcaatacatgttattttattttaaatgaccattccctttttctcctttatattacagctagggtattatatttattttaataatacatgaataggttatattatctatgaatttaagtttatgaaaataaagaaagccttacaaagtatttgtttcaaagggttggttttgatagattgagaacctcaggccaaagtctggtatacagtaattgtttaataaatatttgtttgctggataagtgaataaaatgaaaactaaggtgcaagtcctcattaatagctaagagaccaccattgtttccaaagcacagggaagagatgggtgtatctcagttcacatatacatagctttgaacaaggtataacagggacaataaatgagaatttgaaacattaaatttcatacttttttttttttccccgagatggagtcatgctctgtcacccaggctggagggcagtggtgcgatcttggctcaatgcagcctccacctcctgggttcaagcaattttcctgcctcagcctcctgagtagctgggattacaggtgcctaacaacacacccagctaatttttgttcttttagtagagacggagtttcaccatgttggccgcgcctggcccatacttcttttttaagctctggtcaacaagtgcatctcaatgcagtgggttttattgagtgatacagatgttttccaccagtaacaggacctattgtcagcattgttgccactggattattaatggttttttaaattatattattattagtgagtagtgtttaaataatgttgaaagacttcacttatatgtagaattctatatatacaagaacataaaattgtctccttatattaaaactattttaaaaaacatggctaatacaaaggttttctgcttaaaatgcagttaattactattttgaagtaactagggtccttcatttcttcaacattcaagttaaccaagacttcttgataaataaagctattgtaacaaagaaagcttgataggaaagctattgtaacaatgcaggtgttatttgagaaagaaatgtggtaaaagaagatctttcaaatttctttcaaatttaattttcattatgttgaattttaacagagtatgatttcaaaattttctgagcctttcatatggcttattaaacatgtcatctgctgcattttacaattttctgtggaccctttggcattaaattattcttaacatttctttaaagtgtcttctatactttataaattattttttcttgagaattagattctcaggaactaaaaagatttatttatattcagtttccatagttttcagaagtattcaattaatcagagtttgtgaccaatcctaaaatacatcctttatgtaactaattaaaaaattaactttatatacagttacaaaatctaatgtctcaggtgagcatgtccagtgtaattctcttcatgttcctgtacagattatttttattgcattatataataaagatttgaaaagcagagtttcatttgttttgggtttagagtttcagaagaataacagataaagcttcattcagccaagactgttagaacagaactactctacgactattcatccatatttcttgagtgttcatggagtaaaaatttaactttttaaatagcaagtagaatgcagttgaaatatttggttgctgaggtgttgcaaaacagtaaatctgagcattgataacttagtgcagtggacacttctatttttgtgcaaaattaagttatattatatgcaatttcctaatagctgcacctttgtgccttttaactcttgttaacatcttgtatataattcctacacagataggccttcattctagagagcaagaattccaggccatctttgaatagtttcacccagttttccaaacagcgtaacataccaagagtgtaacatcaaaaaaaaaaaaaaaaaagtctaacatgacatcaaaacatttttgatttgttgttttaatttctcaaatgaaggacattgtagcagttgttttacctcttcagagcaaaggattaaacttcttaaatgatagagtcccaacggatggtttttgaattagtaagatggcagttgtgcacagccctccacagtatggtccatcaatggaccaaataaataactactcatcccactatgatgtctgtgactggtttctactgcagcactgtccaagggtgattctactgtgggtatggactctcccatggataaaagaatatcagaaaacccagtctgctgatgagtgtgggctcaaaaatactcacacgagttgacttggagacagagctgcatttgtttatgtgtgtagttttgtatatgtgagggttttcctattcccagagtcccaattagctgctttaaatatttgtggtgtgctctgaaacaacccactcatttcctttacacttgatgagaacactagttatgatgttctcctgctcttttgtgtactaatatcacaagggatagtgcggttcatgggaaaagtgggtgtgaaggagcctgggatgtcttttgtgaataattctgccagactgtagtcaaaaccattttcattggtggggggaggactgcatttttttggtaaaaatggaagtaacagaaatcctaaatatcttttgatgggttataagatatattactaaaagataatttatatttagaattctaccctattttatggttaggatataatgagatgtatttgaactggtttacgtttagtatattaagtgttcagtaaatgttagctgctgtttagtgttgtgacaatatttcttgtcagtagtaaatttattagtagtaatcaaaattgtggtgatatatcaccacagcaatgcacggcagcccaatttgcaatctaaattgcatcagttatttcctgatttctagataatgtactttaattataatttaatgcagttggaaagatttaataaggaatgcttaatgtttgttttttaaatattcactaattatcactcatttttaaattcagaatttctataatgatctctgtggctttgcatgagtccatgttactttctaaatgtgttggacctgccagtggaaccttacattcagaagccaaatcactgtggaggctaaatggtggccattgctcttgggacttctattagtcttgttgtcccatcagcatcagtctacctgaggcgctctctattaccctcactttcctttgagttaaagcatccttctcttttttttttttcatgaaggatccccagtaccagaggatacttcaaatccccatgagattgctagtatagaaatgccggcagcagcttgacatttttttttcaagttgagtgttcagtggtcaacttgtacattaattctgcatttcatgccataacaatcctaaacttattttagtatacaagaggtgtttccatttctatatcaccaaataaaatgaattctcctggggttcctcctcttcccttaagacctctgtttagggagaataagattaaaacactttcttaagaatgacttgttaggttactctttaaatatatactatagacgaatacctttaaatggcttggctgacctgaataccatggtgggtgtcggggggtggtttttgggatgaaactggatcaacctcagatcaacaggcattagattctcataaggaatacacaacctagatcccttgcaggctcagttcacaatagggttcacactcctgagaatctaatgtcgctgctgatgtgacaggagtgggagctcaggcagtaatgctcactcacccactgctcacgtcctgctgtgcagcctggtttctcacaggtcacagggactggtatcagtccatggccccagggttggggacacctgctgtacctaatatattttggaggaaatgatacacaggacaaagacgtttagagggagatctggtataagctggctggttaagagaagtttgggggtgtttgtgacagagtagagagaaagagattgctagatgattagggaaaattgctgcatataaaatgggaaaaaagtcagcatgccaagggaaaatgccagggtggtggttgttaacaatcaaattcaccttctacaattttcaccagaatgtgtcttttctgattctggtgccttgattcggaagacccaaagaagagatgcaggttgtgattcctggaaccacagaacagaaagatgactgctattcctccttcataaaaaaagagaaaacagaagtttatatcatgtttcaatgtacactcttcacaacacagcctttcagttttgcttcttttattagttaatagtttacctatttttttttttcttgcctatatggtacagccagtgtgtgttgtctccagggttatcaggagatgatgtagttgtgttagttatgcactggtacaaactgtttcctcccattggccattgttttctacagagactgacttctatttaccagaaatggcacagtctggcatttggatgccacctcttagaaccaatgagatgacattctggattattaaaatatgtttcatgccatgctgtgggaaaaggggatgtgagaattttatgcgttagtaggataaaatgatgtttttgtacgtttcactgttctcttgcaattaggaaagttgccagttttgctactgctatgcttttaaaattcttgatgaaactttcaaaactaaatgaaaagggaacacttaaaagtaatactctgaaaatgaaggaggatatagtctcattactaatagattttttataaatggaaagattcctttaaaaatatagtagtacatatacattatacatatctctgtaaaacagactctggtagatgcattttaaatgttagtcaaatttttaataaaatatagatagtaccaagatacttattatatatagtagcagataatgttaaccactttctaaatcaccttatatcattgtgattcctatacttatgatcatttaaatcataaagagctcttcaacatattgtctttaatcttagaactgtaaggaaggctgaaggatattttcatcatttttgcagaagagaaaatggcccagataaaaattggttgaagatgctccaaccctcgtccctgctagtgtgttcttgctctgccctgtcttcctgattctggatgctatctctaaattgtgtcaggctgtgtcacatgggcaatgcttttctttttatctgcgttgcttccatgggtaacaatgaataggagtctctagggtgccctgcagagagtgcctgctttgctgttaaaagatgcctatcaggtagtggttaaaaccacagaccccggagccagctgctggattttaagctccagctctaccacttagcagctgtatgactttgggaagggtgactgtgctctgggcctcagtttttttaatcagtaaattgagaataatgaaagtacccatctcatagggatgttgtaatgaatgattgaatgaacatgtataaagcacaaagagtgaccacactgagcaagcacttcatatgttggtctgttattattattactgaagagttgcacttttcaaagtggatgtgacttcacttttttttttaaatttatgttctgggatacatgtgcagaatgtgcagttttgttgagcagactcattcgtgatgtctatagtgttaagaacagacttcccaaagtctgctggtgtagtaaatattttttctttagaaaatacatctctcactgacagagtctttaggctctaatctctagtctttagtctcagactagattgtaaacatggtgtggggaatagagcattgatgcaggaggccaaaggcctgaactttagtcccagctcagcgattaaccagctgtgaccttgggacagtcaattaacctcatcaggctcagcttcatttctcctcaggagaaggcaaaactgtccacctccaactcttcttccaaaatcccataccataattgatgtacttgagaagaagttcgctttaacacaaacatcaggcaaagcccaactatttaatcatcccatataattaaaagctgctattagaaggatttagctattttttacagaggatagaattggcaagtgcatatttaggttttgagaaataaaatattccaagcttttgtaaaatacaagtttcttcatacaccctaaggaaaaagcatttactggcctttcataaaataggtaaattatcctttctctgagcctctgctttgtagaataatgctccagcaatcgtcataaccccatatccacccatattgtcctttcaaggtcacactttcaggcactgccatgagaatggagaggagagggaagaagctacttcttcctctgtctatgggccatagacacctgtccctgcttccccacactcagtcattcagcccttgggccagtatcagtatacgcactttatcttcataacagtgaactaaaataagaaataaaaatagcaggaaaagatctctgttgggcactgatgtaaatgacagctaatgtgttcctgcaatcctcatttcctttttgttttgcctctggagactctttttctccatctgccaggtgggaacatcatcttcaggatgatggaaaaggcagaagtaatgtgggtgactgataatttaacaacaggcagattgcaaggatgacccagtatattaaaaaccagctcaccaagcataagggtatgtgacttactttacagaagacactttgctttgtaagctcttgtacagagggggagattttattttcacttctttaaggaagagcttctttccttgttttctcccaagactaggaatgctggatctgggcggggtaggtattgcagcagtgtgcagagtctcagaccatggtgatggaagagttgatgtcctcagcacataaagaggaggattcctcacaataggaatctcaacggactgccagcaattgcatagccagctggtcaggctcaggttgaggtacttggcttaacaagcaaagtcacttaataatgttagaaaagaaccttgggttaaaccctggaaaagtgagcttgcaggtctgggtctgtttccttattcagcaatgggcagtaagaacatagagtgatgtcactcagcacatgcctggcccataactgtcttctttgatgcctgtttttttctgtttgtagggccaaggagatctgttgaagaatgccaagaatgaagctatagaaaacatgaagcagatccagctggcatgcctgtcctgtggactgagtaaagcccccagcagcagtgctgaggccaagagcaagcgcagcctggaagccatagaggagaaggaaagtagtgaggagaatgggaagctgtgactctgggcattatcgacacgttcacccatcttatcaaggactctggtttctcattcttgttttctttctttaaatgttttataagttcacaaaatggtgccctatatggggtattggacatagatattttcacaatgtcagtatttcagtgtagttaatttatctaaattaaagcctttagtatcagtgttttaaattctgagacatgtgtcaacacccctgtgtggatgcctgtggaagagtgtgtgtgtgtgtgtgtgtgtgtgtgtgtggcagagagagagaaagagagagagagagagaaattctgttaaaatctattctgtgttgcattattcatttagtgagttattccttgatcattttgggacaattgttttaatctgaaattctaaagagcacttactgtaacctgttgctgtgtttaatttgacttctctgcctttgacatttaatttagtgatcttagcatagcttattattgaaggaagccaaatttatcaaagcatagatgttttggtagattaaatatagattagaaaaattcctaagaatcagagtagaaataaaagtgaatgaaagattaaacagatgatgagaatttctaaaaagattagcaaggtcatttcttcagtcagaaaactttaaaaaatatttattaaataaaatcaatttttaggaagttttctgtagtcatttactaaacatatgatttcactagaaaagctgatcataagtgaatttatacctacctgtgtggtactctgaaacacactgaaagctctgttgcaattaggattttgatgtgacaataatattgttgtataatttcgagatttgtaggaaggtctcattcttccaagctgagagtctagcactcattttctataacagatatggcagcttagaggtgttggctttgtttggatgtaatttagggtactaaatttaaatttaaagatattgttcaaacaatatcatatcatcacattgagctgatataaattctgtgggtccgataatatctttgtgataatttaagagctaaccagttaccacacatctatgatataaccctaacacacacagaaaagcatacatgcaaaaagaaatgactaattagggtacatttataattgcatctaggtaatttttaccctaatgtcttcataaagtacttgagtgtaatgtttgttacctccaacagaactaaatgttctatggttatgaaagaatatatttatttaaagcattgcttttattttgaaaagcttcttaattaatttgattaacaaatatgctaatttggggaaacctagagaagataattgttgaaattttgcaaatataaacatctcctatagcttctgtgttatttctgacttcttaacactattatgtttatgttgcacattactgaaagagtaaagatatgaaaaaaacacttattgttttcttttattgtgaattgaaaaagcaaagctaatgaaaatgggttactacatcaaaaatatcttaaagagtttgctatttccatggaccagatatgatgaaattattccctgggtttaaaactgggcactcgaggaggaggtacctgaagtcatttgaaggcaagtttccaatgatgctacaatggcctgaaaaaatttctttaccctctgttatatttaacttgctggtaggaggaatagtggaatgcaggtgttaagccctttgtggtgaaaaagaggttctatagacagaaacaaaacccaccttacatcagctgattggttgattttactagtgtacctcttcatctacttgaattctatttggtaaatccatgtctttactggatatacagttaggtgggaagaggagataaaggatgacaaactctcaaacaatatttatacatttatttactccagggtcaaatccaatccttggaagtagcttctctagtttattttatttgtcccagagctctactcacacttaggacccacccaaaaattctcaaaaacgtaatatggattctgcctcatctgatgctatttctggcagtgggttgtcagccatactctgcttcattccactgggtgtccttgctagatggggagtgagatgtggagcagggaggagctttggattctgggagtggaggtggcaagggaaaagtctcctagtctcctgtgatgttcctgcctccagatagaatagcaaaaacaaacaatttttttttgtgtattatgcctccatgacattgttacattctatgaggagcatctgtctcctttctagacttgaactgtggtagaaaaagcccccttctctcttctatctacttagatttggtgatgctaggaatgtagtgttttagatattaattctatttttatttattcatttttacatcaccaataggatctgaggtggagatggcgggtattatcactggcattttacaggtgagaaagcccaaagccactgaggtaattaatggaataattgattttgaacttgggtctgtctgatttcatgtgcaagattatatacttagtgattttgattttaagtttattcttaacattttaaaccagactattaactcttacctttataaccacagatacaaagaactgtatcatttattttctgaatataaaatattaatggtcaatataaaaatacaaaaatagagaactacatacaacagaaaagcaaaattacccactaataacactttgatttatatccctttagacactgtttagagtttatacatatatgtaaatatgcttgtattttaacaaaattgagatattatataaactgtttgtagcagggtgtttaaaattttaacaatatgttatggatatctttctgtgtcaataaatgtgtatttacattagagttccaagcatttgaactgaatctagtccaaaaatgatgtgttttatttggccattgaacattttttaaaaaaatctttaagcaatagacagcttttgaaattcagaaaatgttacgtacaattcaatgtcctgcatgttttaaaatactggataatctaacaacacagaacacctcccactccccacctcacaaccaccacacatatactttcttgcttggcatcagttaattgaaactgccctctccaaaaggggcatatgctgtccaattttctagagagccttttcattcatttatgttacatctggaccttaaggacatgataggtggtgaaacttgatgaaaattatcatttattgagaggccaaaatgagagaattgcttgaggctgggaattgagactagcctgggaaacatagtaagaccttgtctttaaaaaataaaaaaaaattaatggt

SEQ ID NO: 675 - DNA, 15044 bp, Human
aagtgtgctgagcccacaccgaaagcgtttctctttccatggcaccagctgcctcggagagcggagacctggggcgaggcccagggggctgcagcaggaccttcaggcactctgggtttcgtgtcacagaggggagaaggcggtgatgctgtgggggtcctgcgggagctgtgcctggaggtgggacagagcctagtacatgtggggtgggacagggaaggctgaggtgaggctggcagggagcattgctggtaagggccaccctcccccaccccaggagaatggcagaggtggggcctgggcacccagggtggggctgagtggccctgccagacagaccagctcccgcgggtgctaggcatgcacctgagaggggctgggaagcgaagttggggcaccgggtggggagcagaggtgccccatggccttgcccctggggctccctggagcatgcccctcttggtcctggagtggaatgctcaacccaaatggcactagggaggccagtgccatccaggagtgtgggactctgcccagggcactgggtgagcatggcaggggctgggggtgggaggagcccaggcttcctgtccctcaggtggctctggccaagcccctccaggatggggacagggtagtggggctggtggaggcagcggggccatgggaagagtcggatgggcccagtctgagcctccatggctgctgtgcttggggcaaacacctcctactcagcctcagtttctccttctggatggtggatcatcctgcctgccttgcagggctgtttcaggggtcacttgaagttaccatgatacatgagacaaggctgcatgcatttagtcttggggtggggcagacaggtggcatcaaggttacaggtcaccccagttcttggggaggcccagcccctgcctgcttccccctttcagatcagccatgctcttctccagtggacctggccttgctctgacaatggtcaggtgctgggcagggactctggggaagctcgggtcttgcctctctggatgtagcttgcaggatagctggggatgtggaggcaggggaaagctgggctctgggaccgggtggcctgagttccaagcccaagctattgactatagggacagtttaagccgaaataacacccttccagatgagagaaaggaagagatgggatgggcacccaggaaggctgcagaaactggaagcctttgtgatgatgctacgatcccatttgggagggggtgggagccaggaagcctgggttctggacccgagttgctgtgtgacttcaggccgccctgtgacttgctgagccccttgccccagtgatgtgtgaaaggctgtctgaggtcccacccactgtggcttctgtagatcctggtcaggctctgcccctttcatggcccagctggagcagctgtgtttctgtgaccccaccgctggatcagaactggacaagatggcagaggggctgggtctgggcaggaggaggctgggttccagtctcaggccggttctggtgttctagaccccggcatgtcccagacctttctggacctctgttcctgctctgtccaaagggacagagcccatgccccgcctcttccctagggtcccgtgggatccagggaggtgtccattgcctgcttcctgcccagagggtgggctggcagggaaggatttgcccaagtaaagtgaaagtccccctctgtgtggcgggcttggcgtccccagcctcttccttgcttctggggctgtgaagtattggaaggggagctgtagatggtgagatgctcgtggccagggaggaagcacagttgttggtgctcatctgggccaggagatgagcagagccccggtggctgaatgggtgaaacagactgagtgtactcaatgcagccagcatagctgtgtgtccagcctgggagccagggccggtccatggtgaccactgatgccttcacccccaccccgcaggagcctgcaggcctgaaccagggtgatgctgaagatgatgaccttcttccaaggcctctagagccatcagcctgtgccaggcaccctcgacttgcctagaggcccccaaaagttgcagtccacatcagaggcagagtcagaggcctccatgtcggaggcctcctctgaggacctggtgccacccctggaggctggggcagccccatatagggaggaggaagaggcggcgaagaagaagaaggagaagaagaagaagtccaaaggcctggccaatgtgttctgcgtcttcaccaaagggaagaagaagaagggtcagcccagctcagcggagcccgaggacgcagccgggtccaggcaggggctggatggcccgccccccacaggtgctctaggaccctgggttagagctagtctggggcctggacggggttggcgctcatccgcgtgagtgagccacttgcacagtgggccggcaagtggggctggaaggcgcgtctgtctccctgctttcacctgtgccgcaatctggggggctgggaggccttcagcctagtcagggacaccgacatcaccctttagggtgttggccgccggccctgtgcgcgtctaggggaggacggtcccgcttggcgctggccgccccgcccggtgggcggtgggctggggccggggctgacgcggctttcccggcgcagtggaggagctgaaggcggcgctggagcgcgggcagctggaggcggcgcggccgctgctggcgctggagcgggagctggcggcggcggcggcggcgggcggtgtgagcgaggaggagctggtgcggcgccagagcaaggtggaggcgctgtacgagctgctgcgcgaccaggtgctgggcgtgctgcggcggccgctggaggcgccgcccgaacggctgcgccaggcgctggccgtggtggcggagcaggagcgcgaggaccgccaggcggcggcggcggggccggggacctcggggctggcggccacgcgcccgcggcgctggctgcagctgtggcggcgcggcgtggcggaggcggccgaggagcgcatgggccagcggccggccgcgggcgccgaggtccccgagagcgtctttctgcacttgggccgcaccatgaaggaggacctggaggccgtggtggagcggctgaagccgctgttccccgccgagttcggcgtcgtggcggcctacgccgagagctaccaccagcacttcgcggcccacctggccgccgtggcgcagttcgagctgtgcgagcgcgacacctacatgctgctgctctgggtgcagaacctctaccccaagtgagcagaccaggggctgggcccgggccggcagggagggtgtcctctgtaggaggggtgtcgaggggtgtcgaggtgtgccgccggcagcttttagtgaggtcggtgtttgcagagttttgggtccgagaatgcaggggtgggacttggactccctggggcagagcctggacaggcagagactgggcctggacacagggataaggctggggctgggtctgcgttgctcttggaatccttaatttcctgggcctcagtcacattctgctgttggggaaactgaggcacagaaaatggtagggatttcattcacgagcgcccagtctgaggagggggcaaagcaatcaataaccatccagagctggaagggctgtggcagcagaggccaggccccgtgcagagcatgggcccaaagcaggcctggagaagtcagggaagccagcctggaggaggtgaaagccagcggtccttctctgagccagggaatcaggccaggaggcaggaggaggggtgatagggcaggtaggggagaaggtgagaggaaggtcggtgctcctgagcatgtcctcttccagggcactctggagctgagcagagctatgcgggcacccccaggcaggagagttccaagtgatgggctagggccacgtgtcttgttagacccccattgtgtagggttaccctgtgagcccgccgcagagctggagcccctcaggtgggaggctggctgtgcagctggtacccctgctgagtacagcctcaggcgtcccttgactccatagatccctgggcgtgcccgtcattcgcacggtctgcatggagagaggcttactgcagtgtggaaaggcccagggcgggggagtccaggggctgttattgtggggcttggccactgctggccccagatcctagtgtgaaactttaggaaggaagcctggaggtatagacagtgtgggcagtgtctgccgtctcgggggccttgggtggcctgtgggctcagttcgtgttgaagggtcagcctctggcagaaggatagagaaagggtccagtggagagggtgggagaggagtcagcagggcataggggaactggcacagggcaggggccacgggagagataacccagcccagagccagttcccgcttgctcgtcctgactcaccaggaaatgccgggcacctgcacccctgcctgccagtctttctgtcccagtgacctcggggtctgctggcctggggttagcaacaggcaactaaagccaagctgggcatggagccctggtgagagggtgcccaggggggcatcgttgaagcctgtgtgccagaaatgtggggaacggagggacacagctgcatctggattgggtgaggggcagagagaaggtcatttgtaaacctctaggcagacaaagggcccttaggaagtgccagggctgggcagtcccctgggagctctggggcgctgcagaggcgccaggacagtgagccaagatgcgtctgtggagcagtttggggcagcccttcctgcccattctggcctacccctgggattgggaggtggccggggctggtgagatgcccaagacctgcagggctggagcgcagtgggctgggagctggctggattccagggctgctgtgagtaggagcagggttttatctgggtgacaggtagtcttggagcaggaagaagatcagatcttaaaggtggctctggctgctgggtgaagaaggaattgttggaggtgagggaaggagcagagaggccgggaggaggcttttgcagtgagccagcggggagctgatgggagccggccagggcgccagagtggcatgaggctgctgattttgggggctattttggagcaggacctaatggggggggtggtgagagagtcagaggaggcatgatgacttcagagtttctgttccaaaccaaactaagtagatggaggacccatcatctgaaatggggaccgggtgggggtgcgggagggtgtgctgggcagtctgggcctgccagagaccaaggctgagggcctgggctctagcttgagtggtggtgctgatttggtatagttgtcctcatgccagcctcccctgcctgcagtgacatcatcaacagccccaagctggtgggtgagctgcagggtatggggctcgggagcctcctgccccccaggcagatccgactgctggaggccacattcctgtccagtgaggcggtgagtctccacctgggccagggaggggcagggaggcagcagaggagaggctcggagacagacaggacatgggcagggagcttgacgggtcttccaggtgagcgaggtgagggatagtgccccagtgacctgcccctcctcctccaggccaatgtgagggagttgatggaccgagctctggagctagaggcacggcgctgggctgaggatgtgcctccccagaggctggacggccactgccacagcgagctggccatcgacatcatccaggtactgcaatctgccccagggcacacgtaccgcccgtgcacgtgcatggggagccccacgcacattccgtcctgtgtgcatacccatgcccacctcggggcaccccctctgttcccgcctgtttcctccccgtcccctgcccccttgtccaggcgagcccctgctcagctcacccaccaccaccctgcagatcacctcccaggcccaggccaaggccgagagcatcacgctggacttgggctcacagataaagcgggtgctgctggtggagctgcctgcgttcctgaggaggtgggtgtgtgcccaggatggggtccctgtagccaccgctctcagagccacggcccctccctagtgcctcaggtggggagctgagctggatccccgccctctacccctgtccctgtcattctgagccaggagttgtttcccactcagccagggcactgagagcctcaggtggtctgacctccaccaggattcaacgtgggagcctcttgcgcccaccccatcagcaaagctctcagcagagcagcctctagcttcaaagaggataccccaggagggactgagaccccgccaccccttcatacaacactcctagtctccaccacctgaattctctctgctctctccctctcgacctctgagggcttctccagccaaccacacgctcactcctacctggtctcccaactctagagagggcctgggagcagcagagatgggctggtaccctcttcaggagcccaagccttagcttgtgaagccagttccatgatgcccaggggctagcggcccctcccttggctatgggcagccaaacagaaaagtgaaccccaggagctggcagggagggcagggaggctgctgctgtggtcccagtgtttgggctggtcctgaatgtgccccttctggtttcgccagctaccagcgcgcctttaatgaatttctggagagaggcaagcagctgacgaattacagggccaatgttattgccaacatcaacaactgcctgtccttccggtgagagtgttgggaggggcttgcgggagtgggagtcactcagcgggcaggagaggggagctggaaggtggagggagaaggagctgcttaggccaagaagtggaattcaaaccagcaacatgtgtgaggactccacggcctgcagcagcagcagcaaacatttcccaagtgctggctggggcaagcacacaggcagatgtttcacccattatcttatccttaaagcaaccctgtgaagtaggtatagtgatctgtctattaggcagatgggcaaaccactggaggaggctcacttgcccccagttacaaggggatgtagtggaggagtgtcctgagggcatggagaacatggatgggaggacttgatcccatagagaatggggagccattgagggttctagagtgaagagagggggctgtctggctccctgggtatggggctataggctgagcagggctggggtgacctctctgcctccaccttccaggatgtccatggagcagaattggcaggtaccccaggacaccctgagcctcctgctgggccccctgggtgagctcaagagccacggctttgacaccctgctccagaacctgcatgaggacctgaaggtagcgggagcctcttgccctcaggagcccagtgttggggggttcccagggagggactgggaggtgcccccagggaggagtggcagaagcaaagatgtggggaagacacgctccaggcctgtggacggcaccgtgggccagctctggtgcagcggtgatgcccggttggggaccctagcaggctctgaactccgccgatcatgtcctggggtttcacctgagaggggccgcctggggctgggagggcctggaaaagtttcactgcccctccccgattcagacacagcccggtcccaagcctgcagacacctttccttcaatcccctcagcccctcctatccacccccatccccgcgcctgactcccagcaactgaggctcagggtcatcggcagctggggttatatctgttatgggccaagaaatccacagaaaatgctgtgaaaacaagtagttcctttagcagggtgtaaagtggggggtctctcaaaaggaaggggagaggttctcttcccggtgtcagggactagcggccatgggtggcctgagtgtggtggaagcccgagcggtgaccccacatcccctggtactgatctccctggcccagccaagcacaaggtcttgtttatgaaggaatttatttatttaagtggcagtggacttggcctccgggccggcagacaggctctcctggctcctgagccgcactgggtgaccttggataagggtgcacagagccggctcccacttcctgtctgtgagcagggacctgaggttggcccgggttccctgggagtccttgagtgccccccgcccctccaccaggcacatgtgtcggtgtgtgtctgtgtctgcgtgtctgcggctggcagcccttcctctccagggcgtgactagacatcctgcctctcctgtctcagccactgttcaagaggttcacgcacacccgctgggcggcccctgtggagaccctggaaaacatcatcgccactgtagacacgaggctgcctgagttctcagagctgcagggctgtttccgggaggtgaggaggctctgggctggtggctgggtcttggggagttgggggcagcccggacacgcacactagcacgtctgtgtacactcacgcacatgtgctcacacacgcacatgtgaacacacgtgaatgcacgagcatgtgaacacgtgcacatgtgaacacacgtgaaggcacgaacatgtgaacgcacgagcatgtgaacacacacatgtgaatgcacgagcatgtgaacacatgcacacatatgaacacacgtgaaggcacgagcatgtaaacacacacacatgtgaacacgtgaacacatgcacatgtgaacacacacgcatgtgaacgcatgagcatgtgaacgcacacatgtggacgcacgagcacgtgtgcagtcttttgctctggcatctgcctctctctggaggcctggctacaaggcttcaagggaggtggcgagctccccatcagcagacagctcacacgcccctggctgcttgccctcccaggagctcatggaggccttgcacctgcacctggtgaaggagtacatcatccaactcagcaaggggcgcctggtcctcaagacggccgagcagcagcagcagctggctgggtacatcctggccaatgctgacaccatccagcacttctgcacccagcacgtaagccgctgcccacctctcccaagcccctctgaaatggctgcctcttctcccctagccctttcagggtcggagataggccgttggtgcctctctaagcccaacgagtcgctgacccgagcctctggacccctgggtccctccaaccacacccactcctgcagggctccccggcgacctggctgcagcctgctctccctacgctggccgagatcattcgcctgcaggaccccagtgccatcaagattgaggtggccacttatgccacctgctaccctgacttcaggtgagaacctggggcacctcaggaccactgtcacatcactgtggccaaggcctcacagggctggcattgggaacccagatcctggcagctgcccacgtgccagtcactgtgtgaacctcaccaggggctcattcttgtggccttcaccacagcactacgaggacaatacttcccattcccgtttcacagaggaggcctggagagctcacaggatgtgtccaaggtgacacggctagttagtgtctggctgcatggcccacactcttagctttacctgacactgcctctcacaggggagactgagaccagagaggccagcttcacccagcctggggggcctctgcggcctaggcctatgctctgggaccagggctcatattcgggagtggaggcttagcccttggctgcctgaagttctggtgggccagggacattgtttcttcctgggctgggtcctctgacatgttagggtaagtttgaatgggtcttgacagggttgaccccagcttcgccaagtccagtccctgtctgatccattccacccattcattcattcacccaccatacaagcacccatctgctcatccacccattccttcacccatctggctatccgtctatcttctcacccactcatcacctgtctacccatccacccacccacccacccacccgtctatccatccatctattcatccacctacccatgtaagcacccatccacccatctactcatccatccacccctccacccatttagctatccatccactcaaccactcacccacccacccatccacccatgcatctactcactcatccatgctcccatccctccacccatctagctctcatccatctgctcacccacccaccatccatctacctatgccaccaacaattatggagaagtctgctaggtgtcagcctctgttctagttaccaggatgcaatgaagtacaagggaagccaggtctcagtcctcccttaagtagctcattctgttgagggccagcaatactaatgacataatcaggcaaagaaacagacaattacaagttgtaaatagggtttaaccaaggttgtgaatgataggaggtgccgactttagagacaagaaagccttttgggggtggacatcttagcggagacctaaggggtgggaagaggcggtcatctcagggcctgggaagaacattgcaggggaacagccggtgcggaggcctgaagcaggctggggcatggctgctcttgggaccatcaggtggagggcatgggtgagggagagtgaagtgcagccccctcgtgggccgggcgttggctgtcgggccctgtggcactggccgggagtgcagggagctggtgagtaggggtgtgggtgacaggctgggctgacaggatgctctctttgccagcaaaggccacctgagcgctatcctggccatcaaggggaacctatccaacagtgaggtcaagcgcatccggagcatcttggacgtcagcatgggggcgcaggagccctcccggcccctattttcccttataaaggttggttagcttttcctgtggcctgacctgcctgtgagtgcccagcaagccttgggcacaccccgctgggagctgttaagagcagcgctggttctcggttcctcccgggtctcctgtgctctgatgctacttctgcctagccctggcggaggtgcaggccctgtcagctggaactggacagaccttggtttgtttacatgtccgatgggggcaggagctcccatcctgggcagccaaccaggcaacaccaaggactctttgtaaacgatagctgatcgtgtgcacgcaaggaaagaaccaggagggagagtgcagccaggctcagggatccccggacacctctgtccagagcccctccacagtcggcctcatgactgtcctcctcgtgggtggggccgagggccctcttcagctctctggagacaggggccgagcctcacccatctgccctctgcagcccagggccgccgtgagcgggattcagcaatggtggaatggaagacagaactggaagagaaagaaggaaaagatgagctctcgtctggcaggggcttttagggtcctgtggcgagctgtgagcaccgccagcgttagacgtcacatccaggtggccccacggcccctacaggctggccctgcaatggggccctgagccctccctcttcatcccccaaggcctcaactagagggtggtcccccgagggcttggtgtctactaccgaagggcccaagacctcctgggtcctctcaggctcccccttccccaaggcagggacaggccctgggggtgccaccgtgggccctgccacccagaagtctggctgaggtctgggcaggggcagggcaagcttgacctctcactgttgaccctttggcctctgtatttgtttcctattgccgtgacaggtttccacaaacttcgtggatcaaaacgaggtcttccagttctgcgggtcagaaggctgacccggggctcaaatctgggtgtcggcagtcctgcactccttctggaggctctaggggagaattcatttctggccttttcatttttagaggctgaccgtaattcttgacttcaggctcctccatcttcagagccagctgtgggtagttgaatctttttcccgtcacctcattgaggcctcccctctcctgcctccctccaccactttttttttttttttttgagacagggtcttgctgtgttgcccaggctggagtgcagtggcctggtcatggcatcaaggctcactgcagcctggacctcctggttcaagtgatcctcttgtctcagtcccctgagacaatcccccacgcccagctacatattttttgtggatacagggtctcattctgttgcctaggcttgtctggaactcctgggctcaagggatcttgtagccttagcctcctaaagtgctgggattataggcatgagtcactgtacccggcctgctctaccgcttttaaggacgcttatgatcacattgcgcctacccagagaacccaggtcgtctttctattttcaggtcagctgattagccaccttagttccatctgcaactttagttcccactggctgtgtaacctaacatagtcacaggctctggggactgtcacgtggacatctttgggaggccgttattctgcccaccgcaccctccgttcatcccctgccctgccgggcacctcgctctaccccaggaaaatgtgagctcgttttcctgctcggcatgtgctccccctaaggctctgctcctccctgggcctgaaagttccttctcagcctgagagggggcccttcgatctcaggcatgactcagcccggctgatgcctctgcagtgctgagtcaggatttggggccggctctcttgggtctgtccccttttcccaggtactgccttacaaagctgtggccaggaagtggccggtataaaggatgcccaaggtctttgtacgtgtgtaggagttagcgtgtttgatattgttaatataataataattattttttagagtactgcttttgtatgtatgttgaacaggatccaggtttttatagcttgatataaaacagaattcaaaagtggctgtggagtgatttattttgggagctgcacaatgatggggggcccagccaggcagccttagcagctttctgagcctctaggggtccgggcaaacctacctaggttctgtgtcaatccccagcctgtcccagcccccagagcacctcatgtggtccaggcaggagatggcccaccatcccctcactgtgagcaggagctttggaagtgtctgcctgtagggcatggacagtcacttcacccttccgtgcctcagtttcctcatctgtaaaaaggggactgtgaccctttggggcttcctccaccgtcctttactgaggaagagggtggggtggacacggggcagccatttcaaccgcatgcacgggacacagagtgggaactgactcttaccatgctggcattgacctgaaagctacagctgtggacacaggaggtctggtttgtgttcagagacgggctcagctgccacggaagggtgggcctctccgcagccaatctggcctggaatttgggaaggagcagagtccctggaagggaagaagggtaccttgatgaacgttgcacagaggccggggagggccccaaggggagccgtgtgcacctgaagaggggtgtgggcttcagcagggcctgggacagcccggagctgggggtgggggagggcaggccctttctcctgagttccattcttggggccaaagcggatggcatgaggccaccgtgcagtgagagaaaggagggagacgagggccaggggcagtgcggcttggcacggagaccctctgcccggctcctggacccgccggtccatgtggctgcgaggtcctggcctggttgagccacgtggggagcgtgggccttgggcgggcgagttcccgttcctctcctcggagcacagggtcagggggaagtgggggcagcgcgactctcccctgcatggccccctgaccctgggcaaacgtggggagagatggcgcctgagccccgatggaagctgtcagtgggccctggcacacattctcccacgggggcggacttaggtcccaaagtgacccccagcctcgcggcggccagggcgggccgagtcgtcggagcgcggcgggacctggggccaggtggacccccctccccgggctgcgtccacccctggcagaggggcgggctccgggcgcgaggccccaggcgaggaggaagagggtgcgggcggcgccttggaggttcctgctgttcctgcttttcggggcgggggccttccgggtcactgtcccgccagctgttggatctgcaccagtaacttctccaggaaaatcccccggagaggaggatctgcccggcgggggggagcgagtcccccagcgcggggacagggcgggcggagcggggcctgggccaggcctggtgcctttgtgcaaggacgggccccgggctgcccaggctcctgtgagcaggggtggagcggggaggccgcagcccccgcggaacaccgggcgcccccggcctccagcagtgggaagcagcccgggggctgacgctccctgcaggagccaggagcaagcaaacaagcagcttgagtgcaggcgcggggacgggccgggggtgcctgcgggtgaaagggcggctcaaagggacagtcgctggaggcccggtcttgaggaggtgcctggagcagacccgggctgggcgctgcgggggagggaggaggttgcggaggccggcgggcgggaacggggaggaattccaggtttcaggcaaagaaagacggcaggactggggaaaagggatcctggacaggagactccgcaggaggaaggagggggccggtaagtgggctccttccagctggggagcggggctggaaggggctggagacgcgagtttcaactcatgggatttatggcttggaaagacccctctgcccttcgggggcgctggggtccccaggggagagatgagggcggcagcgagggccccctcgtgcagtgagatggagcgagctctc

SEQ ID NO: 676 - DNA, 9946 bp, Human
ccagacaaccctggagcaacgcagccttgaattcctggggtctcttatatgcacacttttttcaaccaaacgggggtcaaaactgtagcatttgtgggatgcaagacttgtgtatatgaacggcagacttttcctatatgcaggcccagcagagacaatgtcggggctggagtacgagcaggtgttggtgcatgtagggggtactgaaacgaattgcctgtgtatcccaagaaacaactctactgagagatcatattctctaggggtttatttttgtttttatttttattttaagttaaagcttcgggtagaacacccagtgtctccttgtccatctgaagaagatgctgctatgtggaagcacatccttgagatccacaaggagacactgggcaaggagacgagggtgccccactgtgcagaagtctccctaataaatgatctatgaacaccctggtgtttagtgcttctttctttggaatcccagcagctctgtcactggacggtttggtgcactcccttgagggaattcccctgggctgcttggggtccactccagcctcaggtgtagctggaggacgcagcctcccaccttggtctggagccctgagcccctcactgtcattgcagatcccgaggttcctctcctggctccactcagtggtggaaacctccaccctaatgagcccttgatggtcccaggtccctgtggcatctcacctgtggcctctgttctttcctgtggatccatctacacttgggaacttccacatctctttttctgctcatgacattgatgctctgggtatttcagaaatgcccagatagatggacaaatacacgtccatctatccattagggtcagatgtgagatccagagtggacacatcaatcacctacgtagactgtggagtccaacgccaagatcctcttatgtcccaaacacctcaggtcttaccctggtctggaaatcaagcacaaatgagcccctcctaatgttccagcaccactgaccgtacaaccactgtcacgagtgggatttgtgacaacagtcggcaaaggaagaatctgaggctcagagatggttcattaccgcccgaggtcacgtaggcagtggatgataaccagtcgttgaataaatataactcccccccaactccccaaatcaaagctcaaatataagtcattgttcccaaagcgttgaacagggattgaggtgcagagggacggccaagtaagcaaagggcaccgaggaggcaggaaagactcagagatttgttcccggggggtggggttggacactgtagcaaaatattttaaaaaggggaagttaagaggggactatttggttgaaagaaaacccacaatccagtgtcaagaaagaagtcaacttttcttccctatttccctgcatttctcttctgtgctcgctgccacacgcagctcagcctgggcggcacagccagatgcgagatgcgtctctgctgatctgagtctgcctgcagcatggacctgggtcttccctgaagcatctccagggctggagggacgactgccatggtaaggaccccacaacgctgagctgatggacggctgaaggagggagggtgaccatgtgggaggctgtgagaaggaaggagatgcctccgctaccctcgtcaggaagggcagacacaggaaggaaccagttttatttgctgctacatcctggctctcagtgggatgaaaacaaaccagacagacggtggctgggggtcaggaaagggcccattaccatctgaaatgatgcagagggcctagtgactgcccccacctcagccctaatggaatgagagcaagggtcctggggagggcagttccacttcctgtgtggctgcagatgacagcaccccatgagaagaaggacccagcctccgattggccacactctgtgtgtctctctatcctgccagcaccgagggctcatccatccacagagcagggcagtgggaggagacgccatgacccccatcctcacggtcctgatctgtctcggtgagatttgaagaaggaggggagcttctaacctaagagggacctcaccccacagccaaactctggtccctaaggagaccccaggggctcacaaagatcccagggaggggaggacctgcccaggcttcagggggcaaatccctcaccgggaactctcttccagggctgagtctgggccccaggacccacgtgcaggcaggtgagtctgtccccagctcttccaggtccctcctcctcactggggacaaggggccacccccgtgccgctggggatggggaatagcagttctgggctgactgatcggggcgtctggagggtcctgggctgagagctggaatctgctgggttgggtgggaaatgagttagaatccgactcctgatttccttccagggcacctccccaagcccaccctctgggctgaaccaggctctgtgatcacccaggggagtcctgtgaccctcaggtgtcaggggggccaggagacccaggagtaccgtctatatagagaaaagaaaacagcactctggattacacggatcccacaggagcttgtgaagaagggccagttccccatcccatccatcacctgggaacatgcagggcggtatcgctgttactatggtagcgacactgcaggccgctcagagagcagtgaccccctggagctggtggtgacaggtgagctgacactcaggggtcccagccccagactctgccctcaggaagggggacggctctcaggggcttctccctctcacagcccagccctggggatgacgcgggtggtctgagccacatttaacacggtgcctccttctctcctaggagcctacatcaaacccaccctctcagcccagcccagccccgtggtgaactcaggagggaatgtaatcctccagtgtgactcacaggtggcatttgatggcttcagtctgtgtaaggaaggagaagatgaacacccacaatgcctgaactcccagccccatgcccgtgggtcgtcccgcgccatcttctccgtgggccccgtgagcccgagtcgcaggtggtggtacaggtgctatgcttatgactcgaactctccctatgagtggtctctacccagtgatctcctggagctcctggtcctaggtgagaaattcacagcattgcctggagttccctgagtctccaggcaggtggggagcagccgcgtctcagggcagttccaggtgggatgatgttggggcgagagggctcagggctcctggggccagagacacaggaagatcagcagtgatgtggccccgggggaaagggaagatttgtggggaagcctgagggtcggctcctggaaaccatgaccaccttttcccaggtgtttctaagaagccatcactctcagtgcagccaggtcctatcgtggcccctgaggagaccctgactctgcagtgtggctctgatgctggctacaacagatttgttctgtataaggacggggaacgtgacttccttcagctcgctggcgcacagccccaggctgggctctcccaggccaacttcaccctgggccctgtgagccgctcctacgggggccagtacagatgctacggtgcacacaacctctcctccgagtggtcggcccccagtgaccccctggacatcctgatcgcaggtgaggagcccagcgggttcagtcagggacccaggctccgcacaggccctgccgggggagctcaggtagtgatggccgggatgagggatgggggtcccaagggagggagagacagacagagacaggggatgggcggggagggggagactcagagaaaacagagacagagacactgagggtcccagagggagacctggggaggtgtcagctcagagcaaggtggggcagcccctcgcccatccttcttctctccaggacagttctatgacagagtctccctctcggtgcagccgggccccacggtggcctcaggagagaacgtgaccctgctgtgtcagtcacagggatggatgcaaactttccttctgaccaaggagggggcagctgatgacccatggcgtctaagatcaacgtaccaatctcaaaaataccaggctgaattccccatgggtcctgtgacctcagcccatgcggggacctacaggtgctacggctcacagagctccaaaccctacctgctgactcaccccagtgaccccctggagctcgtggtctcaggtgggggccttgaccctgtcctctctgagctcaaagtctcagctcagaccctgccccaggagagctctgggctgggatggagtgagcgggggtctgagaggggctcagccagtgggagactcaccctcagagggaaggaggagaacagggccctcccaggcctgcccaccctcagtggcatcgccagcatcatggacaggagaggcgggtggagggaggggcctggggaggccacaggtcccatgtagagaaatttggtttgaggtggagacttcaggaaagccccagctcctcagcctcctctcattcttttacccaggaccgtctgggggccccagctccccgacaacaggccccacctccacatctggtgagtccctgaggcttctgaactcaagggagtgcggcctcccccagggcagccctgggtctcccagagaatcccattcccctcaaagactcgagcttccctccagggagccgggcagagccagaggaggggccacagggtccccagggctctgaggctgggctggtgaggggtggggggtcaaggcagagagaaatgttggggcccagcctgggggaggagcagccgggctgatgtggggagcagggcagccccagccctcacctccccgtcctgacccagcaggccctgaggaccagcccctcacccccaccgggtcggatccccagagtggtgagtgacgggctctgagtgggaggtgggcagggtccaggggaggcaggggtgggttctgtcctaggttcagtctcctctggaggtggtgatatagacaggctcctcccctgcttgggcctcagtttctccaaatgtaaaggtgagaggcctgcgggtgggaaagttcctttcagctctgactcccagctgtgacctcctgggagaggaggcctcccagggaacctcccagacccgattccgcgggggcctgtcccgtcccacctgcagcagagacggtgacctggggcaggggaggggagaagagtcatggttcaggacggtcaggctctttccctgcagctccggggctcggctctggtgcaggaacaagggctgcaggtcagactcctgggcttccttcccagctctgccgcttcctggctgggggccccgggcaggcgattcccctctctgagcgtcagtttttcatctgtacagtgggtggggtggatgtttctgtgctgcacgactgttgtgggggttggaggtggtgaacagaaggtccagcagtcacctgcacacagtaggcgctcatttcaatgacatcacccccatccctgacatcatcgtgctcaaggtctgggaaggcacctgggggttgtgatcggcatcttggtggccgtcatcctactgctcctcctcctcctcctcctcttcctcatcctccgacatcgacgtcagggcaaacactggacatcgagtgagtagggaatggggggaccctgagggctgaccgagggtgggctcagggcacagccaaagagaatccaaaccactgggcaaatgcagctttgagaaactgttccagcatttctcaccaggccaatcgacagtcagtcccatctacaaatgtaaagtgtccttcgggctcagtgccatctacaaatgtaaagtgtccttcgggctctgtccatcctatgaggcatttggaacatggaggcaggagtgtttttaggtttccttccttaccttcgagctgtgtgtgcagggcagggggctccaatgttcccagggctgaggctctgtccttcttcccccagcccagagaaaggctgatttccaacatcctgcaggggctgtggggccagagcccacagacagaggcctgcagtggaggtaattctgcccgaagaccccagactcccacctgctcgtggcccatacactgcccctaaagctcccattcttcccccaggtccagcccagctgccgatgcccaggaagaaaacctctgtgagtgagaggaagaggtgaccagccaggagggagatgggggccccgaagtttccgtagcaatggggaaaggggcactggctggaaagggtctggggctcagggtgagatcatctcaccccacactgtggggcctcagggacatcgcagcccctccctgcatctcagtggccccatctgggagctgagcaggggctggcaggactcagaggtcccagggaaccttcccaagagacaaaccccttgctctgccccagcagatgctgccgtgaagcacacacagcctgaggatggggtggagatggacactcgggtgagaccccgcccctgtcccaggcaccaaaggcctcctggtgccagatctaatcctgcagaacttctctgtcctccttcccccggctctcagcatcgtcacggtggacccctccttgtccagcacgctgcctcccgcctgctgcgacctcactctctcctgctgtcctgggacctcgtgggcctcctcccgggtccccttcctgctcctcatcctctgtttggccgtctggttgttagagctctccccaggcctcaggaggatgaggaataaatgaaccaccccggtcccccgggctccccttcattcattcaaccagcgagtgttcccagggagctcactgtggatggggctccccatgggagctgcagacacagcagggagcaaagccgcccccgcctcctgagctcacctcatggtgggagacaaaatgcaaataaatgcatcgtgtccaggagtgcaacgtgctgtaaggaacataaaccagggaaagggcagagagtgtggggcagtggggccagtctgaatggaaggggagggctgtctgctcagctgtcatctgagaagcctggacagagtggggcacacgatcctctgatggacgagcccctgcaggcagaggaaacagccgtgcaaaggccccgaggcagcagcgagctcttgcaggaaggcccgtgaggctgcagccaaatgggcaaggtcagagtgaggagcagaggccagaaccacagggagggagcggccagaccctccacggccttagggcgtccctgagattccatcaggaaagggatgtaatcggatcaccccgggaacagtgaggaaaattgactccagggggtcaggaggattcaaggacaccccccaccactgtctctctccagcagagcccacacgatgaagacccccaggcagtgacgtatgccgaggtgaaacactccagacctaggagagaaatggcctctcctccttccccactgtctggggaattcctggacacaaaggacagacaggcggaagaggacaggcagatggacactgaggtgagtcctttcctctccaggcccccaggcctcccccacccccaccacgttccttccctctcactctcccccgctgcaggctgctgcatctgaagccccccaggatgtgacctacgcccagctgcacagcttgaccctcagacgggaggcaactgagcctcctccatcccaggaagggccctctccagctgtgcccagcatctacgccactctggccatccactagcccagggggggacgcagaccccacactccatggagtctggaatgcatgggagctgcccccccagtggacaccattggaccccacccagcctggatctaccccaggagactctgggaacttttaggggtcactcaattctgcagtataaataactaatgtctctacaattttgaaataaagcaacagacttctcaataatcaatgaagtagctgagaaaactaagtcagaaagtgcattaaactgaatcacaatgtaaatattacacatcaagcgatgaaactggaaaactacaagccacgaatgaatgaattaggaaagaaaaaaagtaggaaatgaatgatcttggctttcctataagaaatttagggcagggcacggtggctcacgcctgtaattccagcactttgggaggccgaggcgggcagatcacgagttcaggagatcgagaccatcttggccaacatggtgaaaccctgtctctcctaaaaatacaaaaattagctggatgtggtggcagtgcctgtaatcccagctatttgggaggctgaggcaggagaatcgcttgaaccagggagtcagaggtttcagtgagccaagatcgcaccactgctctccagcctggcgacagagggagactccatctcaaattaaaaaaaaaaaaaaaaaagaaagaaaaagagaaaaaagaaatttagaagaataacaagttattccaaatgaaggcgtaagaaagggaataataacaataataagaggagttgttcatgaggaaaaaccaaagcttgaaaattcaacaaagccagtgaagctcattcttgaaaacatgaatcacactcatgaattctaactacaatgaaaaagagaaagaaagagcaggcatgcatttccatatgggagtgagccagcagacagccctacagatcgtacacacgttttccaaaactaacaatggaacaggcggcaaacctatgccaatatactagaaattgcagattaaatagatgaaatattctaaactggagtttacataatgaacataagagtaatcagagaatctgactcattttagatgtgtgtgtgtgtgtatatatatgtgtgtgtgtgtgaaaaacattgactataataaaaataatctcgagttcacgaagcttcattggtgatttcttacaaatattgacacactaatgaaacacacaaacacacccagagcatcacaaatgtttcttgagaatagaaaaagtggcaatgtgcccaggtgcggtggctcacgcctgtaatctcaacacatagggtggcagaggcggcagattacttgaggctgggagttcaagaccagcctggccaacacggcaaaaccccatctctactaaaaatacaaaaattagtcggacatggtggcgcacactgcagtcccagctacttgggaggcagaggcaggagaatcacttgatcccaggagatggaggctgcagtgagctgagatcccgcccctgcgctccagcctggtcaacagagccagactctgtctcaaaaaattaaaaaaaaaaaaaagtcatgacatataaaatagaattttccattctataacaggcatattttaaactctacagtttttctgtttcaaaataatatttttttaaattttattttaatgttttactttattttatttggcagtttaaaattctacatatttaggatgtgcaacatggtattttaatatgcctgtgaaatcgctaggtcaagctaattaacatctgtaacatcacgtagttatctttctgttaagagaacatttaaaatccactttcttaccaattttcgcgtatgcaatccattgttagcaactgtagtcaccatactgtacaacagatctcctaaacttactcctcctgtccaactgaagtgcggtatccttcgatgcagctctctgattccaccccagcccagctcccggggaccaccttctactctctacttccatgagttcaactggggcaatccgcacataagtgagatcaggcagcaggtgtcttcccgtgccttctttattccgcgtagcgtgacgtcctctaggctcgtccatgttgtcacaaatgaaacaatttccttcttctagaaggcggaatagtttttcgct

SEQ ID NO: 677 - DNA, 51539 bp, Human
ttgttgtctttatatattaacatatacaaggtctcactctgttgcccaggctggagtacagcagtgcaatcttggcttattaaagccttgacctcctgggctcaagcgatcctcccacctcagcctcctgagtagctgagaccgcaggtgtgtgccaccaaacctggctaattttttgcaccttttgcagagagagggtttcaccatgttgcccaggcttattgtcgtttttgatctctgatgattttcttcatttctcaccacctcagctacacattttaaaagatggtttacaatatttttgtggtgttttgtattaggagaattcttcagcatctgctgtctaccatattgtcagaaatggagtctagccatccttcccggcccatttcaaacgggttcctcttaggaccaggagacctcacattatgtgtgtcctaccttggcctgtggtttggtcacttgtgtgtgtgtgaacttcatcctccttgagggcaggaatatggtttcctctctttcgcttccacagagtcctgtccagagttctgcacaccaagactgtgtaaatgaatggaattgcatctgggagctcgaggcacccatgcaaacctgtgctgccagtgacttccaccagagggcagcggcagcaggtgccggcgctggggcaggactgggaggagtctcactctgggggcgcctggttccccgtggctctaatacttgccgcatcaaatgcatacacccacctttaggaccgaacccaatggaggaggaccgctcctcattccacatgttggggaaatgaagacaagcaaggatgcaggaagtggagggccaggagaggtggacctgggatgggaccaactgaggcagggccaggatttggaaccaaaccccttctggatttgaccacttccagggccctgcttggacaaccaaattatctattccttttctcattcaataaacatttattcacctcctaccatatgctccacagggagtaccatgggaattaaacacgcttggcccctgccttcttcctatagcgtcagtctgctgcagtgcaatggggcaactcggggtttctcaggcagccctgggcttccttccttcagccctttgctcctgctattccttctggcccagaggcctcccatgattgctgtttgtcaaaatcctgctcagccttgtagacccagctcccatgcctgactcccacggaggcatgcccagtctggtacctggagatgggatagctggccccactgtgccatctgacggggcggctcccacaaggccttggcacccttccctgtagaaggacttgtgggatggccatctctcaggcccttcccaatttatatttctctgaggggagacttaggctcttatctccaaaagtgcatcaagaccacaccctccttcccaaccaccattgcacctaaggttaagataaaactcaggatttaatccaagagagccaaattacacagaccgggacaggcaatgggtcattcactccctcttccaatatgtactgattgagcagctactacattatcaattttttcttctgggccaccagaaatgaggcatggctcttccacttcccttcttcttagaagaccctcggggaagtgtgtctgcatggatgcgtgtgcatgcgtgtgtctggctccgtgactcttggggtgcagcctggatgggtgggctcccagcacaggcagctggggctctccccaccagcccctgtaacagcagcccagcttcctgcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattgctgacggcagccctctcaggtaggcccccttccctcatctcctgccactggtgctggaggagccgggtccggccctctcagtcccctttctggttgtttccttgtggtcacttttctaggatcttttagccaagactacactcaggtaccagggaggtccagcatctggggctaggagaggacacaggagcccctcgaggggctggggctgtgcctggaagcctcctggagtgacagaatgtgggaagcatgctttgtgccttaccaatgggtccctagggtgtgaggagggaggtgcctctcccatccttaagctcaggaactcccccatttcctatttcttgccaactcttaagaaggaaccgttcaccttccagagaggcgggaccactgatggtggtactttcaacgccaaagctgaggcttggggtccagcaggcgtaggccaatcacaggagagcaccgcccgaaacaggactcagggaagccagggagagttctggacaaccaggcgctgatggcctcagcacaaccagctggggtagtctagggcataagcgagcatgaaggccacccccacgtctcaagctgcccccaagtgtcaaggcacctggccacctgggccagggaatcagatggccagaaggtttggggcactagactgtgctccccagatacttgctggcccctgttgagtgcagggtccaagctggccagagcggggcaggggcctggagatgcaagagatcctgaccccatcgagctctcacattttgggatttgggaagactggtatggaaacagaattcgggccaggggagtctgggtccaccttgcagccagagagccaagtgctttcattttgtgatggaggagacccaggaagacccagtcaggagggggcatcgagctggtttggaggactgggtacatgtcgcgagactctgggcagggagtgctctcctctctgccttgatctccaggcatgtgttccgagcctgtggcctcatactggttcagggaaagccattcggctctgggaactggagtttgtgtgccttcagctctgtgcatgtagctttgccctgctaactctaccaggagtttctggagcagcagctctggaatttcagctgccttctgcccctgagctgaaacagactgtccgagagtggccccctttcctcttccccatgaagccc[450 bp omitted]ccataagtgaaaggtaaagggaaacataaaaacaaatggtggcaaaacccaatttctattacgctttagcaaaaagtgaaaagatcgtgaagacccagagctcatcccctctgtgaaaggggtgatgaggaggggagaggagatggcctcctagctctagcaggtattttcttcttgactttgcagaaggactgaaaacaccgtgggcagggaataatttcctcactctgcgatttcagagcattaaacgcggcttctgtaaactctcctgagggttgccaggggtgtatgtcctactgctgaaaaatatggcctctccaggcaggaggaagactgcaccttcaagcagccccttgcccctctccggggctgatgcaagggacactgagctgctacactccaggcctccctgagcttttcttcctctgtgtccagctcagcaggcccaaatgctagcagaacctgacctcagagggcaaggttgacccacatctgcttgtggggagtttgtgttgggccgaccatattggggaaaggagactaggacctccaaggagaaaaagaaggagaaagaaaaatgatggcaaagagggaggaaatggagctgggataatgaagtgcgtgtggaagtttcaggcctttaccccaagaactatttcagggtggggctgcctggctctgccctgggaccacaggcaggtggaatcctgccctcctttgccctggcagacctggctgaaaccttgctgtgctcgggcagacctcccctctccttcttcccccttttattttttaagacagagtctcgctctgttgccaggcttgagtagctgggatgacaggcatgcgccacgacgcccagctaatttttgtatttttagtagagacgtggtttcgccacgttggccaggatggtctcaatctcctgacctcgtgatccacccacctcagcctcccaaagtgctgggattacaggagtgagccaccgcgcccagcctccttcttccctttctaaccctagcacgaggccctatctcctgggcctctgcccaggtggcccgggtgctgggcctggcttggtttgtgttgctgatttctgttgcttagagattcaagcctccagttctccgcctcagtttcctgatcagccaactaaggatgaaggaacagagagaatgaattaggagcccttgacaggggaggctggggtggcatcatgagaccccaggttctgccctggtcccgtctctaattcaccattgactgtgcttcttttcttctcagccatgttttctcatcagtggaaggggggtgctctgtcagacaatctataagaaagcttttgtccagatctgacactatgacgcagtaacaaagccccaggcctttcccgccagggcagtgctgagctccgtgactctaatgccagctgtgctctggctggcgaggtcctcgagggctgcctttgtgtatgaaaaggctgtttgtggctacttttgaaaaaaatagtaattctttaattaacaattttttaataatttgttttttcttaacttgtgagttcaacatactaatcatattttataagccctgtaattttgattaatgactttcgatgggcctttaatatttgagcaaatgaagttgaacagacctagcatccttaaataataaatacccttacaaatgtagctaatcaaactcccttggttctgtgctattccatagggtagcccctacaatcacgcatttaaaatgtgatggtagtccaaattgagatgtgtaaagtgtaaaatatgcaacaggttttgaagatgagtttcaagaaagaatgtaaaatatttcaacaaattttatgtgatttatatgtcgaacttataatatttttgatatgatgggctaaatgaattctattatcacaattaagtttacatattcctttttactttttaaaaatggggtttctggtctggtgtggtagttcacacctgtaatcccagcactttgggaggccaaggcaggaagatcgcttgaacctaggagttcaagaccagctggggaaacatggcaaaaccccgtatctccaaaaaatacaaaattagcctgaagtggtggtacaagcctgttgtcccagctactcggaaggctgaggtaggaggatggtttgagcccgggagtttgaggctgcaatgaatgagccattattgtgccactgcactccagtctgggcgatgaaggagaccctgtctcaataaaaaagtagggggagggttgtcctggaatatttaaaattacatgcgtaacttgcatcatatttatattggataacactgcttttgatattctaagcacatttataaatatgatgaattccatattttatagagcatgaaacaaaatgttcccaagaattttagaaaatgcttttagaactaaaaaactagcataagtgaagtgaatattaagttatttttaaaatttttatagatatgagggtagaagtgcagttttgttacacggatatattacgtagtggtgaagtctgggattgtagtgtacccagcactggagtgttgtacattgtacccaataagtaattttcattcctcactcccctcccatcttcccaccttttggaatctctgatgtctgttactccattctgtatgtccatgtgtgcacgttgtttggctcctacttataagtgagaatgtggtgtttgactttctgtttctgagttattaaagcgaatatcaagttctcttaaatattctaatgtttacagatattgtcaaattctcttaaattttctacttcaaaattgaaccgaagtcaattacctgctcacattcatgaggaactcaatggccaaatgtttttaaatatcacaaatataggactttatgcaactcacggagcttgacccaacttacatttaacaccattggatatatactatgagtgtttgtttatttaatcatctctattttctaaattctaatcttcctgggtttaaaagccacttaccaaggaggaaacaatggcgccattgcaggtaacttgggttatgccaagcaggttgaagtttttccatctcagtggactgagctgaggtcggtgtttttgttgttttgccaaaacataagatatggttcccctgtgttgctgatggatgcgcttgtgccctttttgatagtccgtgccctctaactgggctggctccttgacctatgaactctgaatccaagttatacaaacctaatcccctacatctgccgtgcatctggccttattgtttgattggactgaattaaacacacatgtttacttttctattctgacctcttttcacattcttcctgcctggcaagacttcatctcatagatacataaataatttatgacaggcttctgcatctttctcccggcttagcttggctctctggccacaggtcaatgactgatgacagttagcgtggccttcaccgtattggggccatggaacggggtagctcctagggtgctggagctcgaactttacagagggatctagaatgagtgagaaatgctgcccatggccctcctcattcagaccacatttattaaggctttatttattatatttatagaacactcaagaattaaattcagtacccagctgttagattctgagttaaggaatcagacttctccctggggcaaggaggaataaacaggtggccccaactgtcctttaggacaggagcttggagtgtagacctcccaggtgcgtggccatcctctccctgcctggaccacagatgggacaccatgagctttaacatccatgccatgtgctcaggcctgccctgagcagccccctggtagggctgggatccccaggctgtatctacttcctcagctagcaagacctccaggccctccatcctgtcctcggcactggcccttctccagactcagagcatggtaagttatccagcatagctcttcccggagcactttattccagcccaccttcccagtgttggccaaggtgtcatccagctgacaatttacttaacgtaatttccctcctttttctttctttcttttctttttttttagatggagtctcgctctgtcgcccaggctagaatgcagtggtgcagctcactgcagcttcaaactcctgggctcaagggatcctcccacctcagcctcccaaatagctgggattacaggcgcctgacaccatgcctggctactctttcttaattgatgttttaaaatgcaaatacatttattttgagaagaaactttatatatcactcccttaaatggaaagccattcattataaatcaccatcatgattataatggtgaaaataaacataatggaaataaaacaatgttactaaattctagccagatgcatttgctgctttccctttcctcaaaagggagggctgtagatgtcagagagactttaaagactaaccccatgggagatttcctcctccaagtctgtaattagaaaggctgaaagggaaataaagagtatgcataacttcctcatcatgtaatatagtggtatataatgccaagtcaatgaccacctaaatcaattttgcatagttttgtgtatgtgccctagactttgaaaacactgatccagagaaaggacaaagggggtgggcatggtgtcccctgacaagactgagcctggggacgctgactgctctgcagcctggggttacgtcctacacatgagacccccatttcaggggctccccagtaccctgagaagtccctggattttcccagtgagccctgaggttggggggcacccgagttcacctcccttgattccgctctgggaatctaggcccctgcagcctggggaggagaaggaaccttgaggaggggtgaggtgggtgtggactttgagaactagctctggtcctaacttgctggggaatcttggtcaagttccttcctttctctggccctagtttcctttctggaaaactgggtaaattgaacactaaggacccagcctaaacatgcttgtactttatgtatgttccttgaggctttacaggttatggagcagggcatctggctgtacgcagcagagacccagccactagacacttagccctaggaagggcactgtatcaaccccagccggcatcctgtcgtatagaatcatggaccccggagtcaggcagacgcgggttctgaattgcatctctgcatggccccagggtggtttctttgcctgcatgctagagataaaaatccccaactcaccaaagtgtacaagttaatgtagatgatgcatctgaaaatagccgaacaaaatgcagtgctcagaaatgttagcttataaatgctctacagcaagaccaaagataatcccttgcctatgtgaatacaggactcggtggttaacatagtgctgtttgcacaatgagctccatcacccacatggtgacctcattttatagatgaggaaactgaggtttagcgaggctaagagacttgtcaggacctgagcttgggtctcccagccagcaggctggtgctttttccattgtgtgggagttgcctggcttgtttccagccagctgtcctgtgggctctattctagcatagggtttctcccctaaatgcaaactcctagccttgcagcctcaccactgaatctaggaacagccctgagggacctctgaggtcctagggaccctggaagtcttcttagcaacagatggggtcaagtgtggctgcctccctcatcatggcacgccctcatggggtttgcctgggggttgccctgcaccttggggccagcaggaaggcaaaattaaagaggcaccatgagccaggggagagcttgctgggcagcaggctccatattttgttttgttttcttttttttttttttctttttgagacggagtctcagtctgttacccaagctggagtgcaatgctgcgatctcagctcactgcaacctccgcctcccaggttcaagcaattctcctgcctcagcctcccgagtaaggggaccataggcacccaccaccatgcccagctaatttttttgtatttttagtagagacggggtttcaccattttggcaaggctggtcttgaattcctgacctcaggtgatccacccgcccgcctcagcctcccaaagtgctgggattacaggtgtgagccactgtacctggcctaggctccatattttcatattcattcagtacctgctgagtaccaggccctgtgctggcactgccataggacatgaaggtttgcccttgaacagtttatagtgttgtggtaagacacaccagcaccaccccgggataggtgtggcaacaggcacaatccagtgacagctgcaaccaccacccattaccagggacttaatattctccaagcaccagctatgcatatgctgttccaccctgacaacaccaggacaatcaccccttttttatgggtggagaaactgaggctcagaaagttatgtattttgtcccaggttggtggctaatgctgaatttaaatccatgtcatgatatgtcaccactgggggaagctgactgatgggtacacaggatttctcttcactattttggcaacttcttatgagtccatagtttgaaaataagaagttaagggggaaaaaaggatttcagccctttctggtggctcacacctgtaattcagcacgttgggaggccgaagtccaagagttccagaccagcataggcaacatagtgtgaccccccacgtttacaaaaaattaaaaagttagccggatgtgagattcatgcctgtagtcccagctactcgggaggctgaggcagagaatgacttgagcccaggaggttgaggctgcagtgagccatgatctcaccactgcactccagcctggacaacggagcaagaccttgtctcaaaaaagaaaaaaaaaagtatttcagaaagaaggacccatttgaaggccgggtgcagtggctcacgcctgtaatcccaacactttgggaggtcaagtagggcggatcacttgaggtcaggagtccgagaccagcctggccaatatggcgaaaccccgtccctagtaaagaaatacaaaaattagccgggtgtggttcgggggatggggggcacctgtaatcccagctacccgcaaggctgagggaagagaatcgcttgaaaccgggaggcggaagttacagtgacccaagatcgcaccactgcacttcagcctatgcaacagagtgagactctgtttcaaaataattaattaattaattaaattgaaagaaagacccatttgagcagaaacctggaggtgggacagcctacgagggcccggctgaggggaggtgctgaccagccagtccggctggtcctgttgggtcatgttgggtaggcaggactgaaattcccaaaggagctgaggtccaggctcttttctgcctcctgacccagactggtgtgccatgaggattcaatgagcgccaagcacagggactggcccacggaaggtgcgccacaaaatgtacatttacaagtgttaggcaggcagtacaaggatcacgtcctccagtgcagcactctgcaaatacgtaaacctgccttctcctcgtcacagccctaaggaggtatgcgctactatttaatacttccattttactgagtaagtgacaggctcagagagataaagtgacttttcctagatcgcaccactaatagatgacagatacttggttttacctcatgactccaaatccgttgctttttcccagccctggaattgggtagggtttgggccggggacccctccccactcaagactcctgcaggaaaggtccgcccttcccccagggacttttcacctcacccaccatcagctgggctgtcatggaactttatggagcctgagctctcctccttcaggctgagtggccatgcccagccttcgtttccccggctgtaaagcagggccaacgggagctcagagctgtgtggggctccccagatgttggcggtgacatgcttggagaaatgccaggctccttagggtgttaggagagacctgtggccacagctgctgctccgactgggaccgggcaggcgctcccagggacaacagagggaggcagagggaagcccaggttcccaccctccattttgtaggctcctgcagcccgaacgccttctgcctgaaaatggcggctgagagaggccaggaggcaggatgcagggctgaggaggaagctccggggctgggtctctggtccctgggagatgctgagagatagggagatggccctgtcataggaatgtggtcccctgttttcccttgtatggaagggtgcccctgggtctccaccgtgtgctagggggtgggggcacactcaaaagtccggccaataagtgtccaggccacccccaatctccatcaggaccctgagctgggctgaggtctccgggaggtgccagcagatgccagggtggcggggggggggttctgtgcatggggctggggacagcagatgcccgggtggggggcggtctgtgcatggggctggggacagcagatgcccgagttggcgggggggggggtctgtgcatggggctggggaccagggtcatgtggggacacaggctgtaagagtgacgaggggccttggggctaggggcttcttgggggtcccatctgaggacctcacttctgacttggagtcatgtactgagccctgtggcagggagaaggcagaaatgaagtcactgtgtcctcggagtcagatgcaaagccaagcgtgactctgttcattttacagaaggacagactgaagcccaagagcttaagtaacgccgccagtggctgacagagctgggagcagagtcacttctggtcactggggtttggagggaggatgtttatctgcacttcagtaccctttttgctagggtgttcacctctttcaggaggggtgcctgggagcaggcgggcgcggggagacagagctgaggaagccccccaggcctggaggaggcccgttccccactccacttggtgtgctctcgttttgcctccctccctccttcaaccaaactaaaggatgcacagttgccaaatggattcagctccttggagaaatatgttgctttgccgggatgggattctagaagtatgacaatgtctgagctggaagaaaccccagcgagctgccagccatctcctgtttgtcagaggaggaaagcaaggtgcgaagtggggaacgacatgccccagggtcttggagcagggctgagaagcccagtctttccagggcctcttcccacgctgcccagcagggcatggcggggcctgtgtgaaccaggcacaggcttaactaactccccacccccacccctagagagaatgcgggggactgctatggcccagtgtggcctgacatggtctgacatgaacacaggtgaccctgggcagtgacatgctggcttcatgtagctactctgcccagcccctccaacggctcctccagtcctcaggctctgcctcctctttgtttttttacttcactttttttttttttttgacggagtctcactcttgttgcccaggttggagtgcagtgttgtgatctcggctcactgcaacctccacctcccaggttcaagcgattctcgtgcctcagcctcccgagtagctgggactacagtcccgcaccaccacgctagtttttgtatttttagtagagacggggtttcaccatgttggtcaggctggtctttaactcctgacctcaagcgatcctcctgcctcagcttcccaaagtgctgggattacagacgcgagccactgcacctggcctgttttttcacttaacttttaatttcaggctaatttcagacttactgagaagttgcaagaacaatacaaagaatttccccatgctcttccctcagactctccaactgctaacaattttccacatttgctttattatttcctctcaatgtgtctgtttttctattgctttccccctaaactgtttgagagaaggttgtaatgtccctttctcctaaataccccaacgtgtgtttttgttgttgttttttttttttacatacggacattttcttacataaccacagtgtacttatcaaaaccagataattaatgctgatacaattctattggataatcgacagaatttattcagattttgccaatggttccaataatatcttctaagacaaaagaaattttgttcagtatgctgcatttaattctcgtctctctattctccttgaatctggaatgatttctcagattttctttctctttcatgtcattgatctttttgaagcatagagcagttattctgtaaaatggccctcatctgggttgtctgatggttcttcatggttccatttaagtcatgcctgtttggcaggaatatcacagaagcacgttttgtccttcccagtgaatcatatcaggaggcacatgggctctccatgtcccctctccggtggtctaacttgcttggctaaggtgttgtctgctagatttctctgctgtaaagataatttcctcctttgtaattaacatgtatcttgtgggtagattctttgagaatatgtaaatatcttactcttcctcaaacctttgcccactagttgtaacattattgttgattcttgccggaatcagttattataaggatggttacctggtggtgatattataattccaccattccttcttcattaatagttgctgactcggctctctttgctgcctccgtgggagggaggcaggtggctcagtgcatggcaggctggtactaatgaggccaaggtttgagctccctttccactgtgcctctggtggctgctgtcttgccccgcctcggatattggagtctgggtcagcacctctccaccttagggctagttctccctccatctttacaattttgccattcatttgttgagctactagtatgtgttaggcactttttttcagccactgaggatacgggacaaagtcccggtcttcaagaagcttctattctaatagggaaaatagaccaaaaacataaacacatttttaaaatagtatcatttcagagagggatatgtgcaccaagggaaatcaggcaaagtaaggggactgagagcggttgcactggagacacaggcagaacctcggaggggatatagacctgagtgatgagatgagctgggaatgctgagatcagggagaggacattcccgtcagggggaggagcaggggcggaggccctgaggcaggaatgagattgatttcagactgatggaggagtgaaggagatggagttggagaggctggcagggcttgagggcatagataatagggtttggaattaatccaagggaaatgggagctcatcagagagttttaggtgtagaaggatgtgatttcatttgcccttcatgcatatacaattacttaagaattttgtacatcaactcctttttttctttttttaaacaaagatatagaacgcttcacgaattcacgtgtcatacctgtacaggggtcattctaatcttctctgtattgttccagttttcgtatatgtaccgccgaagcttgcacccactcctttttttttttttttttttttttttgagactgagtttcgctcttgtcgctcaggctggagtgcaatggtgccatcttggctcactgcaacctctgcctcccgggttcaagtgattctcctgcctcagcctcccaagtagctgggattacaggcatgcaccaccattgcctggctaatttttgtatttttagtagagacggggtttcgccatgttagccaggctggtctcaaactcctggcctcaggtgatctgcccgtctcagcctcccagagtgctgggattacaggtataagccaccgcacccggccaccctctccttttataaacttaagtttatttgaacttagaaatctgtcactatcatgtatctcaaaccaatactacttaagtaaatagaatatatatatatataaacaaagaaaacactgaaaccaaaagtgtcattaaatagcctgccgtccaagcatgagctgtctctccattcattaagaagtgttaggtggccaggcacagtggctgatgcctgtcatgccagcactttgggaggccaagacaggcaggttgcttgagcccaggagttcaagagcatcctgggcaacattgcatgtccccatctctgcaaaaataaaatttaacaaaaagtgttaggtgttaaagactaagtagcagcacaatgagactttctccttaatgcagtcggacagaaaaattggaaaaggaataatttgtttactgcatgattcagttccatttaatcttatatgttaaactgtctttctgactcagacctgatttgagaagcattttgctaactggtggaaggatttgacaggcccagcccacccatttaaccatggagaaactgaggccttggaacggggcaaggacttacccaaggtcctggtaatagctgctctccattctactcaccctcggtatcactcccacccaatgctagctgaaaattcagatgtgatgtaaacattagtcatccttattgtaaaaacgttataacaaccacattagaaggaatgcaaagagagaaaagaagtctcagccagcaccttcacacaacccggctgtttgttcttgaaggaggaagtttttgagtctgtggagcgtcatgggccttcagtctcaccagcaggaaggtgggtggctgatgggtgccgggctggtgttgatccacacttgtcaggtggctctgagaccagccttgactccaggctccaccacttccgccatgaccttgggcaagttcccaaagctctctgaggtaaaatgggtgtggccatgtcactcttcagcttttgcgctctaggtagatgctaaagccttccctgaagatctctatggaacttttagtcacctgcatctgtgggggctgcctcagccctaaccatgtcaacatagtgttgaaattcagttccgagaaacacttgtgggtttgtagactctatggcatctggaagtgaaagagggacacatctctccctcttacgggttccttcccccgctctcaacgcccctaatccagaatgccctagaagctcttctcagctcccaccttctgccccggaggcagcttttgttgcaggtacacctgtggtttagtttactagagttgctgcaacaaactgagtggccagggcaacagaaatgtattgtctctccctggcgccgtggcgcacagctgtaatccctgcactttgggaggctgaggcgggcagatcacctgaggtcaggagttcaagaccagcctggccaacgtggtgaaaccccgtctctactaaaaatacaaaaactagttgggtgaggtggcacgcgcctgtaatcccggctactcaggaggctcaggcaagggaatcgcttgaacctgggaggcagaggttgcagtgagccgagatggcaccacagtgcgagactccatctcaaaaaaacaaaaacaaaaacaaaaaaaccagaaatgtattgtctcacagttctggaggctcaaagtccaagatcaaagagtcagtgggactggttccttctgagaagctgttctcttctgagcttctggtggcttgctggcaatcttgggcatttcttgacttatagaaacattgccccaatctccgccttatcttaaaatggtgttcttatgtgcatgtgcctgtgtccaaatttcccacttctgtgaggacaacagtcatattgaattggggcctgccctgatggcctcatgctaacttgattgcccctataaagaccctatttccaaataagctcacattctggggtactggaaattaggactgttttaagaggaggggaacaattcaacaactcgtagcaatgtatgtagtgtgtatagggtgtgtgtgtagggtgtgtgtgtgtacatgtatgtatgtgtgtgtggtgtgtgtgtatggtgggggggtatggagaaagaggtgggtcactgccctacttaatctctcctcctagcccactcatcctctggagagatgcaagttagatatctcaggttatttggcaaaggcctggaaagaggtatctttccagaggagaggagttacccctgagaactcctactcatcctctaaaacccttcccaattgtcccctgtttcttggagtcagttattccctcctaactctgttttttttccagagtacttagttccaagcccaaggatagcatttataactgatcgtaatcaaccacgagtgcatctgtatcctccaccagggcatggggcctggcccagagcctagctgagagaatggaatgaatgagtggcatctccctgaccaagggttaagatagatgggaactcagaaggactttgagccgcctcagaagcatcctgtaagtgacttgtgaagaggagtaggggacagccgtgtgggctgagagctgagagtgtgagatcagattagagagactggaagtctggctccgcctcttagtaactgtggccttgggcaagtcatttcatgctgcggagcctcagttttctcatctggaacactgagccttcacaggctcctcatggagatgaataagacggtgcgtgctgtatacataaagctggggcacacagtgggcattcagatgttaccttccttccaaggaacccatatttttttcctgaatttgaattcctgaatccactggcactctgagccacgtagatccacatggccattggccgctgtcagcccccagctgttaaggacgcaaggtggccacaaagcattagtctgaacatccctggtgcctcccccaggttctctttgaatctggatttatttaaagagaggaggtgagtggtaggtgaggagggggctgttgttaggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaaggggaccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccagcctttgcacagagggtcttgctctggggaattctattcttgaatttaataccttgagtgtctagcctggcccaccagcttctgtcccacctccaggtgtttgctcgagctgtgccctctccctagaatgccttcttaactcttgctacttgttgagggtgcctgaagagtagaaagagtgaatctggggaacaaattcaaatttggatttgaattctggctctatcaatgccaggctatgtgaccgtgggctaggaacttaatttccctgagcctctttgtaaaatgggtttcataatagtgtctcctcacaaggtagccatgaggcaacgtctgtaaagcactcagcacagaggaagcactcggcacagaggaagtcctcgggaaatgtggatctgcttcccttgcctcagcgaaatgctccttgactttgaagtcctggcccaaagggcacctccccggcaataccttcctggactcactcaccagccccaccacttgcagagcagccctgtccctcctccaggttcctcaagcatgtctcctgcctctgcacctacctcagagagacaacattcgagtcagctcttaacatctggcctccaggctggaccacgggctctattacctttactttccacggcagagcgcagcatggctcaagaaatgctgcgggaggtgaagtgagttctagggacttccattaataataagagtaactagaatttgttgagcattcacagcacaccctgaggtgtttatcagagcccaggaaaccctctttctgggttcaaatccctgctctgcctcttaggggctctattgtcccagaaagttccttgtctcttgaatcctacatttccccgcctgcacgatagtgataataacagtgcttacttctgagcattgttaaggagattcaagaatttaaaactataaaaacccatggctttcttacccagagaagggcagaaaaatcgttggcagggtgcattgatatgactcggacaatttacaaaggtttttcatatatgcttttattttaaaatttttttgtttttattttgttttattttattttactaaaattttatttagtaaaaatagtacagaatttagaaaatacaaaaacagaaaaatttaaaaatttatcaatagctaccttcaaagataactgttgttactagcctcttgtagaatcttccagacatttcgttagagaggaatattgcaaacatacagaaatgcattgagaatgacatttgtttatttgtttatttgcttttgagatggtgtctcgcactgtcacccaggctggagtgcagtggtgcaatctcggctcactgcaacctttgcctcctgggttcaagtgattctcctgtctcagcctcccaagtagctgggactacaggcacacaccaccacacctggctaatttttgtatttcagtagagatggggtttcaccatgttggtcacactggtcttgaactcctgatctcaagtgatccacttgcctcggccttccaaagtgctgggattacaggcgtgagccaccgcgcctggcctgagaatgttttaatgaacccaatgcgtcctcaccacccagacttagaaaatgtttacacttttgccgtatttgctcagatctatattaataagaaagaaaaccatacagatactgttgaaataattcttatcctttcctccctagaacacacactccaaagtgtggtgtgtgtacccttttctcccacatttttatactcctattacacaaaaagtgtctccatacacaatggatggtattgagacatgtactatattttatataaattgtaccctactggacatattgttctgaaacttattatacttttctccttgttttcaaaatctaaccaagtggatagatatgcatctagttcattcctgcaatggaataatccagcctatgatacaatacagtctgtttatttccagctgatggatggttagagtacttctaattttcttctgttacaaacagttccgcagaaagtatccctgcacacatctgcatgtgaacaattttttctataatttatacaaaagggtatagctttcagatcaaggtatgagcctcttgaaatctatgaggtatcatcagccatttccttttctttctttctttcttttcttttctttttctttctttttttttttttttttttgagacggagtttcactcttgttgtccaggctggagtgcaatggctaaatctcggctcaccgcaacctccacctcctgggttcaagcgattctcctgcctcagcctctcgagtagctaggattgcaggcatgcgccaccatgcctggctaattgttttgtatttttagtagagacagggcttctccatgttggtcaggctgatcttgaactcccaacctcaggtgatacacccgcctcagcctcccaaagtgctgtgattacaggcgtgagccccgcgtttggcctcatcagccatttttctctgcacaatatccataaggctatgatcatcctgaatatgttgtttttcatctgttttttccatctacgatacatatatgcacacatattcatctttcacgtatttgcaggtatagtcattgattccacaagatcttgggcatttgccatgggccaggtattgggggtttttatggtaatctttccttagccctgtgaggtttttgtttcgttttcattttagaggtggaatctcaccctgttgcccaggctggagtgcagtgatgatcatagcttactgcaacctcgaactcctgggctcaagtgatcctcctgcctcagcctcctcagtagctagaattacaagcatgtgtccagctaatttacttatttatttattcatatatatctatatatatgtatatatatatgtatatatatctatagagagagacaaaggatctcactctgttgcccaggctggagtgcagtggcaccatcttggctcactgcagcctcaaactcctcggcccaagtgatccaacctcagcctctcgactagctgggaccacaggtgcacaccaccatgtccagctaattttttgaattttggtagagacaaggttttgccttgttgcttaagctggtctcaaattcctgcgctcaagcaatccacccaccttggcctcccaaagtgctgggattacagcgtgagccacagcacccagcctcatttttttatttttaaatttattttgtagagatagggtctcactgtgttgcccaggctgttctcaaactcctggcctcaagcaatcctcctgcctcagccactgaaagtgctgggattacaagtgtgaaccactgtgcccagcttgtgaggcttttttttttttatatataactatgaggtgagggaggcaaggggggcatgtgaagagattcgcccagggtcacactatagtaaggaggaagctgggtttctaacccaggcatgtttaatttcaatccagtgttctttctgatgcctatgatgtggtagatggttttttcccaaccaagacctactgaatgggaattctaaaagagggacctgagggccgggcgctgtggctcacacctgtaatcccagcactttgggaggccaaggtgagcagactacctgaggtcaggagttcaagaccagcctggccaacatggtgaaacccggtctctactaaaaatacaaaaattagccgagcatggtggcgtgcacctgtaatcccagctattagggagactgaggcaggagaatcactagaacttgggaggcagaggttgcagtgaaccaagatcgtgccactacactccagcctcggcgacagtgtgagactccgtctccaaaaataaaaaaaaataaaaaaattaaaattaaaataaataaataaataaaagaagcacctgaatattcttctcctcctctcagtggtctaaagtctggcgggggatcaagaagatggggctggtgacatgccagtgtttctggcctgctgtgctctcttggagccaaatccctactcttatcccttgggattttactgagctgcttgcaaccctccatgggaccttctcattttaccacctggtagctggaaagaaggcacggtctggcacgggagcctgagccagccttggagccaggaccccaggagacttttcttttagaggaactcctgttaccacagcaactacagcccacatctcctccctaggaacactggatgtttgcagagccggggaagggtgcagccaagttgagagtctgcagcagctcagataaggttcacaagaaaggcgaggagtgaggaggagagaatgcagccttcagagaaccagaatcacccccttgcagaaaagaaggctaaggagctgtcagagtcatctttctgcctggtatggaatgtagaatcaatagccagctgccgtcccatagctaccaagggccaaacgagagaaaagggatgaaagcctcaggttggaggataataacaacaacagctaccatataccgcgtcctaagcgttttacgaagatcacccacccgtgcactcttcttctgtttggctcatttatcatgcccagtgccaggttaaagatgaaacctagctgggctcagtgactttccctaggtcacacagccagtaatcagcagagatgggtttagatcactgttctatctgtccccagagtccctgtctaagtcatgaaagacgaatttcccgagaatggaggctgtttcccagatgaattggtgcctgggatctcctgctccctcgatcatcccgctcacactcatctccctcatatcatacctgccccagttcccagcatatgcaacaagttcagcagatgttcatggaactgaatgcaggctggcaacagactcatttctcagctttcaggagaacatggctcacgccctctcactttcttgggagaggagggggagtcccagcaattgaacgtacctcaaagcctgttaagtcatgttgatcttatcttttaagttttttacagaggcgagtaggaaacgttgtcttttacttccccttggatttggtgacagagaggaggggagatgaaacctgggcatgcatggaaggtatcacgcaggtgaacatcatctgtcctgtgacataggggcaaaagaaaggtaaaaaggctgaatttctggccgggcgcggtggctcatgcctgtaatcccagcactttgggaggctgaggcagggggattgcttgagcttaggagtttgcgaccagcctgggcaacacggtgaaaccctgtctctagtaaaatacaaaaaattagccaggcgtggtggcacacacctgtagtcccagctactcaggaggctgaggcaggagaattgcttgaacctgggaggcggaggttgcagtaagccgagatcgtgccactgcagtccagcctgggcaacagagtgagactcatcccctccccaacacccccgccaaaaaaaaaaaaaaaaaaaaaaagctgaatttctttgacctgagtgactgcagtcctctggggctgggactctttgagccttaacttccatccgtctctgtcaattgagtaaattgttttatttgtgtccccaagccctgctgtggtataactggggagtgtgaaaacaaaccaaaatcctgtaacataataccaaataatactcactctctttctctttctctctcaagaaaatgaaagcacatgagccaagttctcctgaaagctgagaaatgagtttattaccgatctatgttccgtttcattaacacttgctgaacttgttccacgtgctaggaactgggacaggtattcgggagataagtgtacatgtaaaataataccaaagcaccaaactgctgactttcctctgggcgccaggggagagaagtcactctagccttcctggccttggagagccaagtgggtataagctggtctagtcacagcagccagtcacctctgcaggctaggacagcactgtgtgactgagcctgtgacagcttcagtttcttgacaaagtaaactcagcccaaccgggtgtcacaggctcttcaagtccaagtcccctcaaaggttgaacacatttatcccctcccaattgaattatattatttgtatgagccagcgcatgcgtctttttttttttctttttctttctttctttttttttttgaaatgaagtcttgctctgtcacccagcctagaatgcagtgctgcaatctcagcacactgcaacctccccctcccggattcaagcgattctcctacctcagcctcctgagtagctgggactacaggcatgcactaccacatccagctaatttttgtatttttagtagaggctggatttcgccatgttggccaggctgatctcgaactcccgaccttagctagtccacccacctcagcctctcaaagtgctgggattacagatgtgagccaccaggcccagcccgcatctttctaattttaatggaattacaggcgttcccttctttctagttgttttattaattgctcaccattaacaataccaagggcatttctaaaaagaaaatagttaggacagttccagcaccctctcactcagagcttcctcccctaaattcattggccctcctcttccaattggccgatgcatcctcaggccctagacagtgctggagtgagccccatatttgagagcaagtggggaaggggtgggggcagtgcgaggtgagactattaagtctcatcttttccctgctgtgaggtctgtgggatgacacatgccacccaggaccccctgccccggagaaggaaggtttcctagttgttgcttatctttggagtctgggatcttttgggaaatgagtccctggatcttgggttctgagttgtgtcaccattgcgggggaagggtgggttatcatttctaaactcagtgctggttgacacttgcagaggagaaaggagtttggaaagcctccagggttgtcaaaacttcctgcctctcgcccttggcatgatcaccaaagcagaaatcaggatgttggattccaacccgggggagtggtgtggttacgaatgtggcctctgcaagcagacagcctgggttcaattcccagcttggccattttctagccgtgtaatcttaggcaagatactaaaccgctctgtgcctcagtttccccatctcgtggtcttgctttgacaattaaatcatactgaataaatgtcagccattactgctgagctgtgccagatttgtgacgggtgctcgacgtgccttggggcctcccctttccctatcagagcagtgggaagcatcacaacatccttcccttatccccctgcactctggaccccagatgcccgagataagtagctactcccatcagtgtgggttgggagtagaaaactaggagtccatctggctgcttcccaaacctgcaaaccaggaatcccagtccagcttcccggccactgggcaaggggcaggtgagtgtttccggacagctccctgaaccagtcctgctccacttgaatacctggagtctgagccagggcctcgggaggtgggcccaccagggttcacgtagcatttgtcatcactgctcgggacaaaaggccagtcttcatacacaagatgcacggtggtctgcaggttagcagggagcacgcctctcccaaggttcggggacactagtcacaagggcctggtgccagtcttgcagagaggcacaccctgccctgtcctggcagtgctccagagcagcagctggactatccgggagatcactgcgctgcactgggagcctgacctccccgtgggccttggggatactcttcctttgggccgcagattttgcaatatttctgacaaaatacttgctgacaaaaagccttctgagagaagcattattaactccagttcatggatgacagtctaaggctcagactggcaaagtgactggccaaaggtcactccactaataaggaacagagctggactccagcccaagcctttgaactcaaggccttgtaaggtacataggtaccttccccccatacagcactgtctgatgtcaatatgtgagtcacatttataattttaaatttttggctgggcatggtggctcatgcctgtaatcccagcactttgggaggccaaagcaggtggatcacctgaggtcagaagttcaagaccagcctggccaacgtggtgaaaccccatctctactaaaagtataaaaaaagtagccaggcatggtggtgcgtgcctatagtcccagctactcagggcgctgaggcaggagaatcgcttgaacctgggagatggaggttgcggtgagcccaagatcataccactgccctccagcctgggtgatagggcgagactccgtctcaaaaaaaaaaaaaataaaataaaataaaataaaaataataaataaataaatttttagcagctgcattttttcaaaaaagtaaaaagaaacagatgaaatttctttaataatatatgttatttaactgaatatatccaaaatatcatttctacacatcaataaaaaaattcttaataagatactttacattctttattcttaccaagtctttgacacacaacctgtacttcacacttaaagcatgtctcaatttggacactcaagtttcaccagaaacattcaatctgtatttagatttcatactagttacaattgaaaaaggagaatcacatatctaacttactctggccatttgaaaaggttttccaatgattgaattgattatgcctttaaaattaaatggaaaacattttgtaaattaaatagaaatgaattgaattaaataaaatgaaattttgagtttctcattggcacgaacccatttcaagtgctcagtagccacacgtggctggtggctattgtactggacaacacagcaccatatgattttccctccgagtggggctgagtgatctctaagcccttcaaatgtatgctcctcccctgcgtttatacagatgagtgctttgtgtaccatgggcccacttccgtgatgataaatggacggtgtaggacagatttcccatctatattgacagcatactgaaaacagtatgctgtagtagttaaaagggtgatttctagagccagactgtccaggttcaaattttgctttgattactgaccagctgggtggccttgggtgatttacttaagctctctatgtcccagttttctcagtgatgacactgggatgatgatattaatagtatgcacctcacagggtggttgtaaggatttgctagtacatgtaatgcacacagataaccgctatcatctatggggcatacagtaagtgctcaagagatgttgcctttcattacatattttatctaattataatcaaagaatgtaaggactggacaagatcaaaatctcatcaatctgtcattatgcaagtgacaaaacggggccagaaagtgaaagaactcattcaaggtcatgtagcaagttaatgatagaaatcaactgtcagctcctgacgcccaacccagtgaccctctccactgtgcccccaacaatgctgacattgccgagaagagacaccctgacctgccagccacatgagctcttcaattcttccctgggaatgagtatggctttagctggcgtggccacactgtctgcccaggtgctctctgcaggctcattggagcagggtgactgggtagtcagtatgaaagctcactgtattagtacttcaagctagcccacatgtccccccaggaaaaaagccctgtgtatttatttggggacttttaatttttatttgatatagaacatttgaaaaaattagaacaacacaaggcagaaaaaaaaaaaaaaaaaaggaaaacaggccaggcacagtggcttatgcctgtaatcccagcattttgggaggccaaggcaggcggatcacctgaggtcaggagttcgagaccagcctggccaacatcgtgaaacccagtctctactaatatatataaattaggcgggcatggtggcacatgcctgtagtcccagctattcaggaggctgaggcaggagaattgcttgaactcaggaggcggaggttgcagtgagttgagatggcaccactgcactccagcctgggtgacagagcaagatagaaaggaaagaaagaaagagcaagaaggaaggaaggaaaacttattaataccatgtgggcatgtattttcttttcctatagtagagattaaatttaatttactgatattcttttagcatctctcctgggcaaggcactgcgcaaggtcctggatatatgggggtgatgcttagaatctagtgagccgatggttgtcagttcatgaccaggatagctatgtaattaaatgtggctgggcccacatgaaaaaaaatctcaggatgcagtgagaggacagaatgggagattgtactcgggctctctgtgggtcctggaaaaccttcagaagcttaaaacatggcggggggtgaggacggggactgaaggggagagtacaaccatacttataacataaccctgtattctgcttctgccacttaacattgtggcataaacttatccccacatcattaaatactccctgtaaatttttttttggcaaatatttttaatgtgctatatttttctaaccaaccccccaatcacttttagacaatccagttgtctccggtttgaatttttttttggtgggtttttatttgtttgtttttattatgctatcagaaacagcacagggtcgggttctgtggctcacgcctgtaatcccagcactttgggagcctgaggtgggcggatcacttgaagccaggcgttcgagatcagcatggccaacatagtgaaaccccatctctactaaaaatataaataaaaaaattagccaggcatggtggcaggcgcctgtaaccccagctactcagtagctgcggcaggagaatcgcttgaatcaggagggtggaggtggcagtgaaccgagatcgcatcactgcactccagcctgggcaacagagggagagtgagactctatggcaaaataaaaataaaaataaatataaatataaatataaaaaaccagcacatcacagcattctggggctccagtggatggaaaagggaatctagaaccatctagttccaaagcatggactttagtctccaggcagtatggtacttgagatagttttatttaggataggttcccagatgtggaattactggattgaaagagcttggtttgctgttgttgttaaggctgttggcatctgtgtttgcaaacactttctgttgatttttttttttaactatacttctagcaggtgacacatgcacctggctgcaccacttgtagattccacctccatgtttccatcgtccctttccaccctgcctctggctctgtacagcatctcttcatccatcatccactcaacgagcattcaggatgcaaccgtgttttcctcagcacctctgacagtgccggaggacagaaagtaacctcaggtgtagctggtgttgacctgacactggtcactgggcacggccagagcggcattctggggagtgccttgtttccccaccaggcttgctctgacactgggctggccagcgggaggctcagctttccctcgatgtctatgcctcctttctccacaagtccctcacctctcagatgcccatgggacatctcaggagcctgggtgacacaacaggagtatcagtgtcccgttccgttttctcaaattccaggcaacaaggctctttcgtgccttcattcttcctgtgcttacagtctcctccgcagcccgttccactggagtcttcttcccactaccccattggaggttctgtcccactcggggacttctgcatgggactggcctgaaaaagccgcctccttcctgggctggggtcggcactcccaacctctttcttctcctattctgaaaccagccgctcccctccatcccttccctgtcttgttccatcactttccagaatttgggacacaactagagatgattttcaggggcacacagtataacttcaggtggtaaatgaacttagcattaaataacactgaatcatgtggcaataaaagtttaaataattattatttttcaatgttttgtcattccttctgattctatcagatagtctgatgatgatgtgtctttttttttttttttttttgagacggagtcttgctctgtcgcccaggctagagcgtagtagtggcgtgatctcagctcactgcaacctctgcctcctgggttcaagcgattctctgcctcagcctcccgagtagctggaactacaggcacctgccaccacgcctggctaacttttgtatttttagtagagacagggtttcaccatattggccaggctggtctcgaactctggaccttgtgatccacccaccttggcctcccaaagtgctgggattacaggcatgagccaccgtgcctggccgatgatgtgtcttttaacatctctaacatggctttatttttagtatgcttgtttttacaattaccttctattttaagcaagtcatataaatcgtccctttaggttttaatatcttcttatttttttcatatcaacatacatacctaattttacatacatagaatcatatcatacatgatttttaaagtacagccttttaccttcattgcttgcttttcctccccctatcttccatggctgtgactgtgtcccacgaccagctgcatagtttgcagggcccagtgcaaaacggagatgcagggcctttggttcaacaaatgatgaggaatttcaagatggcaacagcagaggattcaagcaaaggccgggtccttctaagcacggggccctgtgcacagtccaccagcctgtggagctggccctgcttggccccttcccctgaagcccactcttaatttttccattttgattatctgctgtgtgttctcccacacttatcttcatgttcctgcaatcataccagttcacagagggggttttttggccttgcttcacaaaaaatgtatcatattatattctcttctctgcatcttgcttttcctactcaacacagcttggaaatcctgccaacccatctgggtctatttcattctttataaaggctgcataagatgccatgctgtaaatggaccgtaattgattcagccgtttcccctgtgaatgggcattcactctgtttctaacattttgccattcaaaaatctgcagtggactgggtgcggtggctcacacctgtatgcccagcagtttgggaggctgaggcaggcagatcacttgaggtcaggtgttcaagacccaacctggccaacatggagaaaccccatctctaccaaaaatacaaaaaaatttagcagggtgtggtggtgggtgcctgtaatcccagcaacttgggaggctgaggcaggagaattgcttgaacccaggaggtgaaggttgcaatgagccgagatcacgccactgcactccagcctgggtgacagagcaagacactgtttcaaaaaaaaaaatctgcagtgaacatttttatgatcaggtgtctttaatgatgtaaaaaagcaaattcacaggaaagggtaaaagtttgctcttactctgttttgtgttgctataacaaagtaccacagagtgagtaatttaaaacaaaaagaaactttattgtctcatagttctgcaggcgtggaaagcccatagatctaggggccacatctgatgagggccttctctctgcatcataacacaatggaaggcgtcacatggccagagagtgcacgagagacagagcgagggacggtggaactctcacttttacgacaaaaccacttctgcaataaccaacacacccctgtgataacagcattaatccgttcatgaaggcagactcctcatgacctaatcaactcttttcttttcttttcttttcttttcttttcttttcttttttgagacacagtctcgctctgttggccaggctggagggcagtggcgcaatctcagctcactgcaacctccacctcccaggctcaagcaattctcctgcctcagcctccggagtagctgggattacaggcatgtgccaccacacccgaccaatttttgtatttgtagtagagacagggtttcaccatgttggccaggctggtctcggactcctgacctcaggtaatccacatgccttggcctcccaaagtgttgggcttacaggcgtgagccaccacgcccagccctaatcaattcttaaacatccaacttctcaacacaggtcattgggggattaaatttccaacacatgaaccttggaacacattcaaaccatagcaggctccttttcaaataaatttattgcagcaaaaaagtgaaccaatttaaagaaaagtgtgaggcacagggccaggcaaaagtggtaacaatgggccgggtgtggtggctcacgcctgtaatcccaacaatttgggaggctgaggtgggcagatcacttgagctcaggaatttgagaccagcctgggcaacatgggaaaaccccgtctctacaaaaaatatacaaaaattagccagcatcgtggcaagcgcctgtagtcctagctactcgggaaactgaggcacgagaatcgcttgaacccaggaggtggaggttgcagtgagccgagattgtgccactgcactccagcctgggcgacagagcgagacactgtctcaaaacaaaaaaggtgataatgatgtctgagaaacgctgatcttccattcggccctctgtgaaatgaggcctggatggaaagacggttccaggtaatttctgcttttgttcctgtagcacagaagtcagagaacagagaagccaggttcccttcttgggataggggatgggagaatgcttgacacaaaaataaagccctcgaggttatccgctttcaaccagctgccttggagctggcagctgctgctcactcattcattcagtcaatcaacaaacattgccttggacactgtgggggacacagggctgacccagccatgggccctgccctctagggttttctgatctaggagaacacatttttgtctttatgcatgagaaagtggttttccagacccagagagagagatgatacagagcagagctaaagcccccctgccccacacacatcacattcacacacacagtcgtaatcacatatgcacacagtccctcacacacactcatatgcacacacctcacagtcatacacactgcagccatcattcaatccccctcccccaccccatgtagtaacattgaaaactacgcaggagcactgggacggttgctgtgggaaccgggattctgaaatcctaacttgtgggcatctgaattcttgcgctgaacattctaatacatcagccacagagtttatgctctgaatttggagtcatttctcctccaggggctcaggctgggcagacagccagggagttagcgaggacggcaattagagggctgaagactttctgcctgatgatgaagaggcccacacggtttcctggagagggctgtctgccagggtgtgcacgcgcacatgcacaagctcaggctcagggggtatgtctgtggaatctgctcaggtgaagctccaggaatgtgtagtggtcatgtccgagtcttcaggctctgtatcggtcaggccggactaggcaaggctgtagcaacaaggacacccccaaatcttcatggtttaacatgataagggcttactccttactcacacaaaatccaagctgggtcaacatccccttccctcttgcagttcctccgcaacccagggcctctaatatccttcaacagggaagacgtaaatggaaatggctcactgcctcttccctgctttggctcaaaagcaggcagacgtcttctgcctaggcttcaaccagcccaacctaagtgcaagagaaaccaggaaatgcagaggagttcataggcaaccacaacagtccctgccccagagcctccctttgtgctttgcaagcccaaacatcccagcccagaggggaggcaagtccttggagacagtttaaatccgggctctgcagcttgctcactgggtggcctcaggcccacgcatcagttgggttcccaccaggaaacctagaataggaatttaaaggggacttatttacagaagaactatttacaaagggtaatgcagtaagtagaatctaagagcaacttctggccaaaggagacacaaccagggagtggtcagtgagtccgagtaggagacagtcaaggagaggtcaccttgaataagcaatgtccttcacatgagggacacagcctacccgagggacctcacagggggggccagaggaataagtgtcacatcttcgctctcctcacttctgcctagctctgctaaggctccccattggctgaatctgacagaagccataaggcccaggaagacaggggttaatccaaacagatcagcctcccagggcagaatggatagtagctctggtggaataaatggaccctatctggcagggacaactgatttttgcttttggagcctccttttcctaatctgtaaaataagaatgctaacacctgcctcattgcattgttgaaagtaaatggaataggccggatgcagtggctcatgcctgtaatcccggcactttgggaggctgaggcaggcagatcacctgaggtcaggagttcgagaccagcctgaccaacatggagaaaccccgtctctactaaaaatacaaaattagccaggcgtggtggcgcatgcctgtaatcccagctactcaggaggctgagacaggagaatcgcttgaatccgggaggtggaggttgcggtgagccgagatcaagccattgcactccagcctgggcaacaagagcgaaactctgtctcaaaaaaaaaaaaagaaagaaagaaagaaagtaaatggaacaatatatgcaaatatgcaaatacctgtccttcatgaatgctagtttcttagtgtctgaaggcactttgcaatccagtggttcccagtccaggatgtgtcaattattctaaagtctgatatgaaattctcaaacaaattctataaacaaaattttctttttctaaatcactcccactttcgagctttttctatatgtcaagtatttcataggctgtctcatttcagtctcacaatattttcctaagaatcatagctgaaaaattgggactggcacagaaagattaagtcacccattcatggtcacgaagccactttgtgtgtctggccccagtgcccactgcctttcctccctgttctactccgatttctgaagctgtgtgtgcaatgaataggtaaagcggaggatcctgaaatgccaatgtttgagaactttccctaccttgaagggaggccaatgcacccaaagttgaggaccacgtcttttccaaaggcctcatgtagccaccacaggctccaggaagtgccccctgctcatcagggtgtctctgtggtctccaggcctgagctcactcacccaccatgctgctgctggttcatttcaggtcatccatctccagccccacctgaccagctcaacaccagcagtgcagagagtgagctctgggagccaggtgagcaaacattccctctgggggtccatgatcagctttctgtaggtggtcccccagggtaataaagaagggaaatggacatttaggataccagggaggctccctgacttcagacaacacttcttcctgacccatcacctgaagttccactatcaattcactttgaggtcgtagaactaccatttttgagaggacactgataagtcacatacaggtgggcaggtatgcctggagcattttaaggggatttgttgagaacaggctagagttcttggtgggggaggcagggtccttgatttactcagcagacgtttattaaggacctactgtatgcaaagatgcatgctagcactgggggtacaatcctgggctaaaaggggcaggtggttcccatagaaggggttctggggaagtgaggaccaccatcagctgaagcagcccatcatcaaccccatggccagccgcttcacaatcctccaaggttccctagtcactgtgacagcctctaggacagtaccctcagaggagcagaggggccttcaggggaagcatgcgcccactggaccagggcccctgaactcacaactctgcctttctttcacaaacgggtgcccctggagacaggagcaagtgaggagggtttctagggggctggacccctagttgtctgtcacccatcttaacctctagagtcactcccaagccccaccttcggctgactctaaggagaaccacagggtcaggcctcaaggtgggctcagggatgagccagcccggctccattttgcagactggaaagctgagacccctagccaggcagggcgttgtcaaagttcacgcacagagtcagtggcagagcctgggcaaccctctgcccaggccccaccggtcttagctctctggtctgacacttccaggggagcggcttccggtccgtctgacaaacgggagcagcagctgcagcgggacggtggaggtgcggctcgaggcgtcctgggagcccgcgtgcggggcgctctgggacagccgcgccgccgaggccgtgtgccgagcactgggctgcggcggggcggaggccgcctctcagctcgccccgccgacccctgagctgccgcccccgcctgcagccgggaacaccagcgtagcagctaatgccactctggccggggcgcccgccctcctgtgcagcggcgccgagtggcggctctgcgaggtggtggagcacgcgtgccgcagcgacgggaggcgggcccgtgtcacctgtgcaggtacgagcgcaccccctacacgggcccccacctgccccactccccaggccttcagccactgcccctggctccagaccctggacgcaagcctcgccctccagacctccacccccaccgcctaccagtgcaaacgcaccgggttcccacaccggaggacgacctcgagtcatttccagatctgagcgtttccttggatctggcctccagactccacccccacacttggttcctagtcccacccctgggttcccaaagctaacccggtctctaaccccacttactgggcccgccgcttccctgtccccgcccgctctgggtctctcctcccctttcgccatatacataaacatgccaggttcacagggtccctaagcgctgtggctcccaggctcccaaacctgccctccaggccccgcccaccaggtctctggtccctcccaccagcctgcggctctacctaacccatctgcagtcctggggggattcccagtcttgcctaccgggctacagccctctcactgggtccacaacacgctcacaactctccggccagtccaaccatcaccccaaccctcccttcctggtcgggtgccccagcatccacaaccccctcccacccctagagaaccgcgcgctgcgcctggtggacggtggcggcgcctgcgccggccgcgtggagatgctggagcatggcgagtggggatcagtgtgcgatgacacttgggacctggaggacgcccacgtggtgtgcaggcaactgggctgcggctgggcagtccaggccctgcccggcttgcacttcacgcccggccgcgggcctatccaccgggaccaggtgaactgctcgggggccgaagcttacctgtgggactgcccggggctgccaggacagcactactgcggccacaaagaggacgcgggcgcggtgtgctcaggtcagtgggcggagtcgctgaagcccggtcactaccaacactcaccataggcctactgggcgccaagcctggagttagtgccggagaggtggtccctgcccttgagatgtcacagttcaggaggggagatgagactgagacaaacataattcaggagagaaagtggcaaatgcccccaagaaaggcagtcaggtggagtctagaggcagcagaccatgcggagctgtaggctaaggctgaccacctcccggaagaggtgacattaaaagtgagactcttcccgagtgggagttggccacctgcattcaagcagcaaggggagactgaagggagggaggcctctgaggaggctgttggtctgtccaggtggggccagaaggttctggaccagccagtgcctctctttgataagcaggagatgggggaggtgggggtgttaaaatgtagattctgattcagtaggtctgaggcagagctccagagtctgcgtttctaacaagatcccaggcaatgccgatgctgctgctccacagaccacacttatcacagcagggttggccagagcaaatggggcaggtgacagggggacacagacacaggagggagaagacacaagatctggagaccaaatggctgcattggtgcctgcactggtgggtctgggctggcgggaatttctgcccaaaggattctgacctgactctgtcccctgccccttccctgcagagcaccagtcctggcgcctgacagggggcgctgaccgctgcgaggggcaggtggaggtacacttccgaggggtctggaacacagtgtgtgacagtgagtggtacccatcggaggccaaggtgctctgccagtccttgggctgtggaactgcggttgagaggcccaaggggctgccccactccttgtccggcaggatgtactactcatgcaatggggaggagctcaccctctccaactgctcctggcggttcaacaactccaacctctgcagccagtcgctggcagccagggtcctctgctcaggtaccccatcctactccacccccccagatttgagccagaattctacctgaatccatgtcctaaaaacttacagtccaaggaccacaataggcaccagatcggcaatggcacatatggcataagaaggactgttgtccttacggtgcccaggcagacagtgctaattcatcgaggtattttcagatgctccactcagccccagaatgatgaatcatatatgaagacattatatgctaagcaatggttcctcttgactgggattgactcaagagttgacaccaatttgccatcccaggcctggtgatgatagtaaaaataatattagcaggccctagtaataatatcggtgacagcttctggaaccctgatcatatgctaggcattgttaagcactaagtagctcttatttcagctgagcctcatacccactctatgagttgggttccaccatatctcgccaaatctaagatggcattgtttatgtcacaccattattattttatgtaccataaagaagaacgaacactgccaaaataaaccaccaaacgtaatgactgaggccattatcccaatttcagacgtgttaaagtttgaaaaaacgtgagtgttagatagatctgaagaaacatggtatttgcattcttacggcattcagacaccagattacaaattccagctctgccatttacgagcaaggaggcttccgacagtcccttaacctccatgtgtggatgctgatactaggcacttcgcaggatagctgggaaacctgatagtatctgctgagggacttctaagctcatttctttgtgagcctacctgcccaacgggaatgccgattatgataatgaagataatgtccgctcttcatctccctaggctgattaagaacaaactgaaactgaatggaaaacggatttgtggtctgtagcagcttacacagaaagaagggataattctattagccctttattttaaccaaagagccttcccagcatttaatccatgagttcctccttactgtggggggtggggtaggggagggaggtaagtttccttagccacgtgtccctgatgggagcacaaccctagttctgggtcacttgtctgtcccattcagtttctaacccaaggcctggcacacagtaggtgctcagtaacatgcattgagtgactgggcggtgctttctgacagcttcccggagtttgcacaatctgtccactcccgaagtccctgcaagtgttcagacagtcactataggtaagtgttgctgggtactacgcggtttctcagaagcttggacgtgtgtgtgtgtgtgtgtgtgtgtgtgtgtgtgtgtgtgttcctgtgcacacctgtgttggggtggaggatggtttggtcctcatcctccacctccagccaatggacttgcctccccggggctctctgggtggcatttctgctccttctacatcccctccttgccaagtcagcccatagatcactgagtcctgatacttcctggacagaagtccattcccccactttcctgtgagctgctggagggcagaaggaaagagctggagagagctgataccacctcaagcaggggtcagggtcggggcagcagggggagggtgatcttggcccagctgggtagcgggaatgccggcacacagccctgtgttcataaccggccagacactgggcctagggctttatagccattatttcccaaccctttaatcctcttggtagccaaatgggagaggtcttattataacccttacatcaagaaaggagctgaggctccgaggctgaagtcacagctagagattgctggccagaactgacaaccaaggctctgaattccagatccattcttggtctacccaccagctgcgtgtagcttggctggcatcagagcagactcccaggactcaactcccagctgtgcctcttgctagctgtgccctgttgggcaactcggaacctctctgagcctcagacacctcaattataaaatgggggtgataagcatatagtactttctcctagcattgctgtgaggctccagtgaattaatttttgtaaagcacttagaacagagcctcaaagacagtaagaactgtccgaaagtctgctgttgctatgagtatttagttcaggcattgagcccctttgcagtcctgggatacccacaggactcccttgctctgcctcctagctctctgtcatcttctctcagacacccagaagcagtgaacaggggtttggggagagggcacagaggccttagccatagatgacagcacagagaggaaatgaaatgtacaactgcacaggctgccgggcaagctcctgccaggccccgcaggcaacctgcacacgctttctcttcctgaggttggagtggggatccacgccatcctggaagggcaaagagtgaagcacaaagagagatccagggaccacaccccggcccttggtccatcagcccctccctcggccaaggccctctgtacccacattcacgggtctccccatggccgcaacacccagcctcactctcacatctgcttcctgctgccagatccagctcccatcctggcccaaacttccccatttgcagacagagaggggagaggagaaaatgaagacggggagaggagaaaatgaagacagggagagggttctctcccaggggaagcagactctgcccccagcaaagaggtctggatgatctcatctccctccccgttgctgtcactactagtcatctagccctgtggtctgctcactccaggaaccctcctcactgacccctgtatccattcttgtgcttcacattcttttaagcagaggggaggctgagggagggggagggcaagaagtcacccctgagtggggctgcagaggtgggagaccctgaatcccagaccccactcccgtcctcatggaggggatgtctggtgggaaggaggggggactcaggcacagctcttctgatggtctgttcactgccagaggtggctcagagtcactgtctctgggaagtcagcgttggtcttccctcacagagaatgaagtgccttttgtagggcctcatgcccccagtgtcgctgttcaaacctccatcacagcgggtgcctcatcatactggactgggttacttattgatctctccgctagacaaagcccctcaaggcctgtgatactgttgtcttatgtgtagccccagggtctagggccaggcacacagcgggtactcaatagttgtctattgaacaaagactacatactgaagagctagcagacagatagatctctgcagcctggtggccagagttctatttcaggcagtaattcatttaatcaattgctcatgcattcaatatgcatttattgagcgcctaatatacaccacacacttaaaagcaatgagaaaattggaaaaaggaagcaaggaggaagataacataaaaagggaagcaggtcagctttacagagaatggaaaggcaagaagaagggtgagtgcccattcctctttcttcctgaattggaattcttgtttccagaatcttctgtgacagtgaaaatagagaacaaggaatctcgggagctaatgctcctcatcccctccatcgttctgggaattctcctccttggctccctcatcttcatagccttcatcctcttgagaattaaaggaaaatatggtaagtgcaaggttctgggagccatggccatcccagggggatgtgagccttggcagaaccccagcagcagtggcgtggtccagcaatgaccacccggccctggccctggggagatccccaaggtggaaaggattttcccagcatgcccagcagtcatggacgcaccagcggggagaaccagactgtgcatgtgtgtgtgtgcctgtgtttgtgtgtgtgtttgtgcgcgcgcacatgtgcctgcaagtgttgggggaatgaggagggtggtgtgtcgatgagaacagaacggaaccaggtagactgggagagggcaaaaaaatgacttgtagaatttctgcctcccctccctcagccctccccgtaatggtgaaccaccagcacctacccaccaccatcccggcagggagcaatagctatcaaccggtccccatcaccatccccaaagaaggtaggatgtcccccatcctgggtgtgggagggctggggaggacaagaagggtgagctttctggaaggtcagcaccacttaggtccaagacgtacacacagctggagatgagatctgggccagcccactcccggccctgggaccttgagcaggctcaagtcgtccctggacattgaagggcagatgaccttccagttcagtcatgctaggactctatagagttttgagttctggacaaatacaggcaaagcacgttttagatcttggttctcagaggaaagctctgttctgctttgctctgctagttggctagtaggcttgtgatatcatcatccctatcaatgtcctgcccaattggccttgcgaagccccatcaagattctcctagaatgtggttttatttcatagttcatattttctaaacaaaaaaacaaattggggctgggtacagtggctcacgcctgtaatcccagcactttgggaacctgaggtgggcagatcacttgaggtcaggagttggagaccagcctggccaacatggtgaaaccctgtctctacaaaaaatgcaaaaattagacaggtgtggtggcgtgcacctgtaatcccagctacttgggaagctgaggcaggagaatcgcttgaacctgggaggcggaggttgcagtgagccgagatcacgccactgcactccagcctgggcgacagagcaagactctgtctcaaaaaaaaaaaaaaagaaaagggtcagtcattcatcctttatgatatatggatttatacctcttgcagaggaatttgagcttaatcaccttgcattatgaatgtattcaatcacctttatcggaaagagttcaatgacataaaaaccaatacaaaactcagccaaatattataaatatcctttgcacagagagtccatatatatgaaaagagaatgtgaatacagcatctagcataaggcttagcataaggcagctgctcactgaatagcacagtctagaggtttagagccagactgccggctctgggccaggtaagaacctgtctgtgcctcagttccctccaaggcaaaatggggataataatgtacccacttcacagagttatcatgagggttaaatgaggtaatacttgtaagtgttagaatagtgcctcacatatagtaagtgctgtgttaagcgtttgctaaataaatgtttagttctccatattggaaatgaacgaaggcagcctagaaacttcagactgggtggcttgtacaagatgggctacccaggttgggcacactggtggatgcctgtagtccccgcattttgggaggccgagggggatggatcgcttgagcccaggagtttgagaccagcctgggcaacatggtgaaaacctgtctctacaaaaaattcaaaaattagctgggcgtgatggtgcatgcctgtggtcccagctactcgggaggctgaggtgggaggatcgcctgagcccaggaggtcaatgctgcagtgagctgtgatggcaccactgtactccagcctggacaacagagtgagaccctgtcccagaaaagaaagaaaaaaaaagggggctacttggtgctcccctgctactctgcctctcacctctgctgttcatactctaccatctctccctacgcctttccgcccaccactttgccatgccctcgactctgttctctccccagttttcatgctgcccatccaggtccaggccccgccccctgaggactcagactctggctcggactcagactatgagcactatgacttcagcgcccagcctcctgtggccctgaccaccttctacagtgagtgcctggccgggctcccgagggcccacctacctgaatctgggagggggccccgaggggaccgtcaggtcagtagtcccacctagtaacccctgcatgatgcagacagaatccccctggttacccactggattgactgtaaatggtcctacactgacgtttgcaccgtgctttgtgaccctggggtcatctcgatgtctcaggacatctccactctgacctctgtctctcccatgtttgtctctggccacgtaaggtcttaagaccaggcctttgacattcacctgaagatggctctctgtgtgagagcgggggagtgcggatgagagacacagttggcaggggttctcgcatgccatatccctccgtgtcccatcctgccctgtctgaccccatcagccccactcacttcctcacctccacgctcttgccagcttgtgcctcatagccagctcttttcattgccttctggggataggaagaggaaagataacgctgaaggcagttccctggcaatgctgggaggttggaatagaccagagcgtcccacaccttattgtggaatcacttgggagcttgtcaaaaattcctgagcccctccccacacctaatgttatcagtcaggatgagaatttggctgtgtgtgacagaaagctccaaatgacagtgtcttgagaggttggcaggggcccaggccccttctttcttgctgctgtgcagtccctaagatgttgccttcatctacatggtccagaatggctcacctccatgtccacattccaggcaagggcaagggaacgatgggatgctggagatggccacagattcccgctcacaacccagcacccagaacgaaaacccactagctgcaagagaggcagggaaacgaaggctctgtcctgggcagctgtgtccagataaaagccagaatggatattggggaacagacagccgtccctgccccacctgctaacccagggcttctgggggtgggacacggatgattccacttcttctggcctgtggaccagtgtttgggcgccacagggatgaagtgtctgtcgaacctgagattccgagcccaggcatataagatgcaagactgagagtccacagtgctataacattgaaattaaaagtcagtggtacccggttcaaaagagctgactccaagatcccagacactcatatcctcaagactctataaatctctgattctgaaacgtgaaggtgccacagagcctgtgatgcagtgattccagaccatctgggtttcactctaggaaggcttcttgaaggagcaaacatctgtccttctcctgcccagagctgccaggtcacaaggacagaaccaagactcttgatacctctctaagtagcaggagggacagctggggctgggggctggggggttgtagggcactagagtttctgtccccaggctagattaaggcgaaggctctgctggattgggatatgaacctggaatttgatgggaaatgctaagccctctctgcctccggagttgtcctcccaccctattcagcctacccaggccccgggaaatccagcctcttctccaggctcctaaatgatgaggttgagccttcacccctccccaccaccgcctctgcttgcagattcccagcggcatcgggtcacagatgaggaggtccagcaaagcaggttccagatgccacccttggaggaaggtgagtcaggatgggaaggggtgtgaatggcagtcccacctccagagagtagctcagctcagcttgagaccttccagcaggaacctccctcaatgagtctttcctgactttcacaaatcctataggcagtaagtgctttctgaagtctgacttaaagccctcttgctgcactgcttctttcgtcaccattctccctttcctgccttaggacttgaagagttgcatgcctcccacatcccaactgccaaccctggacactgcattacagacccgccatccctgggccctcagtatcacccgaggagcaacagtgagtcgagcacctcttcaggggaggattactgcaatagtcccaaaagcaagctgcctccatggaacccccaggtgttttcttcagagaggagttccttcctggagcagcccccaaacttggagctggccggcacccagccagccttttcaggtaagctgtgcctcccccaaacccccatcccatagccagcctggctggaggaggcataaagctgggagccctgagtcaggctgaggtcaggattctacccagttccgcagccattcgctgtgtgcccttggacacatctcccatctctgggccttcactttgtcatttgccaagctagggacttggctctcgtgagtcacgtgggccccccagctctggcaacttgagaagtggctgtgtgctggcagagggtgactggttctgggggtttccagcagggcccccggctgatgacagctccagcacctcatccggggagtggtaccagaacttccagccaccaccccagcccccttcggaggagcagtttggctgtccaggtgccaatatctggggaagggatgtgggagggggacagagagggactggggagtaaatgagtggggaactattggatgcattcgctcaaggggaaaaggagaaaggaagggtaaaagaagagagggaaagtaactttttaaaaaacaaagcaaggccaggcatggtagctcaagcctgtaatcccagcacaaggcaggaggattgcttgaggccaggaatttacgactagccccgggaacatagcaagaccagtctctacaaaactaaaaactaaatattagccaagggtagcacgtgcctatagtcccagctcctcaggaggctgaggtgggaggatcgtgtgagcccaggagatccaggctgcagtgagctatgatcgtatcactgtgtatcatgcccctgcagggtcagagcaagaccctctttctacaagaaaacaaacacaagcacaacaagaatatgaagaggtggggaaaatggatgtggacgggatggagaaatagtcaaacaggttgctttgataagaagtgagctccctgtcagtggaggcattcaagcagaagcagctggttggctccttgggggagactgtggtagcagaggggcttccaacattcaatcgtccaccgtgtcgtgcagtgtgccattgtggagaccatagccctgaaccagacagacgaggctattccctcagtgctgatgttctagtcagggacatggccggaagcaagatgatcagatggcttcatgcagcatcccacggggatagtgatgtggagccagaaccactcagctccgtcctgtggggcagcagggcaatgactgggtctcccactaatctgggcctctctgcccacagggtcccccagccctcagcctgactccaccgacaacgatgactacgatgacatcagcgcagcctaggccggggccagccgaggctcctggggtggctctgaccctctggcctcctgctctacctactccctttcccctttcccaccctcccagctcacctccccatggagctgagaggcctcccttggagagatggaaggaaacgttataccttgtacccctcggtctccatccatcaagccaaacctgctgccacagccctcccccggccccagatagcagccccagggaggatgctgcctccaagaggtgtgagccctctgtctcggggatgaacaagcagagtctgggctacctcttgacagctggtggaggggagttggggagctggactggatgactctggaggccccttccaaacctcaagtgtccggcgctttgattgcctgagtttctgacacttcagggcccagaggtcctgcgaggggcagaactggacccccatgccagtgctgctgcaggagggcccatatactagggtctgctgagctgttgtcactgatcggtgggcgctgggggggtagggtagcacaccagctgtcccaggctttgctccgggcggtaactgcacttgggcagggaatatagccttcctgggcacaactagctgacaatgacaggttgactgtgtacccccaaccaaggagctggggcccaaggccagtcctgccccagagacactccaagtccgccaggggcacagaccagttctgcagtgactgtccctggacaatgggtctttattctgagtttcctatggtttacaaagagggccccagcccagccccaccacagatcccagagataggggcccagtctccatgggggcaaggagcatagagatgttttccaggaaggggctcagaagctgcactaggccccgagtccccatgtgtctccttgaattgatgaggatgctcctgggagggatgcgtgactatgtggtgttgcacccggggctgcaaacgtctccgtgcagcccccagagagaggcccatgggctcagaccaggctttgttgtcctgctctgagtatcctgagattaaactgaattgctgaatgaaaccagggcgtggaatgacaatttcttaaacctcatagaacccaggctgcatgtgtgtgtgcacgtgtgtgtggcatgtatgtgcatgtgtgtgtgtgtgtgtgtgtggcatatgttggatacaaatgagacaaagagttgagctcaaatcttttatttgggaagtaatcccagggagcagcagtaagaaaatgaggaagaaagagggggaaggaaggaagacaatgttcatgaacaggttgctattatgggcagccagagctcaatggtgctggggacctctgggagacacacctcagaattgtcccaccaagggggcagggagctgggatattgacccaccctctctgcctgtcattggttgaggagacattaacccccagccccagcactaccgagcggcctgtgagtgagctgggcacacgctgtgtcgggagaagccacaggcagagggtcagaggcacatgctataaggaaccatcttccatgggaatggtccaggaaaagcaccaacagcaactgctccatgttcagagtgtgtgtgtgtgtgtgtgcatgtgtgtgtgtgcgtgtcagggagaagtcaggttgtggcaatggtgggggcaactctatctgtttaggaggaaatgctagggaactggaaaacccacggtggctcagcaccataaaaaacactggggaggccgggcaccgtggctcacgcctgtaatctcagcattttgggaggccaaggcaggaggatcactttagcccagaagttcaagaccagcctggacaacatagtgagaccctgtctctaccgaaaaaaaaaattgaaaatcatccagtatggtggtgcacacctgtagtcccagctacttgggaggctgaagcagggaggtcgcttgagcccaggaatttgaggctgcagtgagccatgaatgatcacatcactgcactccag

SEQ ID NO: 678 - DNA, 56399 bp, Human
  misc_feature (1)...(56399): n = A,T,C or G
ctctggtctctagccagaggtgaagtgactacacttgacatccactaagtgcttcctttaagaacagggatcctcaataattagcccatgacattttctaataagtcccctccccacacccatgagaatcaaagatgagctgaccaggcagaggcagagggagagcagggagctctgccaggctaagtgagcgggttcctttgcctaggggactgccctccagtgggcaaatcccctgtgtcctcaattatctggtcctgtctaccccccagactctagctggagccatcacttcctcatttccaattttcctctttaaatttttctgtcctggcttctgctgcttgtcctctggcggaaccagtgacttcctgaatgttgaaattgtgggcgccacgggggacctctgcttttcagggcactgctaggagctcactttcctgagtttcatcccctttcactttctgacataccacgggccaaagaaagtgacttcgcctggcacagcttcacttcctgccacctgtcttcctcacctcttacatttcaaataggccaaaagtctacggctcccctgctccaggctgtcccacctctgagaggctgcacctgccctccttcctccctggagggcctttgcctcatcttgatctggatcaatcccccattatccttttaagcccagctctggtatctgatatctcttgattcagatgataaagctatttgtcatatttctgccctgtctcccctgcctcccggcacttctgtcttttcagggacatcaacctttgccgcacttcacagcaattttctggaatgtagttgtagccgcaaccatcttgcatggtagactgtgaatatctttcatgaaaaaaggccatttcttcatctcctcggtgcccagcaggctcacaatgtctctaatgataataacaacaacatgaccatagtgtttattacctaatacttccatcctagccaccttatatgatttaattcatttaaggctcacgaaattcatatcttccttatttatacaaacagaagagtgagatgctcaaagctcaagtgatttgcctactgccagacagcccctatgtggaagaggtggaatttgaagccaggcattctagctcttagtgtctgtgtcttaaccaccatgctatacagcatccctggtagagatgcctgacgggagggagagaggggagaagctactttccttaaggagctcagatctcactggggcctggacaaggacacctgtaacacatgtacacatgtgcacacatgtgtacacacacagagagagaacatgggaaaactacaagaagaaatactaagtgctaaaatgtgtggttcagagcaaggcttctcaaactgtaatgtgtatataaatcacctggggatctagttaaactgtagatttggatttgatctgatggggtgggaccagagactcattgttagaacaagtgaacttgcatttctaacaagttctcaggtgatactaatactgctggtccatggaccacactttgagcagcaaggatgaactctaaaggttgaggcaggtcagagaagggagatttcactgtgggctggagaggtcctgggacagagagctgagtctgggcccatggcagggcttggttggccctctctggagccatccagcttttgggtctcagggacctgggagtgacgggtgcattcagaggcccgtaacttgtgtcccaaagcctcctcgatcccccttaacaagcagcagcactgtgtgggagatccacatgtgaatagcccgtgtttgagaaatgtccaatcctgatcatgtcaggaaacatcctgcaaattctgaaatcagagccaaagggaagtgctgcgaggtttacaaccagctgcagtggttcgatgggaaggatctttctccaagtggttcctcttgaggggagcatttctgctggctccaggactttggccatctataaagcttggcaatgagaaataagaaaattctcaaggaggacgagctcttgagtgagacccaacaagctgcttttcaccaaattgcaatggagcctttcgaaatcaatggtaaagtacgattccccaataatggaaatgaccagaaatgtagtctttctgctagcgagatacgaaaatagacaagtcaatagaaagtctaggtttggcttattgctgcattttgcacgtaatcatcactaatactgtctggagtgcttcaatttggaatttctggaatgctaataatagatgctgtatttttagcatatagtcaggtttttcttagcttcactattgttttaatcatatttaaatattttcccttgaaaaaatgccaatgcttattaaatgtcccctttttttaatgaatgtcttattctgacacacaggttgggtgatacaatgaaaacgcaaaacaggggcactgaaaggggaccacaaaactgaagccaagcatgacagttttcaaaacacagcttctttaaaattctttaaggggatttctgttataactgatgtgctggtcaggaaacatattctgtatttcatgttgactgaaatatgttcatagcttcataattagtttgtcttaggttaaactcaggtctgtaatattcagtcaactctgttgtctttattttctcactcagcattcaacaggtgatgcatttttaaaatcttctagaatttgtagcatttgaagtcatgggtgggcttgcattccacaaatgagctctgatttcctagtctagaacgttctcttgggatcatcttccaagttgatcagtcatttccactcccaggctttgctggaagttgtctatgcaggaaaattggtggctttatctcctggccagagtgtccttctcatcccacacctgtctgcccaggtccctgcctggaattttcagcgcacaaagatgaagcgtctggggctctgcctctaggaatttacagtgtaataacagagaaaggtgtgagtgctaatggctataataatcattggctatttagaacttctcagaatgcaacattctggatacatgactgtttaagagactgaagatgttcaagcaaagtcagctgatcaagcatactcagcacctatttccagcagggcactgcactcagcactgaggaaacaggcttgaataaacatagcctctggcctctggcttctggcacgaggggacaggggacagggtaagctgcccatgaactgacaatttccatgttgtgactgagacttccacaggacatgatggacagatctaaccaggtgtagagccctggagggcagagctgacacctcttccaaagtttaaaggataaagggagtccgttagagaaagaagttagtgcctggggcggggtgggcgccacatgtttgtattgtattcacaagaaatattcagagaaatataaatacttccatactgtttggccaaaattgggacggaaagaccagtggggactgaggctggaaccaaaaaatttgacttcatcctgaggtcagtggggaagcaggaaggggccgatgtggggctgaaaggcactaatgtgcatgtgaggttgctctttgtcctacatagggatggctggagagagaagctgaggacagagaggaacttggcagcaagagatgatgaggggcagtggatggaaggcaggaaaataaaggaatgctctggagaaacaccggaaatcagatcaattggactgcaatggcaggacagggctggggaggaagacgcaggagttaatagtgaaccctagatttctgacctgggttgtgtgtgtcaccaattaaaaatgtaactaagccagtgcaggaggattccttgagcccaggaatttgagaccaacctgggcaacatagtgagaccctatctccaccaataaataaataaataaaatgtttaaagtatctcaccaaaaaaccaaaactactccaatttggatgaaagaaacattttcttatatgcattcacaacatcctgccttctaatacaaagattgtggaacatatgaaactttctagaagagtgccattatgcaggtaatcactgtgaggctctggtaacacagtgacccctcagggccggctctgcacattacttattttttgtctgctgaagatttatttatttaggccatatatagttttattttcttttgaaaatacattatcttaaaattcccacatatggttcatgaaaaacagcactgaaaaatatttctaatgtcattttcctcatttatttttctctattgttggtattgaaatataaaatgctgtttttccctgattataaagtattaaactagttttttttttattattattacccaaggatactggactaggaaagttttcaacacatgctgaagaaaattttagaagtgagtttgggaaacttttggaatataaccttcattttttctaaaattaatcttaaaaaaaggatgaggagtgtaaatttcacactgtaccctctagaagcacagtgcaacttgcatccctctttcctgccatcacctccagcctccctcattagaacaagcctccttcattccattatctgcactagaattaaggtactctttcttttctttattttttattctagctttttaggagtgtgattaacaatacaaactgtatatatttatgatgtacacgtgatgatttgatatatgtatccatggatgaataaccaccacaaagactgctttagtttcctgaggggacttgacatagggttggcttctgtggccctcagggtctcacagaatcccaggtctctcctcagagccatagaaactgctcttttgccccatcatccacctcaacaatggaacatttgggcttgaacgagaggatttacctgttggcaatatctttctgggatgtgtctgtttctacctttttgaaaattagcaatctgtgtctggctttaggcttcctgtcacactcctggccgtctggtttctcaaggaagactactgttaccacagcctaacaagacaagcacttgttaggctgtgcaatgtgatctgtcggaacctcttgtttctttttttttttttttttttcttttttgagatggagtctcgctctgtcacccatgctggagtgcaggggagcgatctcggctcagtgcaacctccatctcccgggttcaagtgattctcctgactcagtctccctagtagctgggattacaggtgcccaccaccatgcccggctaacttttatatttttagtagagacggggtttcaccatgttggccaagctggtgtccaactcctgacctcaagtgatccgccccccttggcctcccaaagtgctggaattacaggcatgagccacctacctggccctgttgggacctcttactccaatctctcaactacttcaggcttcccaccaacttcagtctgaagaacattcttcttgagagagaagtttgaaacaaaatacaggtagaaaagttagggtttttattgttgtttgttttaattaacactaactattgtctctcagtagtgagcctaaccatcctttcttcccacccttaacatactctagagcaaccttcaacaaaacccaaaccctcaagtccgttcaggctcagtcttgcaacacgactgctattatttcatgtcattgttctgactttgctcttcatcatgccaatatttctcaacatcttttaaacatctggctttattgcagagtttagtcttaactttttatggtgaagtagttatagagtcagagaaaattgcaaaaaatgtacagagaagcttttctgactcttgtctcattctcccccagtggtaacatcttacactgcattaatacaaaattacaaccaggaaactgatattggtgcaatccatagagcttattcattagttttacatgcactcgtctctgtgtacatatatagttgtaccaattctatgcttaaataaccccacatacccctcactcccccaccagcagtcatcaacccctggcaaccactaatctgcttcccatctctataattttgccattttgggaatgttacataaagaaattacacagtatgtgacttctttaagattgatttttttttcacatagtgtaattcctttgaaacccatccaagttgtatccatccatagttggctcttcttattgagtagcattccatgatatgaatatatcaaagattgtttaacattcacccactgaaggacatttgggttgttttcagtttgggggctattacaaataaagttgccatgaccatttctgtaagtgttttgtgtgactttaagttctcatttctccaaggtaaatgtccaaaagtgtaattgctggattctaagtgtgtttggttttacaagaagtagtcgatatattttccagtgtgactataccattttacattcccagcagcaatgtacaactgatccagttttctgcaacctcgtcaacatttgacattatcactatttttaaatgtagccattctcgtagatgtatactgatatttcattgtagatttaatttacattttcctaatggccagtaatgttgactatcttctcatgtgcttaaataccatatgtatagcctcttcagtgaaatgtctctttgtgtcttttgcccatgttttaattggatcttttattttttatggtttggttttaagagttctttatatattctatatataagtcctttgctagatatgtggtttgcacatattttctccgagtctgtaacttgcattgttatgttcatatcagcatcttttacaatgcaaaagtttttaattctgacaaggtccaacctaacaatttttccatgtatgtattatgctttcggtgtcaagtctaagagttctttagcccttgttggtgaagattttcttctctatcttattctaaaatttttgtagttttacattatttttatttttatatgttagagacaagatctcactatgttgcccaagttggagtgtgcagtggctattcacaggtgtgatcatagtgcattgcagcctcaaactcatgggctcatgtgatcttcccacttcagcctcccaagtagctgggactagaggctcataccaccatgcctgcccgtgatccattttgaattgattctcgtataacgtataatgtgtaggccaaggttttcatatgtttcattttgttgaccatggatacatagtcattccagcaccatttgttgaaaggctatcctttccctgttgaattgcttttacacctttgtcaaaaacaacttgggtaaatttgtgtgcatctcattctgcattctttattctattccagtgatctatgtgactatccctctaccaataccacagtgctttgattactatagttatattgtaagcgttattatcaaatagagttattcctcaaattttagtcttcttttcaaaactgctttagctattctagggtttttgcctttccatataaatttaagtgtcagcttgtctacggttacaaaaagatcttgctgaaattttgataggcattgtgttacacctatagataaatgtagagagaattgatatctttattattgcagacttacaatccatgcacatctctccatttacttaggtctttggttcttttaactaaatttttaaaaaaatttcagcatacagatcctgtacatgttttattagatttatatctaaatattccattttctttggtgttagaaataccaaaattgttagaaatagataattggtgccaggaagaaaagttagcacagagacaaaagatctctcagcaaggccatctttactttctgcagaaagggtgctcaattacagatggaacaatggcaagaccacacctgaacaaaagaaaagcagacatatttatcccttacacatttggttcatccttactgctgtgtcctgcatctattggctggagcaggacctcacaatcttaaactgatacccgatttgctaatagcctacaactttcctaatagttaagtacagggaagaacaaagaaattgcttacaaaaggtttaaggaagcaataacatttccaaataaggaaggagcatagggtgtgagctggaacgtgcctgtgagcatgttcagcagttacataggctagggcttaacaaagagttattaacgcaaagcaagaggcttgaagaaagttattcctcaaaagaaaccatcatttccaacactcacaatttattcttcaacaagaaggaaaactttgaagaggaaatttttactttctacaatccctcctcttttactttttagttttcctcttcaaacttgcttaacatgtcttggcttagttgttttgattaactcttggatgtatggtacaacataatacttaagaagaaggagtatacttattatagttgttgaagaggtaagaattgaagctatgtttgtttgtttgtttgtttgtttcttgttgatgaaatactagagtaaaagggataggcaattgaactagagcaaaagtattgctccaattatttggcagagtgtccagtaatggtcctccataataccaccatacatccgctaagggcaggtgtatgaataagggtggactgatgggtcagctcttggaagtgactgacttcactgcatcctgttaagtctccaaggaatgccagatttttccccttgtcattggatatatgaggtaaaattggttttggaagatggaggctggatggccctcgcaggctgatccgcagggtgttgaacttcaggaaatagcagaaaaagagcttggcacaattctttattccagggggtggaatcttgaaaaagagctaccatgcactccatgtccccttgatttgaggaccatgctagtggaaaggcaacaacgtgggcctctggcctaccttgcacacaagagtagcagtcacttttgtttaaagtgcaaacagaatatttaatctattttaaccaggcatttacatctttataccctgtttcaatggctatggtttgccataggtctcctatttctactactgagaccttgcttttgtcatttggcatgaggcgagtcatagtttgattttgtaggtttgggaaaggtgcagttgtaggaggtagaggagggagaacaaagtgcaccttaaagaagcctataggatcctttccagtgacttctgctcctaaaccacagaagtgccctacagtggggttagagttgctggtggtaggaatagtaatggatttaagcactgggttaggaaaggaaaggaaaagatagatagactaagctttccttagctttaatttggtagggcttgacccaggaacaatggcccatgattctgaggataatggcacttgcttgactcaggtgtcatgtgtccatccctttccgctgtacgaacagcagtctcgatggttagcagcacaaggtacggtccttccaaggctggcccgagtttcccttctttctatcctttgatgagaatgtgatccccaggctgatgctgatgtactggaaactccaagggcggcatctgtgctaaaagaccttttgtttcaagggaagagaaggtggaggataaaccaagtatataatttctaagaaattgatcttttgttttaaacgtgggtacatcaacagtggactttatagtcctttgtgccttcttgctgataaattttctttagcaccgatttttattagtttttagaccaaagaaagccaaacaccattttatatttgacagtgcttcgtatatgattttatactagaaaagctaaattttacctttatatgagtgtgtcattaatgttaaatttaattttaataaaaccttgttgacatatgtatccaattttaatgtctgaccataaggtaagatttttatagactgtttttaaccttttataattttttgttaaagagcaggttagtgttttaagaaaaacctgttgttcttttattttaatatccagttcacagaaaaactggatgacacccctttaactttagccaatatgtttacacacagaatttcctttacaattaaagtttcaaaacttgcttaaaccttcaaaacaaaatttttttaaccttttaatgtaggtagaaatccacattcttatgcctccttataatccttttaccaaaagtttattttgctttccttacataccttgcatataaactgtttcttcaatagttttacattcaggaggcctaattacttttaagttatacaacatttcttgcataaattcccttttataattttgtttttcacaacttttacagacaattcttcgacatgcctcaactttctgagttgttgctaacatcgctttctttaaacaaccagttaatttattttaggacaagaatttaccatataacattcctttttacataaattctcccctcccccctttttttttcctcaaagatgatagccattcttttccaaagtgaacttccttcatgtctgtggactggactgttaaaggccacaagattagaagttaggataatacatatgacactgttaatatttagcaaattttacttttgttgaaaaccttgtaagtttgggatttcaattatcctttgctattaataagacctaatttagtccaaatttaacttagaattgctatagatgactccttcctgaatctgtaagtattttaaggcttggctgagtgcaaacagctcccacctttgagcagaccaattattaggcaattttcctaactctgcttctacaagagtttccttatcacttactgaatacccattgtgtccttttctctcaatcacctgggaggaaccatctatcatcctgtcaccaaggaggaaccgtcaatcatcctgtcctgaagggagttcctcctaggtctggtgggacctttctatggtaactaagatttagatccccgttaggaaacctactgagttaagggaattttcagtggctaacgttaaatcactttttctaacagaatagccgcataccttaaggttcttgagtcagtgagctaccttttagcttttgggttttgttgtttgtttgtttgacttaggttagttctggcctgatgaggtgtgctcacaatgaggtttcctctaaaagttatttttctactttgctctcttagcaaagcagttgctgctacagattgaatgcatttgggccatctacgggttactgggttaaggattttttattagaaaggcttcaggttgtcagtggcctcagtgctttcgggctacgcccctgtttacactgacaacaaggtggtattggagtgttatagggtcatgaagaagactttcaattatcaattacaagttttaaatttaccctggcttttaaatgactagggtacagttttctctttactacttccatctctctctttctctctcttccttgactctgtctctctctctcttttactacctctttatctctctgtctctttctctcactctctgattctccatctctctctctctctttcttcctctttctctttgactccctctttgtctctccgcctctctctctttctctcccttatttcctctcccagtttctctctcctctctgctggtctttccctgcctctgccagccacttatgttgctgctctcccttctccttccccttcccctaggggagcaaccagcaggagtggagcttagcctctttcttacccctttcttacctctttcaggggagttctgaatatttttcttactaccggaggtttgtgtgaggttcaaccacctgaaatttgcagaaggttcaacccctcaaaccagggatgtcttgccttgcctgtcctggaaggctcaacccctcaaaccagtgggtgtcttgccttgcctgccctgggaggttgacctggtttctcccttcccctctctgaaggtcccttgcacacttcccacttgtgttgtcctctctggccgctcccccaagggagaattaggccccttttagtgttggcgtgcaggtataaatcccatggcaggatccgccctaagccatatgaggtagctatggaaccgcagagaggacccactcactccatccagcagtaggacttgtcaccatccacacaaacaacaccgcaagcagggttatctgtgatcattcacgcacatgtacatttagccctccagaatttcatgaccaaggaagtactttaccggctcctgtggctttgccttccttggtctgtgcacaaagtcgtcgctgcagtatgtgaggatcctttaagctaggttgctggccagtttctttctgcattgctgagagctcgggttattcctcgcaccaggtgggtcttggtcccttacccctgaggccaccgcaagaggtggtgtggtgcctcctcatgaaagaggactagagatgcccccggaggagaatgtatccccatacgattgccaccaaaattgttagaaatatcaaaattgttagaaatacatcattggtgccacaaaggaaagtcagcacagagacaaaagatctctcagcaaggccatctttactttctgcagaaagggtgctcaattgcagatggaacaatggcaggagaacacttgaacaaaggaaaagcagacatatttatcccttacacatttgggttgtccttgctgcgtgtcctatgtccgttggctggagcaggacctcacaatcttaaactgatatccgatttgctaatagcctacaactttcctaaataggtaagtacagggaagagcaaagaagttggttacaaaagttttaaggaaacaataacatttccaaataaggaaggggcataggctgtgagctggaacgggcctgtgagcacattcaacagttacataggctagggcttaacaaagagttattaacacaaagcaaggaggcttgaagaaagttagtcctcaaaagaaaccatcatttccaacacacaatttattcttcaacaagaaggaaaactttgaagaggaaactttttactttctacatttggtgtgattgtcagttctattatgcttttaatttggtttccatttattgttagtatatagaaatgtggttgatttttgtgtgttcatcttgtgtcttccaactatgtgaatttatttattcattcgaaaagttttctggaggtggggggaacgatggtggatgagaggcgggactagatttctgctccagacagagcagcatgcagaggcttgcattgtgaattttagctccatatcaactgcaagaacaaaccagcaatcctgagaggatccacagaccctctgaaggaagtggactgctcctgaaggacccagtagacaccccaaatactgcgagtgccccagccgtgtaagtggaaaagggagaccctcgtctcctgaacacacaccctcactggagaagatgaaggtctgtttgcaggagaagtttctgactttacctggagctgatcaagttagagagctgagccaagtgaaatacaggggtgggggaagcagcagaaaggccctgggagcttgctgggtccccaagcagcccactcctggctggcaccacaggaatccatcaggaaggtggccagaggagcaggggcaaaactccacagggagaaaggattctctagctgaactttgtaacaatttgaacagggtgagaagcctcctgaccagaactcaggggagggtgcgaatccagcttgcagacttcacaggcaggagaagatctaaagcccttgtctttggcagctgggaggcagagaaagcctcaggcaagttttcaaggctgtctccccctccccctggaaacacacttggggctgttgctgggggcacagtgggagtaagactggccctttggtttgtgtgggagctgggtgaggcctgtgactgccagctttcccccacttccctgacaacctgcatgactcagcagaggcagccataatccttctaggtacacaactccagtgacctgggaatctcacccctatcccccacggcagctgcagcaagacctgccgaaggagactctgagatcatacatgcctagtcccacccctggacctgatggtccttccctacctgccctggtggcagaagacaaaagacatgtgatattgggagttctagggccacacccactgccagtccccctccacactactacagctgatgctttctggaaattgctacctcctggcaggccaaccagcacaaaaatagagcattaaaccaccaaagctaaggaccctcacagagtccactgcaccctctgctgcgtccgctggaacaggtgctggtatccacagctaagaggccgttagttggttcacatgagaggactttgtgcagacaacccccagtaccagcctggagctgggtaaagttgctgggtgactagacccagaagagagacaaaaatcactgcagtttgactcacaggaagccacatccacaggaaaacaggaagaatactacatcaagggaacaccccgtgggacaaaaaaatctgaacagcaatcttcagccctagacttccctctaacagaacctacccaaatgagaaggaactagaaaaccaaccctggtaatatgacgaaacaaggctcatcaacaccacaccctcaacccccgccctgccaaaaatagaaaaaaaaaaaatcacactagttcaccagcaatggatccaagccaagaagaaatccctgatttacctgaaaaaaaattcaggaggttagttattaagttaatcagggagggaccagggaaaggtgaagcccaatgcaaggaaatctaaaaaattatatgagaagtgaagggagaaatactcaagaaaatagatagtttaaataaaaaaacaataaaaattcaggaaactttggacacacttttagagatgtgaaatgctctggaaagtctcagtgatagaattggataagtagaagaaagaaatgcagagctcaaagacaaggtctttgaattaacccaatccaacaaagacaaagaaaaaagagtaaaaaaatatgaacaaacctccaagaagtctggaattatggtaaacaaccacacctaagaataattgatgttcctgaggaaaaagacaattgtaaaagcttggaaaacatacttgggggaataatcaaggaaaactttcctggccttcccagagacttagacatggaaacacaagaagcacaaagaagacctgggaaattcgttgcaaaaagatcttcccctagacacattgtcatcaggttatctaaagttaagatgaaggaaagagtcttaagagctgtgagacagaagcacaaggtaacctataaaggaaaacctatcagattaacagcagatttctcagcagaaaccctacaagctagaagggattggggccctatcttctgcctcctcaagcaaaacaattatcagccaagaattttgtatccagcaaaactaagcatcatatatgaaggaaagacacagtcattttctgccaagcaaatgctgagataattcaccatggccaagccaccacaacaagaactgctaaaaacttgaactgtttaaatctgtttaaatcttgaaacaaatcccagaaatacatcaaaacagaatctctttaagtcatatatcacacaggacctataaaacaaaaatataagttaaaaagcaaaatcaaaaaaccaaaatgaaacaaagtacaggcaacaaaaagcatgatgaatgcaatggtacctcacatttcaatactagcattaaatataaatggcctaaatgctccacttaaaagatacagaactgcagaatggataagaactcaacaaccaactacctgctaacttcaggagactcacctaacacataaggactcacataaacttaaaataaaggggtggagaaaggcatttcatgcaaatggacaccaaaagtgagcaggggtagatattcttatatcagacaaaacaatctttaaagtaacagaggttaaaagagacaaaaagggacattatgtaatggtaaaagtccttgtccaacaggaagatatcacaatcccaaacatttatgcacctaacactggagctctcaaatttataaaacaattactaatagacctaagaaatgagatagacagcaacacaataatagtgaggtacttcaatactccactgacagcacaggagggtcatcaagacagaaagtcaacaaagaaacaatggatttaaactatacctttgagcaaatggacttagcagatatatacagaacatttcatccaacaaccaaagaatacacattctattcaacagtgcatggaactttctccaagagagaccatatgataggccataaaatgaccctcaataaatttaagaaaattgaaattatatcaagcattctctcagaccacagtggaataaaactggaaatcaattccaaaaggaaccttcaaagccatgcaaatacatggaaattaaataacctgctactgaatgaggattgggtcaaaaatgatatcaagatggaaatttaaaaattctttgaactgaatgacaataatgacacaacctatcaaaacctctaggatacagctaaggtgttgctaagaggaaagttcatactcctaaagatctacatcaaaaagtctgaaagagcacagacaatctaaggtcacacctcaaggaactagagaaacaagaacaaaccaaacgcaaacccagcagaagaaaggaagtaaccaagatcagagcagaactaaataaaattgaaacaaaaaaatacaaaagataaatgaaacaaaaagctggttctttaaaatataaacaaaattgatagaccgttaacaagataaacgaaggaaagaagagagaaaaaccaaataacctcactaagaaataaaacaggatatattacaactgacaccattgaaatacaaaagatcattcaaggctactatgaataatacctttactcacataaactagaaaacctagaagagatggataaattcctggaaaaatacaacgttcctagcttaaatcaggaagaattagataccctgaacagaccaatagcaagcagcgagattgtttggtaatttaaaaattaccccccaaaaacaaacaaacaaacaaacagtccaggaccagacagattcacagcagaattctatcagacattaaaagaagaatactaaggtaccaatccttttgacactattccacaagacagagaaagaaggaaccctccctaattcattctatgaagccttcattaccctaacaccaaaaccaggaaaggacacaaccaaaaaagaaaactacagaccagtatccttgatgaacatagatgtgaaaatccttaacaaaatactagttatggtggatatcataaagataatccaccatggatcaagtgggtttcatagcaggggtgcagggatggtttaacattcccaggtcaataaatttgatacaccacataaacagaattaaaaacaaaaatcacatgatcatttcaatagatgcagaaaaagcattcaataaaatccagcatccctttatgattaaaaccctcagtaaaatcagcatacaagggatataccttaatgtaataaaggccatctatgacaaacccacagacaacataatactgaatggggaaaaattgaaagcattccctctgagaacgggaacaagataaggatgctcactctcaccactcctcttcaacatagtgctgaaagtcctagccagagcaatcagacaagattaaaaaaaaagggcatccaaattggtaaagaggaaatcaaactgtccctttttgctgatgatatgactgcttactttgaaaaccttaagggctcctccagaaagctcctagaactgataaaagaattcagcaaagtttctggatacaagattaatgtatgcaaatcaatagctcttccttacaccaacagtgaccaatcagagaatcaaatcaggaactcaatcacttttgcaatagctgcaaaaaaaaaaaaatacaatacttaggaagatacctaacaaaggagtcaaaagacctcttcaaagaaaattacaaaacactgctgaaagaatcatagatgacacaaacaaatggaaacacatcccatgctcatggatgggtagaaacaataatgtgaaaataatcgtactgccaaaagcaatctacaaattcgatgcaatccccatcaaaataccaccatcattcttcacagagttagaaaaaacaattctaaaattcatatggaaccaaaaaagagaaggcatagccaaaacaagactaagcaaaaagaacaaatttggaggcatcacactatctgatttcaaactatactataaggccacagtcaccaaaacagtgtggtaccagtataaaaaatagcacatagaccaatggaaaagaacagagaacccagaaataaacccaaatacttaaagcaaacaaaaatataaagtggggaaaggacacccttttcaacaaatggtgctgggataattggctagccacatataggagaatgaaacttgatcctcctctctcaccttgtacaaaaatcaactcaagatggattaaggacttaaaccaaagacctgaaactgtaaacattatagaagataacattgggaaaacccttctagacattggcttaagcaaagatttcatgaccaagaacccaaaagtaaatgcaataaaaacaaagataaatagctgggacctaattaaactaaagagcttttgcacggcaaaaggaacagtcagcagagtaaacagacaacccacagagtgggagaaaatcttcacaaatctatacatcggacaaaggattaatgtccagaatctacaacaaactcaaacaaatcagtaagaaaaaaaattccatcaaaaagtgggctaaggatatgaaaaaacaattctcaaaagaagatgtacaaatggccaagtgacatgtgaaaaaatgctcaacatcactaatgatcagggaaatgcaaatcaaaaccacagtgtgatactaccttactcctgcaagaatggccataataaaaaaaatcaaaaaaaccacagatgttggcatggatgtggtgatcagggaacacttctacactgctggtaggaatgtaaactaggacagctgctatggaaaacagtgtggagattccttaaagaagtaaaagtagaaataccatttgatccagcaatcctactactgggtatctacccagaggaaaagaagtcactgtttgaaaaagatacttgcacatgcatgtttatagcagcacaattcacaattgcaaaatcatggaaccccaacaagtggataaagaaactgtggtgtatatatgatggaatactactcagccataaaaaggaatgaattaacagcattttcagtgacctggatgagattggagactattattctaagtgaagtaactcaggaatggaaaacgaaacatcatatgttatcactgatatgagggagctaagccatgaaggcataagaatgatatagtggactttggggacttggagggaagagtgggagggtggtgacggataaaagactacaaatacagggcaatgtatactgcttgggtgatgggtgcaccaaaatctcacatatcaccactaaacaacttcctcatgtaaccaaatacaacctataccccaataacttatggaaaaataaaataaaataataataataataataaataaaaataaaactttttttgtagattttgtggaatggtttatgtagatggtcatgtactctacaaataagaacattttaatttctttctttccaaactgtatgccttttatttctttttcttgccttactgctctggctagaacttcccagtgctatgttgaataagaaggcaagaacatatatccttgccttgtttcgaatcttaagggaaaagtgtcctgtctttcaccattaagtatgatgttagctttagatagtttgtagatgcagttttttaagttgaggaagttctcctctatttctagtttgctaagaatttttattgtgagtttattatttgttatgagtcatagttttgaattataatgatgagagttttactatgaattggattttggcaagtgctttttctgcactaattttatggtttttcttctttagcttgctgatctggtggaatatattgattaagtttaaaacattgaaccatccttgcatatctggaataaatcccactttgttgtggcatataattttttaaatatattgcttgatattatttactaacttttttatgcaagttttttttgaaatttttatttctattttaagttccagagtacatgtgcagaatgtgcaggtttgttacacaggtaaatgtatgccatggtggtttgctgcacccgtcaacccatcacctagatattaagctcagaatgcatgagctattattcctaatgctctccctatacccccaccccctgactggccccagtgtgtgttgttcccctccttgtgtccacgtgttctcattgttcagctcccacttataagtgagaacatgcagtgtttggttttctgttcctacattagttttctgaggataatggcttccagctccatccatgtcactgcaaaggacacgatctcattccttttcatggctgcacagtattccctggagtaaatgtaccacattttctttatccagtctatcattgatggacgtttgggttgattccatgtctttgttattgtgaagagtgctgcaatgaacatacatgtgccatatatctttataatagaatggtttgtaataggattgctgggtcaaatggtatttctggttctagatctttgaggaaacaccacactgtcttccacaatggttgaactaatttacattcccaccaacagtgtaaaagtgttcctatttctctggaacctcaccagcatctgctgtttcttgactttttaataatccccattctgactgatgtgagatggtatctcattgtggttttgattttcatttctctaatgatcagtgatgttgaactttcttttcttgcgtatgttggctacatgaatgtcttcttttgagaagtgtctgttcatgtcccttattcactttttaatgaggttgtttttttttcttgtaaatttgttcaagttccttgcagattctgaatattagacctttgtcagatggatagatcgcaaaaaattttctctcactctgtaggttgcctgttcactctgatgatagtgtcttttgctgtgcaaaagctctttagtttaattagatcccatttgtcaatttttgcttttgttgcagttgcttttggcaatttcctcatgaaatctttgcccatgcctatgtcctgaatggtattgcctagattttcttccagggtttttatagttttgggttttacatttaagtctttaatccatcttgagttaatnnnnnnnnnnnnnnnnnnnntaagtctttaatccatcttgagttaatttttgtataagatgtaagaaagggatccagtttcagttttctgcatatggctagccagttttcccagaaccatttattgaataggagatcctttccccattgcttgtttttgtcaggtttgttgaagatcagatgctcgtagacgtgcggtcttattgctgagttgtctattctgttccattagtctatgtgtctgtttttgtaccagtactatgctgttttggttactgtagacttgtagaatagtttgaagtctggtagtgtgatgcctccagctctgttctttttgcttaggattttcttggatatacaagctcttttttggttctgtataattttgagatagtttcttctaattctgtgaagaatgtcagtggtagtttaatgggaaatgtgttgaatctataaattactttgggcagtatggtcattttcatgatgttgattcttcctatttatgagtatgaaatgtttttccatttgttcacgtcctctctgatttccttgagcagcagtttgtagttctccttgaagaggtccttcacgtcctctattaactgtattcctaggtattttattctctgtagcaattgtgaatggaagttcattcacaattttgttctctgcttgccttttactgaagatttttgtgtcaaagttcatgaaatagttttgtttgtttctttctttctttttactggactatctttgattttcatattaggatcattctgatctcataaaatgaattagaaagtgtttcttccttttctgtaagagattgtgtaaaactgatgctaactcttctttaaatgtttattacgatatgctggtaaaactatctgggcctgaatatttcttttctgggagcttttaaattaaaatttagatttatttaatgattatagatattcagattatctatttcaccttggctgagttttggtagtttgtggcttttcaggaactagcctatttcctttaaattgtgagcataaagttagtgatagtattttcttattttctttttaatggctgcaggatctgtagtgatagcacctgtttcatttctgatattggctatccgtgtcttctttcatttttatttttgttcagtcttgctagagatttgccaattttattgactttgttcaaagagctagcttttgtttcattgatttttctctatcttcctattttaaattttatttatttatattcttatctttattatttccttttctggtgattaggagttattttgttcttttctaatttcttgaggaaaaaacttagtgtgttgattggaggccttttttatttttggtgtaagcagttcgtgctataaattttcttttcagagctgcttttttttatcccataaattttaatatattgtattttcatttcctttcatttgtatttttaaaatttttttgatgctttcttaatgacccatgcattatatagaagtccttttttaaatgttccaaatgtttggagattttcctgttgcctatccattgttgatttttatttttattgtattattggcaaataaggtattctgtatgaccttggttttttttcatttggttgaaatttgttttatgacctaggatatcatctattttggtgtatgttccatgtgtccttgaaaaggatgtacattctgctgttgctacctggagtattctgtgtgttcattagatactatcagtcagtagtgctagtgtttagttcttctgtaactttgcagagtttctatcaattgctgaaactacgtgttaaagtctcaactataattgtgtattgtctatttcttttttcagttaaatcagtttttgcttcatgtattttgaagttctattgtttgatttcttatttatagcacattgttggattatgttttttaatacagtttggcaatatccgtcctctgatttagaccatttataccgaaagtaattattgatatgtcagtgcttaaattggccatcttattgtgtgttttctgttttttctttgtttcccattcatgtatttctcttttcttgccttcctgtggattatttgaataatttttagaattccattttgatttatttatagtgttttttattgaatagttttcttaatggtttctctacttattgcaatatacatatggaacttatcgcagcctggctattgcaatatacatacagaacatatcaacattttaccattttgagtcaagtgtagaaatcttactttcatttatgttctttagccttctccactttttaaatataattgtcattttctattacattcactgaacaccacatcaggtggtataatttttgtgttaaaaatcaaatgtgatttttaaaactcatgaggagaaggatgctgtagtatatatccctatttttacttgttctattattctctttcttttttgaaattctagtttactatatcatttcctttctgttaggggaacctcctctagtcattctttaaagttagttctgccagtaaaagattctcttcatttctcttcctctgagagtgtctttatttcttgtccattcccacagtgtatttttattggcaatataattcctggttgacaattcttctttttcagaacacaaaataagctgtaccacttacatctgttctccatagtttctgatgagaaactttctgtcattcaaattggtattcctggccaggcacagtggctcatgcctgtaatcccagcattttgggaggctgaggtgggcggatctcttgaggtcaggaattcaagaccagcctggacatcatagtgaaaccctgtctctactaaaaatataaaaattagccgggcatggtggcgtgcacctgtaatcacaactacttgggaggctgaggcacaagaatcacctgaacccaggagatggaggttgaagcgagcagagatcatgccagtacactccagcctgggcgacagagtgagataccatctcaaaaaaaaaaaaaaaagtattcctttataagtaatgtgccatttgtctctggctgctttctagatttttcctttttccttagatgtttaattttctctgcctttttatgttttcaatgttttagttatgatgtgtcttgatatggatttctttgagtttatcatgtttgcgattttggcagtttctttaatctgtaggtttagatcttccacgaaattagggaaatttttagccattatttctttgaatattttttaagcctcacactttttctaggaattaaatgatatgaattgtaggtgttttgttactggcccacaggtctctgaggctctgttcatgtgtgtttgtttgttttcccagctgattttctgtttttcagacgtgtaatttctattgttctatcatcgagttaactgattctttcctctgtcacatctattacactattcagctcatctaccaagtcttttttctttcattggtatttttttagttctatagtttccatttggttctttttttatatgttgtactattttggtgagcttttaaaaaatttgtttcaagaatagttttaattgctcactaaggcattttgttacagctgctttaaaattcttgtggaatagttttaacatctgtgtcatctcaatgctggtatctcttgattgtctcctctcatctgagttgtgattttctctattctttgtatgatgggtgattttccattatataatggatgttttgtatagtatgttaggagattctgagtcctatttaaaacttctattttagtagacagtcacagagtcacacagtttaggtttattatgtaggttctggcctacttgtgtgggctatggtacaatgacaatttagttttcagagccctgtccacgttattttgatccactttgtttacctggtgccattagttcttgctggtcccctgctggtccttcctgcaaggcagaaggcacgttccagtactgcctggtgctatcaggtaggaagtgagatacatcaggcccaaagggaagacattacttctctgggtctgctcaccaggcagcccagtgctagggtagagtgaggacacctgctcaatgtccactagtgttatagcacgggaggaggacaccctaccagcactgcctgctaccccaggaggtggcagacctggaggaggacaccctaccagcactgcctgctaccccaggaggtggcagacctggaaagactagaatttgtgtgcaggctttttttcttcactgggatcttttacagacttgaaaaattatttttatttccctcctgagctatgttttcattgtgggccagacaatagagctgtcaaatttctgaaacctgcttgcctaaaatctttgcccatactcatcaaggtttactccagggaagcccatttttatttactagcagctgtttttatcctctcatgtcaagcagctcttcctctttggtcaaacctgatccagaataggtgttttctttatagtttcttctaccctctaagagatgaaatgaacagtgtagaggctaaagacttcatcagaccctccattttgtacagaatgagttatataggtctacaggctcaacattcccagtttctaaaatactttgcctctatgccaggtggtagctctgaatttaaaaagcattctgggcctggatggctatccatgaactactgtcacagtattaccataccttattttttctcattgtatccttactcacatgccttccaccacgctctgaccatatggtttcaaaatatctgtattttccatgcttgctccagcctctgacttctgtaatacctgtgtctctgaagcacaatttacctttccattcccatgatgtttgtttcataaaatttagtgctgtccaaaaacagtgctgtccatgacactgtatttgccaatttgccatccaccacctcgtgttaaatgtgaggctcccctcgtgtgttatttgtcttcatcatgacggttgcatgaatacctgaggccctgagttgcattcctgatgttctttcaacacttctaactctgcacatgttcagcacccaaacctctgtagccactcattcattcatctattcagtcatcatcttcccagcatgttgtgtgccagataccacgttggtgctggaatacagctcaaagagcttccaggccatttggggagacagagacaaaaacacaatccagggtgatcagtgctatggcagagagaaacagagtgatgtgggagagccaaggggggttccacccagcccagaggaaccagagaaggtgtcctgaagcaggacgggctctactgaacttccgaaggatgagcagaaattagtcttgtgaaagggaaggaggagagccagtattcaggggacacacattgccccaagtcagaagaatgccaccagttgtcatctggcctggccattggtcaggatccatgtggaggtgtgacatggaactgcagccataggagagctggccagacgggcttcaggtgccaggttgggagcagtgagcccccactgaagggctgagagcagggaatgacttgggcaggttatgtgttgtggggctcactcaggctgctgtgtgagcctggattctggggggtagggtgcagaggagacggggcactccatgctaaactgagtataatcgagtaccactagctaaacaaccaacccaccaacaaaaccactcctctctgtgctgccagagctacccctagaccattgttcatctgggcatttctcaagcaggggtccctgctgtgcgggggttggaaggaatatcagcagggtaaacacaggagctgcaggtgataggaaaagatctgaggtttaagtgcatctgtcacaatagttaaaactcacctgcccctatcacaaaagcaaacatggttgggcacacattcccttgggctccttcattattgtctgtttccctttcagatgtgcccttggggcccatttcaactggatctttcctaggggcagtggtcagtgcaggctagtgaggcaagctcaggccttgaagctagaccaacctggggtcatatgcctgctgtgtcacctgccaccttaactttttaaccccagctctctcctctgtaaaggagtgtaaccatgcctaccttgcagggttgctgcaatggttagagatgatgttggtaaatgcctggtgtggaataggtgctcatttaatgtgagcagtaggaactgcagggccttctgcagtctggggccctccctttaatacccctaaacaagacagagtaacagctgacgaaagactagagtcaggacttccaggcaagaaatattacagcctcttttgtaatgtcgcaaactggaaacagctcattaaaagggaaatgttagcatgaactgtggcttttgtctctaaggagtattaggcagctaatctctctctacaaagaaaactaggaaaatgtccacgaaaatctttcactgtgaaaagcaatgtgtggtattttatgtactatgatatcatttgtaagattaaaagaaaaaaaggctttctcagactatatgggtttgtaggatttctggacaggagggatgggaggaagaccacaccccagagtgctaatagagattatctcatcgggttaggaccttagggggttgagggatgattattaacccttgtcatgccctgtacattatttgataaaatatatcaagcatgttttacttttataatttacaaatcttaaggaaaaaaaagacctagacatgaattccagatctgcttcttataacctaataagttatttaatttctccaagtctcactacttgtttgccaaatgggaacaaccctcctcctcccagagttttgaaatttaaacacattaattcataatttattccacaaacagagattgagaacccaacagggccaggcaccatgctggggcttcaccagtgaacaaggttgatatgacaccttttccagcaaatgatatatggcacagatgtttatttgcccagccacacagatgagtgaccaacagtggcaatttttgctttgtggcaagaaagaggattgggggatgatttgggagtcatgagcttttggtgtctttcccagctgacctcacagggtgccccctgctcacatggagtagggcctggagcaggcagggacttcctgtgctgtgttctctgcagcagcctccttcctcctggcttgtgtttcagttccaaagcccaagaggagaaatggggtgaacttctccctagctgtggtggtcatctacctgatcctgctcaccgctggcgctgggctgctggtggtccaaggtaaagcaggcttggtcctgtgtagtccctcctggggggagaggggtgacccagctgggcccctcagatgaagggctcaggttgagtggagagcctcgggccactgctcccatctgctgggagacagtctcagcccctggcagccacagtgatgagaggagcaaagaaggagtgtatgttgtgtgtatgtgtgcctgagggagggagagagagagacattgagaatgctcttgtgagcctatgtgtctaagcagtgaaagacatcataatttcacacgggggatgacacacacttctgacatctaagactcccagcctctgagtgggaagggctttgctgatccaagtgtccatttgaacatgattttacttttgaagtattcccaatctaaaggttaaagtcatgaagtcgttccatgagcagacactgaagtcactcaagaacgctgaatgagcagttgtcataaacacgtcttgtgtgtattaagatcacacacgaatgctgcttgcacatatttaggtcagaccagcatgttagctgtcatgcatctacacccagagcatgcaggaaggtcttaactgcctgaaggttggagattgattgtggatgcagtaggcacagctttaggccacgcagaaatgttttgtggacgtgcaatatcatgcctgagtgtggagcgcacatggtcaagatgtagaaaaggccgtgtgctcacgctaggtcctgacagcacatggaatttgtgtttacaaattcagggcctgtagaagttatgcacacatgacacaagaatgtcagggatatgctcaaatgcctcagtccctaaaagaatgctgtggggtggggcccagttctgaatctgcaggcgcggctccgggtcctggagatgtatttcctcaatgacactctggcggctgaggacagcccgtccttctccttgctgcagtcagcacaccctggagaacacctggctcagggtgcatcgaggctgcaagtcctgcaggcccaactcacctgggtccgcgtcagccatgagcacttgctgcagcgggtagacaacttcactcagaacccaggtttggcctcctcccctctgggtcaggacttctcaacagaggtctgggagacagcgggatcaggaaccaggaaattaaggaccctgtccaagcaaagtgtgacctccaagagccagggacttagagcaaccagctcaatgccaagtctgaacccagagtccccacatggatccagaatgtctgggagggagggtaaaacacagagcctggggcggttccctggaccactcccccacagctgacttacactgacatgaggttggggagagagcaactgaaggcaccaaactagttcagacaatgtggggactttgtggggaggaggacacccggacctgctgggggaaaggtggtgacttgggtggtagggctgcaggctggggaaaattgagccaagggttaaaaccccaagggtgccccttccctcggtgctctcagggccttgcagctgcaccctctcctctctcagcctgccccaaaatgggaagagcctcgccctcagacagtttcagcaaaaccagctgctaggtgtggctcaactgttgtagggtttaccccgtgacacagagctccagccccagcagggttccttgctctgggccctgtgtgagctgaggcttaggagggtgatcccatggctaggtcctgtgaccaaggggtacgcccagcacgggacccaggaggccaatccctccagaggctgtggcctccccagggagaaaagacgaaggctgagtgggggtgtgaggaggggcgatagctgtgggcagatggaaggagtccacgttcagacacagacaccatgggagtgtctcttccttccttgaaatgtgaaggagctcattttgaccaatacgaaggggttctacctcctcaggctggtttgaagcaacctcctttccccacctccaagactcccagggatctacaggtctcggggtgcagtccgctagttgcagctgagcatctggctctttccaaggactctttcccaaaaaacagccaggtgcttggctcctgttgtccaaacccccacagtctgatgggagccccacacaggagggcttaccctcccactgcagaacctgggcactctcagttggggcttgggccaagggtaccccacagctcagctgcagctcactctccttcccttgcagggatgttcagaatcaaaggtgaacaaggcgccccaggtaggttcatttccactcacacccaccctgctctttccccaaaacctccccaaaagggccccttggcctgtgccattctgggtctggacagctgaccctagcttaccttcccctgtctccacagcctcctttgtcttcagttgggtctcctctctgttcccagaacttaactggactcccagaccctgggctgtcatccccctccttacttaaagaggcttcctctctccactcccccatccaaatctagctaccttcccaggccagaccaggcatcatctggctgccagggcagcctctctcctggtttcctgtaagcattccttccaggtgactcttacctaccacatacatagcacttcccaccagaggtgctgtgctcatttccatggtgtctcactcctctctcctacagggcagtaatgatgggaggcaggtgtcatggaggcgcaggctgtgcggtcaggccgatctgagttctaatcctgggcctggggcttactggcggtgtgactctgggtcagttacttaagttttctggagccccagccactcacctgtgtaggaagcagtggagataatcgactcgcctcacagagttgctgtaggactcaagggagtgcaaaagctgtctgacaatggcatgtgctctctgaggacaaggctatggttgtttgccttttcttcctgcctcaacccacatgtgttgtgttacacacacgcttcactcacagccctgttccatttcatctgctgagtggttgaaatttccccctgaggataaatatacatgccatttttgggacagaatcctttggtcccataatatttcaaggatggcccagatcacaccattggccagggagggttttgaggcagccttgcaaagtgatggaagcagggacttgggagactggtgggcctacagaaaatcctggatctgcccctgtaaactgggtggccttgagtaagtcacctaacatttctgagctctatgtcctcccccgtaagatggagatatggtaggacttcctaggattggtgtcaggataaaacaataaatgtacacctcttagtccagtgtccagcaaagagcaagtactcaatgatgttcttgtcttcgttattattatgactattatttgctattgttatatatggttgttattctgttattcttgagaaaactaaatgctgctgctaggagagcctccagcctgatgaatgctggctcctctcctttaaggaggggcagtttcaacaatttcaattgcttttgctgacagaatcaatgcttaaacttcttctcaacccaatgggttcagtacaaccttcaaaatctgcctgtcacccgccctaggcacagtgctgcccacctcaccccagagcacagaacatggcttctatggctctctctctctctgtatgaatatagatgtgcgtacatagaggaaaactccaactctctctctccatgtctctctctctgtctctctgaatatagatgtatgtacatagagaaaaactccaactctctctctccatgtctctctctctgtctctctgaatatagatgtatgtacatagagaaaaactccgactctctccatgtctctctctctgtctctctgaatatagatgtatgtacacagagaaaaactccaactctctctctccatgtctctctctctgtctctctgaatatagatgtatgtacatagagaaaaactccaactatctctctccatgtctccctctctctctctctgaatatagatgtatgtacatagagaaaatctccaactctcactctccatgtctttctcagtctctctctgtctctgacttctgtctctctctctctctctctgtctcttcccactctttctttttgtgcccagaaaccagagacaggaaacttcttccagcagctggggctatagaagtctcggctcctcctcggacaccacctgcctctccagattccccgcccatcaccctttcccacccagggaggctgtgttctctccccttccccatggcttgccttgcctggtcaagacttcccagaggttcctttgttgaaaaggctccagagacaaataggtgggtgggggaggagggctgggtgtggaacccagaagtcatggtctcactggaggcagcctgccggtggaactgccttcccacgcaggctgcctggaacacagtcaggggaactgctcctcagccaagcttcagggaaggggattgcgaaacccacttgcctctctgtttctctcccctatccatcctggacttctttccttcctcccaacaaatacctattgaaagttccatgaggatgagaagtcgcataggcactggggatccagacatgaagaagacagacaaggccctgcccttgtgagccttcctgtgagcttgccttgtgtgttttccatgatggtccccacgtggtaatctcaggacatccctgtgtaattagtacactaattccatcttactgatgagggagctgaggctcaaaatgatgatgtaacttgcacaaggtcacccagctaaaggggcagtgctaacacctgctcctaggactgtgactcagtgtctctcttttgctttctaggccatgggtttcttgcaggaggagctctgtcttctttccttctttccacacagttggctcatccccatgctcagtgaacgtttgttgaatgaatcaccatgtaagtgattgcatggcgttgttgccccatcctgttgactgactcattagtgtctctgttcctcttcctcaggtcttcaaggtcacaagggggccatgggcatgcctggtgcccctggcccgccgggaccacctgctgagaagggagccaagggggctatgggacgagatggagcaacaggtacgggtctttttcttctgaccctcaatcattttcctcctccttctctggcttcactctgaattccctttcccttccaggcccctcgggaccccaaggcccaccgggagtcaagggagaggcgggtgagtaggtgctgggtatgtacccagaaatacacagcaagtttctcagagtgactgctgtgggctgcagacgcagcctccctccagagtctggacctctgaggggtctgtaggtgaacggaggcctggtgggagaccccagaggggatgagaggctgggaagcaccctttctggtggccagagtagggctgggcagccgccctcaggggcaggtatggctagatggccttcatcctagatggggctggggggtgtgactcctaccccctcctctgtgtgagaatgtaagtctgccagtgccactttggaaagttggcctccttggtccaacaaggactctggtgtcaggcacatgcacctccaccttggactagctctgtgcccttgggaatgtttcctgatgttcccaaagaaaccgagcctcagtttctttttctgtgattggggatgagagggctgcagagggctgccagggggattagagacaatgacacaaagctcatgatcgttgcttggaaagtattagtttccatttttttagactgttgcctaattctgcccagccatcttattaatataaatgggttcacggggcccggtcagagaatggggggcccagagctgtccctccccagggacaaacccaaacatcagttttccattccactctgctcccatccacccttaatttagaaactccaacttgcaaattccgcaaggggttgaggctgctgggatgtgaagatgcgaagacattaagacctttactagacaaagggcagatgagaggatttacaagggagtggggagtaaacaaagcaggtctctaagccgccaggctgctgaggcagaaagaaaacaccaccagttacaagaaaggaaacttgttaggaggtagaatcctccagaaattgattttgggaaggaatttaatagaagggaccccaaagagcctattgatctgtgtccagcagggggttttctgaggagggtttaagcggggaggataggcagaccagaagaaggaaggtttatggtgcagtcagaggtgtgcacatgcattcacaccacacacactcacactcatgtctgagggcacatctgtgcacatacttgcattctcacactcactcacgcaccaatgtaatcacactcatgcacacacatgcactcacatacacacatatactcatgcacatatatgcactcacatacacgcatatactcatgcacacccgtgtctgagcacacatctatgtacatatttgcattcttacacttgcacaagtacaatcacacttgtgcacatatgcatatgctcacacacatttgcagacattcgcaccccccatgcacacacactcacactcagcctgtgggggcttgagcagagcaggctcactcagaggggagtgggtctccctccatcctctttcctccgagagagagggactcaggctaggtgactgaaactcaccagagtggagccactgaggctggcttgaagggaaaagccagaagcctgaggagcacagtcatttccttcaagaaggaatagagctggagcctccccttctctttaggactctgacaggtaggcacatcacacagccttgacagagggctcagagcaggactgtgcaaccactagcactaaaaccaggcaacccctttttcagcccaaatcatctggaacccacatacatgaaacagatccacaaagtaggctgttgtggttccatagagagtgtggagtccagagcccatctgcactttctgcttgggccccactggcatcctcaggaaaagcttgtgtaattcagcaactcacttagagcctctctatatacacccacctcctctcactcctctccttcccatccttttccactttgcctcctggatccctcaatttcccctcatagtctcaccatttctctcctcaacagatccctccctgcccctgcccctgccccaggaacacccagcacctccagtctgtactccatatgctagccttggatacctgggccatgtgggtgggaatcaccgtttctcaattccaattttgtcttagaacactaattatgcatctgctgaggacaggtagtcattagcagccccattttacagatgagaaaattcagatgcagaatacttaagtgacttttccaaagttatcagcctggggagtgacagagctacaattcaaacacacttgcctgactctaaagcctttcctgcactgccatgcaggacatattcctaggtgctgttctggacctttgggaagagagctgtcttagcctgttttgtgtcactactacagaatacctgagactgggtaatttacacagaatagaggtttacttagctcatgattctgcaggctgggaagttcaagattgggcagctatctctggcagcttctggtgagggccttgtgttgagtcaaaatgtggtggagaaatggaactagctctcttggtaactaatctagtctcacaagagcaggaactcactccatcttgccagatgggattaatctcttcataagagatctgtctttgtgacccaaacacctccccactaggacctgctgcattaaggaccaggcttccaatgcatgaacttttgagggacactttcatgccatagcaagagcaaacactgcctggaactgccagggactctgctggttgtgtttgtgcaatcatatgtgtgtgattgtgtgtgtgcatgtgtgtgaaaaagagagagagagagagagtgagagtgagagagagagaaagatctccttctgggaaccttgctcaactaagggaatctagaatgtcagctgattaaagacattttagacattctcaggccacagcaactgagctcttttttccttcctcacaggcctccaaggaccccagggtgctccagggaagcaaggagccactggtaacttgtacttgctctgctagggacaaatgatgcatagcctgaggcactgaggcagttcccccccaccccccatcctctttccacagccccaccccagcccctgacagttactgcccaccctacagtcctcttctcttgagtcctgtcacatttctttaagaccacccaagaaatgagctagcacatcccccagaggaaatctggggatcccattcccttctctcccaaatgcttcctgcccctttgcctctggtagcctgtccccaaaaggatagtgggagcccatctcaccagccattctctttgcaggcaccccaggaccccaaggagagaagggcagcaaaggcgatgggggtctcattggcccaaaaggggaaactggaactaagggagagaaaggagacctgggtctcccaggtgagggccgtattgggggtgtcggtgcttgccaggaggcctgagggaactagggcctgacctctgtgccattgggtctattcagtgcccactgagggcaaggcagtgctctgtctatgggaatctctggagcaccacacatagtctcttctttccgggtgagcaaagagatgcaatatgagagggagaacaatgtcattccaggcatgactatggcaagctggggcacaggcagtgctaggagctcagagaggaagccaaggggatgaggagagtgggcctgcactgggccttgggaagcagggcagactgactggtggcaagggcaaggggattgattcaaggagggagaccccaggcagccagaatcccccattgactgagggtgctatctctagaacagtgttcctcaagccaagggccaatatcataagagctgtttgggtgcttgcttaaaatgcagggagggctcgagggtctgtttcaaatgccctggatggttctgaccatgaaggtctgtgcaccacactcgaagaaacactggcttatgggctctggacttgactgagcatgccacgctctccgcctctcagcctcctgcagtcattggggaggctctgcagtgaatggcagagagtgaggattgcggggccaggcgggcttggttcccatccctgctctgcacctgctcccctgtgtgactaacgcaatacttcacccttctgagctttaatgttctcattttagaaaagaatggtaattaagttaaaaaataattaaattagatatattttacaagacagtaataagggttagagaccatgttttcaagctgtctgcaacatgataggcattaaatacatgacaactagtaataggcattaaatatgtgatagctagtaatagtaatagtattagtaataataatagtagtagtagttatcctgtaacgtagaaagggaaggacttcagtttcaagatcagacagacctgggttctgatatggctcactaactgtgtgaccttgggcaaatgaattaacctctcttagcctcaatttactctcctagaaaagggagctaataataatacaaacctttaatgaggatgaattactgcaggaatataagacatatgagatgtgtaccactgtacctggcacatgggaattccttacaaaaaaactgggaagccttgccctcaagaagacagcccttagtagggatgtgtcagccatcctcaaatattcaaagggcatttgtgggaaagaaaatggtcttgcccagggtggtacccagcagaagaacaaggaccaatggactaaggtttcaggaggaccaattgtgctaaggcaagggaggaagaatgattcagaacctggggctgacccatgatgaagtgcgtgggcatgggttttagcgggaagctgactgctgggaggggaggaggggctgcagaattctcctaggctggtctgatgagggatactggcaccaggaacatggttgggtggttgacctctgaggatccttccaaagctggaacaacacagttctctttatagatgggaaagggagacccagactttctcaaggtggtcctgccagccccagagaaggggcctcagccaggtctttgcccactgagtctgagttatgcagcttcccaaccacactgtcacaaaggcacgcatagaatccacacccagactcaggcttggaaacgctgtggttggcgaagggaaaggcagcagtttgagttcttcaaaaatcaggactcaggcccacccctcctcttcccaaatttcctctcccaagatcatgaggtctctcttacccatggcttgctcaatccactgctggtggctgggctgtgcaaaccaagagagacctgaccccaatagtgctgagattttacctattctcttcctgctagtagacagataagccaccaacttaaagtcccaggggataagcctattttcctcactctactacttagctacagttgggaagttctgaagtcaggcagctgtgcttccttggctagagccagagtgtggtcctctgactgatgtgatactgccctcttcccaaagccattccctttgctggggagtggaagttatagcaacacagatgcaggtccagaccattctgaagaaacttcatgtggcccagcaatgctgtaacttgatggtcctggcccacagcaaaaaaggcaccaacagattcctccagggaaacagttctcagtgccttctaacaggtgccgttggccccttctccagggtggacactctgaacggccaagaacagcctcctctgctttttgcatctccagctgttataggacgcctcagccataaccaagttccttaggattgctttgtcttcctcaaggagcagccacccttcaagtattcagccatctcaaggggtctgattcatgagcctcatacctcgtgaattcacagcactcaatgctaagacccagggctctcccttcttcctcacctcttcagagctctctctccccttttctaattcactggagagaaagctggtgtcatgcctgagtcctccccagcttcagaattatcaaaatcatagattggagcaataaatgccttttagcaaaattgcatcccaataagcctttttgaaagcctaaaatgttgtgttgaggtgagatattcctctttagacctttgccccactctacccacccccaggggagtggagttgagcacggacacccagctgatggtgggaccttggcagcctaccagtagtaccctgcattgcatggctggcaaggtccaggcagtccacccctaaaccaaagaagtcacagagccctaccccagtgaggagcctctgtcaattgatatgcaccaggcaccagcaagagaggagggagcgacagaggactcagaaggggacaggctaggatgagctctgaattctgatgataagtggaaaatttgaaatcttgggtaccaggaaagcccatgtctgaagtgctggcaggaatatgagctgctgcagtgtttttctctctattgatgcctcagagttgctattctcagcatttgggatctgcttttcggaatactcaggtttcaatttttgaagtgaattcaaataattgccaaaatgcagacactaaaacaagccagacagtgctggctgagccttggctattgtccctcccaaggggaccagggctttctgttgactgtcagccataccagatcacctcaccaaattttcatgagtttctttcttgtctctggggcaaagcggtgcactccttgagggcagcggtcatatcttccactcgcgggcaccaagtaggagctcaaggagtttagggtttgggatttcagtggaatgggaagtgtcagaggaggacatggtggcctgattggagttcctcccacaactaaccaagactttttggtttttcaggaagcaaaggggacaggggcatgaaaggagatgcaggggtcatggggcctcctggagcccaggggagtaaaggtgacttcgggaggccaggcccaccaggtaagagggcacgtggtcacatccactgacctctaggtatttccttttttttttttttctggctggctgagccaaaggaaaaaaaaattcctaaaagttctttttcatcttaggtttggctggttttcctggagctaaaggagatcaaggtaagaactacaggaatctgggcatcatcccagctacgactgtccctggcagagtgaagctggggaccagacaccaccatcttttgcttcattgtagtattcacccagaacacctggggttttttagacatctggccctggccaagaggaacagagcagccagtgggcggtgggggcaggcctcactgatgtttctctctagactttaccccactttgccacccagggggtggagttggacagtcacacccagagctcctagtaagtccataagtcccaggccctgcagatggaaaagattagtaagttgctgagaataattttcctcctactaagagggctagctcatggcttctaaagagaggtgttaaagctgccaagaggactgtaaggtgttaagaggtacatgtctcactgctgaaaacagaagcactgggggttggggtatctgggccctctgccaaccaccacagcctggcagtcactactttcctttcaggacaacctggactgcagggtgttccgggccctcctggtgcagtgggacacccaggtgccaagggtgagcctggcagtgctggctcccctgggcgagcaggtgaggtcctgggtcctatggtgggcacagggagtgatgtgtgaaaacctgcctagtccagcccttatgctctctgtggtgtctgttgtccaggacttccagggagccccgggagtccaggagccacaggcctgaaaggaagcaaaggggacacaggtaacagagggtgcagtgggtgagtaggtgggcttgctgggtggcaggatggatggagagaaaaactgcttcttcttaggcccacggaggaggcagagggtcttctgtgccttggcctctgaggttcctggttatgggggcagttgcccctgccaggaccccttaagcccaagggcctagggctgttctttctcttctcagagctcatgaaagtccttgaatgccatgaccaaacctccagcatcacggaggagagcaaagcaccttgcccataccatctccctggtctgcctcccagctgtacgtttctgctgtctcctgctaacccttcattggggcccctaagagggggtccaagagtctagattcaggctggagggtccagaaaactcttcttccacattttcctaggggggcagcctgggagcactgacccacactagccaaagactagtttataccataatgccaacagagtctaggttagtctaggttatataccatcatgtctatttagtctaggtcgtaaaccattgtaccaatatagtctactttataagccgttttggtccagtcacagtgtgcttgcttggtctagaaagtccagaccactatcacaatgcataagatcaattcctgcctttctgccctgacatgcagggtattgcagtgaacagagactgttgccagatgatgtgggcacactctgattgggcatttctgtggagaactgttgcacattggaaagccaagagtgggcaggaggggcaatggggaaggcagggttgtgatgtaaagctgcatgtctgccaaggacatctgtagacagtctgcctccacccctgtcctctgcctgagaaggtcacgcttgtgtcagacaacctggatgccctcacccccgtgctgtgctagagacctacactgggacctggccctccacagctctaatcaattgattgattcattcatcaccacctcctggcaaaccttgggctctgggcttgagcttttgtgtttctttgaaagctgtcgggagccatggcaagcgcagttttacaccctctctgtccttgtaatctgtcgagccccagagcaattgtgttttttatggacagtgtgtttgggaggatccctgctacctgatcccatgtggatgccacctgaaggccactagctgggtctcaccataggaaagtttccatctgggtatagtcgtcagatgttcctgacttgttcactgtccattctgatcttataattccatcttctctggtccccagtctcagagtccatctgactatgagacctgatgctctcttgcccctgagccttctgtgtgatttcatggagatgattgctttcatctctcggttgtaaatagtagtcaccctctgcccccacccccactgccagactaacggttctcaactaaccaagagtattggaggtaaaacatgattttacccacaggagcattgtgcttactccccaagccccaagcttgtgtcttccacagtctgagggtagggaatcctgccctgccctttgcatcctgggaggatttgcagaacaaaagcagctcctgctaatgagcatcttcttgacacccagtgggacaagcactctttgtagcacaactttacggtcaaacagccattaagagatgcagccaggttcaaatctaggccagtacaagacaaagcttgggatcttattagtacagtctatcatgagttctccctccccagccccacaatcagggtgtgctgatgagtgacacctcctcccttcatcccagttcagaaaggatcagagcagaaggtagcagcttgttccattcctgggaagaaacatgaagctttcaggccctatcatggttcttagttatttaaccaggaccccacacccattttagcaaaagacttttggcccatagcttggggatcattttaatttcatcctcatcgagaccttttatatctgctgaatacccttatggagttctccaataattaggcctagtggtgagtaccagccagcaaattctaggggttacccttaattctggctgaccaagtaaacatgaggaagtgcatttcaatttggggcttgtgataattcccgtttatctaaaactgtgcaggttgcccacccgagtccaaatgttttccttgatttagtagctgacagtccacatggacatctcagaggggaattccaataggaccataatctggctaatttagctgggtatgtagatcatcctggagtcataggctaataaacttccggagagattagatttgacaacttctgaagtgggagaagcaggggcaggcagagggtgggagcccaatctccccatcatggagcacagtgtatacttgtcaatgtcaggatgtcggtattccccaaactaaagccactgcagtgcttggccagtgttgatatatcaagccaggtttccaaactgatgtatttcccattttgtaaataaaatcgttaatctctcaagagaatatctagccactttagatgaaaacagaaaaattacagtgcgttggcttgacctaggtgacagctaggtttcattactgtgcattaattattttaaaaacatgagcggtctgttcattattatcagtgcctctgggccaggcactgtgcctgggtcttgactcccatgatcacactgaacttatcattcctactttacaaacaaggaagcaaaggctcagagagagtaaaccctttgctcacagtgtcacagggagcatgaactgaattcagaagtgaatcccaaagtctgattccagagttgtgcttttccagaatcggttttatggaagaacgtagagtgtatgatttgagagaaatcggttaccttcaccctgtccccaccccagccacacctcccactcctccataaatgggtaaatcctggcttggtcaccaagcctttctacctcctccacagccactgaccacactctaccccattcaggtgaaatgcttcctcttgtttgcatctcttgagagaggagccagctcatattaaagaagacaaagaggaaattcttcccattctggtgggaagataacctccacagtttattaagcaaggcaccataccctgcagaaccttctctcagggtcactttttttacctactagaaacagaccctgtccagcctccatcacttagtatttctaacattttcactttcaaagattgcagaagaataatccaattttagctctacatgtcttagctattttgaaataatatttatttagaaataaggaaggactccacttcggcttgtaatcatgacatttctctttttaccatttacacctcatgaaataacattagaagcagccaaaacatttaaactccaaaacaccaatctgattggaaattctttatctcaatggcctttatgtctaaactatagcaatgtgaattttccatgcccttttattttcctcttggggcaaaaccgaagtgcaaataactcaaaatccattttctcatctgtatttgaagatgttttactttaaagataagccaaaaagatcatccataatagcaattgagccctatgtcatgaatataatttcttagttaattccattccttatatctaagttctgagatagtccaataatttattaaattctactaagtcaaatcactaaattgtcatttataaaactcttcctcattttcctctaagtttctgagagagctctgcagaagtctacacataccccaattttgagtcccttatccttcatctcacttcttaccacaaggtcgatttgtcagttattagctcaatcctaaatttgccaggttgcatctagcctccaagttggcatggtatttaggaaagtttccccagacggggcaagacagcaatgtccccctctctacaaaacataaaaaaattagctgggcatagtggcatgtacctgtagtctcagctactcaggtggctgaaggaggaggagaaggatcacttgagccaaagaatttgagcctgcagtgagctatgattgcaccactgcactccagcctgagcaacagagtgagaccctgtcaaaaagaagaaagaaagaaagagagagagaggaaggaaggaagggagggagggagggagggaaggaaagaagaaagaaagaaagaaagaaagaaagaaagaaagaaagaaagaaagaaagaaagaaagaaagaaagaaagaaagaaagaaagaaggaaaggaaggaaggaaagaaagaaagaaagaaagaaagaaagaaagaaaagaaagaaagaaagagaaagaaagagaaagaaagaagaaagaaagaaaagaaagagtgtgagagaaaagaaaagaaagggaaagaaagaaagttttcttaatgtattggagatttctccatttcactcagaatcaggagatctgagcctcagcttgaacttacccctgactagctgagtgaccacaggctcagctacttgacgttgctgagcctgtttccttttctgtggcgtgcaagcagtatagaagaacaccaggtccctgacagtttcacagcactctgggtttgaaataggcagcttccctgggagcaggaacaattgaagactttagtcagaacaccagctcaacactaaacaactggaaggcatatgttttctaacttaacacacatttcttgggagaatattatttctgtaaaaacactttgcaagtaaatatttggaaccctttcagcttgataagcttgtgatacttggggaaagccagcttgcttatggttaagaagaaaaatccagcatttatttgctctccagcgtagttttacaacatgcagctctagaacctattttttagccatttctccctctactctgcaggagctgatcctatcaggatgctgccttgatttatagtgaagtaattactagttcctccatcgattagtccatggacaaccactcagccagtgttctcttagagtccagcgaggcttggagagaaatgatacaaacctcaattctaatttccaatacccattaaatacatatcagaaggcatttcatcaaggtccaacctctgctataggaactgtgggtctgggaggattcagatgcgagaggggctgtgagctcctaaagagacaaggaaggctgctcgtaggaggtgggctgtaagctggtcgctcaagaatgagtgagagttgtttagggcagtgttactcaaaatgtggtcctgagacttgcagcattagcatcacctgggaacttgttagtactgtggattcttggattcccactccagtcccactaaatcagtgactccggtgggacctagcaagttgtttactaacaagatgcacccagatgattctgatgtattctctagtttgactactcctcttttagggggaagaaatggcctcagggaggctggaggtgtcttgggaaccaagtgcgtagaccaagtgaaactccagataggagtgagcctagtactagtggaacaaaggtgccttcagggaacattgggaggctgggcctgggtgacagccccaacttcccccattcactcttatgtgaccttgaattactcacctagcatctctgagtgtgtactttctcctctgtaaaggagggaaatcacactgccttggagggtggctgaaagatcaaacaaggtcatggatgtaaagcccctggcacagtgcctggcgtgatgcaggcagcagaaaatgctgagtcccctggaggtgaggagctaggaagggagagtgtgggaaatgaagagggagagtcaggcttggggctatggacctggtgaacaggggcttccctatgattcctgtctttagagggtgtttgctgctcggtgctttaggggacagttggaggggtgcatctctttaggtggtcacaataaagggtggtcacagtgttttgaggccccttctacttacctgcatgtgaacagcgtatgtcaagactggtggggagaaagaccacaatctatatgtctatgatggtgatgaagcaggaaacagtccacatccagactcttggccccttctatctgcatcccagagggtgccatgttgcagaaatctctaccttaagagcgtgtccctagaggtagggttcagggaccccaagacatagtgacctccctggatgtggactgttttctacttcatcaccatcatagacatacagaatgtgatctttcgcccaacccatcttggcgtatgctgttcagatgcaggtaagcagaagggaaacatctgtcgcttctcctgggcaatctcagctaagcccttcaggtcaatagcagacattttctgggtgctagctgtgcagcaatcctggtgctcatgtgtggactcaacctcagtgcctgaggtgctccccacctggaggggacacaggacactgtgggtcctgttacatcatttattcagcactggctgggcaccgggctcagcgcttgatacacacgatttcatttcagccttacaactgcctcaggaggcaaacaaggagactcagagaaggaaactgaggctcagagcagggacacctggctcaaggtcacaaagttagtataagacagaagtggactcaagtccgggctgtcagactttggaaccactttgctttactgccttgggagaaaggatatcttgtcttgggcgagggagagaaggcttcacaggtggtgacatctgacatctttgcagagtttacaagctaaatgtgagttctccaggtgaaccaaagcagtgaggcattctattcagagggacaggtgtgtgcacaaatggccctgtgtaagctggggcctgtctgccaggggctgacctctaaggcacctccagctcttacaaaaacctatcccaacctcagttctgtccctttccctaacacgaggaacagaagtagctgccctctcagaatcttctggtgcttcctgcttctcttgttgcctgggtctgcagcggcagctcccagccccttagctctccagccctcctccccaggcagcaccaggcctggaggtgggatctgaaatgcccccagagtcacaacttctcttgctcgttattccaagaaggggccctgaagaggtctgccagccccttgcctctccctccactgaccagcacactgcaggtgcttgggaaatccagggattgaagtgagaggtggggcagggcaggcagaaacttccccgaggcaactgcaaggaggttgactgagctccatgcttggctggggacacagatacttatgactcactgttggtgttcccctcattaccctctagtaactgttattgatagtcaataatgagcttgcattttcccaagtttgtgtaactgccttgaggagtcctatttctctgaaataaaataaatattggcacttaaaatcaagaggacatgatcttgctaaatgaacaaattattatctcagtgacccagcaggatgctggggacagtgggccttccatgaaagtttactgaaaaaaaaggatgaatggatggaaagaaggaagaaagggggacctttaacattaactacaataggatcatcatcaatgactgtggttattatttttccattttctggacattagaccctttagccacatgaatctttagccactgggagccacaatgaaaaaaaccaacaaatacttgaagagcatctactatgcaggaggacctccaaagctcctggtggccactgagcccctccacagtcttttagcaataaagataactttatttaccaaatatctcccaattctcttccaatataaatgcaacagcagggaatgggattggatttagatgccaggtcaggttaccggggggcagggaaggccagtggtgcatctggggtctgtctaatccaggctttcatccagtactttgccgtttcacccccaacacacctgttctcattcatctgcagactgtctcttttcatgatctgctgaagaggctttaaacaatcgtggagaaccaatgtatctttccatctgcattaatcagacaaaaggtagaggttgtctaagattaaaaatgtctaatacctaagttttattatctcctccccccccccttttttgttttgatcttaggacttcaaggacagcaaggaagaaaaggagaatcaggagttccaggtaaagggcaggctgcatcttcatccctcggagtgatgacggggaaggcctgccttctcagagggcaggtcttgttgacattgaatgcacagctgtgaccttctcccaaagtggaggttaagactccagggctctgtcactcaagcctcagatttctccgctgcaaaacctgggaaccacaggaactcaacatcctgaggggtgtagcgtatggggcaggggctgaggatggcaaaggggctgaggatggcaaaggggaaaaatgtcaggagagctgggggtgcaggcagaggctccaggctctacagccgccatggagctgtgccccttctgctccatccacggctgctgcttccccacctcagctgtggcccacttgtctcttcttggcccccaagcttctcctctctgcctcctgctgcctgtcactgggctttcttattcttatcctcacctccagagcctgtgcttcagttgggtactgagctggcaccagctggacggtgtttctaggcctctcaagagccctgcccctgtgagtgcaaaagtgagatttttcagacacatttcttgagcaagttttcttcctcataagctagatattctattatgttttatggttttttttttttttcaatttttttagagacaaattctctgtgtcacccaggcccgaatgcagtggtgccaggacaggatagctcactgtagccttggcctcccgggatcaagtgatcctcccaccttcgtctcccaaagcttgggattacaggagtaagccactgtactcggcctctgttactatttcaattcactaaaggagacatcgaggcttagaaacattctagcaaattctcccagcatggctagaacttccacataactatgtaattccagaaggaccaagaatctgtggaataccaccagctattttagcctgcctgttctcgacagcatttacctaagagttgagagatcagtgcagcccccagatggaccaaagacaggctgaacattcagatagcccagccatgggggaggtctggcagttaaggataactcatttattaaacagtaatgcccttgggtctctcttgggaaggcaaagcagggcacctgatcagggcagtgtctctccttccaggccctgcaggtgtgaagggagaacaggggagcccagggctggcaggtcccaagggagcccctggacaagctggccagaagggagaccagggagtgaaaggtaaggcctctgcatctgattcctttgttcttaggactgtgctttacagccagttctgtaccttaaaataggaaaggcgctgttttaagagttctggggattttcagaacccaggagggtagaggtttatttccttgattgacaagtcttgtgctggggcttgccctaggcatggagcacacagcagcgggttaggcgcagctctagcatccaaggcaggggcgtgaacatgcacttgagccatgccccacgacccaacactcctaggcagtttccatgaaggagatgagcccatcccactccatatctctgaccagaccaagcatccctcaccaatctaacttcaacccctcttgctgtagctcaggcccgtttcttcctgctcagtcattgacacccgcaggacatcccatccccataatgccaggccacaggcgagacccacggagcatctgaccactcccaaccctccacccgctccccactcatgcaaatgcaggcaaaggcgtcctgcctgggtttctttcaaaccgtgtgggttttctcctcatgacaggatcttctggggagcaaggagtaaagggagaaaaaggtgaaagaggtaatcactatttatattatctttaatgtgtgctttaaagtcaattctgcacctgaaaattgtgtgtgttgggggaagagaccttggttctcaaataaatttctcattttggggaggagttgagggtctagtcccttgaatgagcctgcccacggcacagagcagcagtttctctccccagccactctctcccttccttccttctctcccttccttccccctttctccttcttcctttccttttctctctccctccctcccttcctcccctttcccttctttctttcctctccatccctccttcctttccctctctctctccattctttccttccttccttctcttttctcagctttcctttttttctctccacaacacatgacaagacgtggtgtatgcgatttgcaaaccagccacaggggcacctgcccctgtggccttgtgcctgcaggccccaggtgcatggaggctgcgtgccaggttgggttggcactgtaaagtgggatcttccaggctctggtgacagtcaagcaggggcatttcttttccttaactgtagaactccaaaatgaaaagaaagagcccgcacttacccaaagccccaaggggccttccttgcctctcccatgtgtgtttcttcacccaggtgaaaactcagtgtccgtcaggattgtcggcagtagtaaccgaggccgggctgaagtttactacagtggtacctgggggacaatttgcgatgacgagtggcaaaattctgatgccattgtcttctgccgcatgctgggttactccaaaggaagggccctgtacaaagtgggagctggtaagtgagtcatcagccgggggcctcttccccagaggtgtggatgtggctttctctcgctggtggggtgttggcaagtgactcagtgtggttttctttaaaagaaaaatattggtccaagcaaccaaaaagctctgcagtgcagggctccaggtatgcatccttccagcttggcaaccccagcagaaagatggcctgtcttctccagcgctgacagtgaaggctggcctggcttcggtcaaggtccatccagccctggagtcagaatgccacatggctgagggtgtttgccgcagatggctctccaaaggacagctgagttgatgcaactggaagaacagagagaagattcagggcaggcaaacgcagatgttcactccagctgtctgtgaaccagcagcctggattgaccagcaagcagtcttggctgtgatcatctttaaagagaagatgggaagggaagagaaagcaaatcagagcagggacttactaaaatgtgtggaaaatgtcttcggatgctggagactcagcctatatctttcagccaaaagttcaagccttgagcaaagaagttaagtccccaggcagaacccttttctctggctataggatctggcccagcaggacatgaggccagtttcccttgctcccagccccaagtgctccctgtccttacccaaaccaaagcaaatgcccactttagagcagggcgatggcttgattacagaggcatgtgaggcaggtggacgcagcaggagtgaatttgcagggaggaaactaaaggacacccgcctaggaagatatttcaaatagtgtggggtttaagcattaaagatttgcatgagacttttgtcaaagggtagagaatagaacggaggcaaagtcattataaaaacaacaacaacaacaacaacaacaaaaacaggctaagccagccatcagcacattgggccggaatgggccagaatgagtgagaagtcggcagtccacctcagatggaagctcccaggcgcacacgtggcttctttgctttgactctaatcctacccttcttcctctgtctcttgctttctctctatcaaggcactgggcagatctggctggataatgttcagtgtcggggcacggagagtaccctgtggagctgcaccaagaatagctggggccatcatgactgcagccacgaggaggacgcaggcgtggagtgcagcgtctgacccggaaaccctttcacttctctgctcccgaggtgtcctcgggctcatatgtgggaaggcagaggatctctgaggagttccctggggacaactgagcagcctctggagaggggccattaataaagctcaacatcattggctgtggctgagtgtcactgtgttcatacctcccatccccattgatgtgcccactccatgcaccacaacatttcattgaattctctcatgtccgtagccaggggaaggagaggttggaggtggtgaggcagaaggtgaaggtcacctatggtcaaccttagtcttgaccatctcttcagtcattcagacataacatctctcatggtgagctctctatccccctttttgtcctcccctgacagtgacctggtaacattccagcacacacatgaactctcttcatgccctatgctgtgtgctccaccctgactccacctgcccaaccggtccttgctctctctcagcgccctgcctgctgggctaagcccactctccatgttgcaaaccacatagtaagcctgaaatcagtcttagagtctcattgatctttccttccatacatgggtgggatttacagaatggaaatatttatctggagtgacagtaatcaaaaaagttttctgaagaaagcacaatttgaactggaccttaaagggtggggaggatgtgaccccttcttggcatgcagtgactgtcactctaggacctgtaggtataaaaggcttcgttttcctgagcctctcctgtgtcccttcttgtggcaacaactcactaaccatctactgaaagaacaaagaacactaggtatcagcttgtttttttttttaagttttagggtacatgtgcacaacgtgcaggtttgttacatatgtatacatgtgccatgttggtgtgctgcacccattaactcatcatttagcattaggtatatctcctaatgctatccctcccccctccccccaccccacaacagcccctggtgtgtgatgttccccttcctgtgtccatgtgttctcattgttcaattcccacatatgagtgaggacatgtggtgtttggttttttgtccttgcaatagtttgctgagaatgatggtttccagcttcatccatgtccctacaaaggacatgaactcatccttttttatggatgtgtagtattccatggtgtatatgtgccacattttcttaatccagtctattgttgttgcacatttgggttggttccaagtctttgctgttgtgaataatgccacaataaacatatgtgtgcatgtgtctttatagcagcatgatttataatcctttgggtatatacccagtaatgggatggctgggtcaaatggtatttctagttctagatccctgaggaatcaccacactgacttccacaatggttgaactagtttacagtcccaccaacagtgtaaaagtgttcctaattctccacatcctctccagcacctgttgtttcctgactttttaatgatcgccattctaactggtgtgagatagtatctcactgtggttttgatttgcatttctctgatggccagtgatgatgagcattttttcatgtgtcttttggctgcataaatgtcttcttttgagaagtgtctgttcatatcctttacctactttttgatggggttgtttgtttttttcttgtaaatttgagttcattgtagattctggatactagccctttgtcagatggttagattgcagaaattttctcccattctgtagcttgccagttcactatgatggtagtttcttttgctgtgcagaagctctttagtttaattagatgccatttgtcaattttggcttttgttgccgttgcttttggtgttttagacatgaagtccttgcccatgcctatgtcctgaatggtattgcctaggttttcttctagggtttttatggttttaggtctaacgtttaagtctttaatccatcttgaattgatttttgtataaggtataaagaagggatccagtttcagctttctacatatggctagccagttttcccagcaaaatttattaatagagaatcctttccccattgcttgtttttctcaggtttgtcaaagatcagatagttgtagatacg
